United States Patent 8,781,750 (CELL-TYPE-SPECIFIC PATTERNS OF GENE EXPRESSION) - sequence listing, part 8

SEQ ID NO: 36041 - DNA, 312453 bp, Homo sapiens
ggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtaagtgtctgggctggcgtgtctttgggagtcagccttgggctctgccggccttggtccaggtgtgaagttgggggatggggtgagggcggatgagccctcagtcctctttcccctttgagcctggaactgagcaaatccggttcgggtgtgcagctagaggctggggacagagagttggagctcctcgggcaaactgaaaagcctggagcaccttctcgagccaagtaggtgacagtatctccctcttgcttaggaaacctgcagggcggcgtgtctcctgttaagagtcggggttagatccaagtttagtaactgcatttcaggcatgggtactggagggtgtttctgagggtatctagagacccggagaggctgtgatctacccaaagtccagagaccttccaccaagagtgatgcttttgtttgcttttctcatgagcgggggtacctactttcccaggagttttcccaacttcacattttctgtaagcctgtaattcatgttagccgtggaaatgtttaaattgtatcgaactttgtgtggccctttcctctctcccccgtggcattgacttttatgaagggagactgtaaacttgttgggcctgtggctttgcatgcatgcatgcatgcatgcattcattcattcattcatttattaattcattcatttctgtacatgtcctgtctctttcctaggataaactttttttttttttttaaatgtgggcctcagtctcactgtctaaactccagttgctaatttagatttcccgttcccttttttctttatctatttgcatgtaaattgtagactgttactctttgaatgggtgtgagatgcctccttaccctctgtagtgaggcaagttttgtccagttgctaagtaactgaattggttactttgtagaccttttcactcttcctttttccttccccgtgacagtaactgacacgggatttggagtcaaagctaaattccacaaatctgctttatcctgagcttggtggaccagtttcctagtaggtggggttgccgcccagactctcacttacatctggctgtgaaagagttagtgagttcctacagtgcatttccacgttacgccagttaaaaaccagagcagccttgtgctacccagggaaggaaggggaacctctcagctgagtacaagaggaactggcagaggttggcagattttgcaattgattcatgaaatgcagaataggggaaatgtttcgcaaacctgattggaacaggaaggggtatggtgggaaactggccttgaaatgaaaggtttgattgtcgtctgtgcattttttcagacactagggcctctataggagtgattggaagggaaattaaagtcctccaagacttgatcatagagagtgaaggagaaagtatcaagcactcagattcagctttccaacccccaataccttttgcttttcaggcataagaaaagccggagactaagatcaattatgaatccatattttcctctcatccaggggcagttatgtatgaatgtgcagttgcaatggattacagttttctcataaaagacatttaaactatggttagtaatgaactgctttgtttatacgacatttacattgacctattcctgtgggtgcttgtaagaaaaaaatgcttatagcctttcaggaatttctttgtctggtttatggtggagtaactcgagatgaagtctaacctttcagtgtcttctaaagcagtctcaaagaattctgtggaaggattctgttcttcatccttctaaaagggctaaagctgagatttcagcttaggaaatttgaattatatatattggaaaatacccttaatccaagtgaataatatctttcttacccttttattcccaaaataaatattacgtttctacgttttctgtggaatggaagcattttctagagatcagcaatgaagggaggggttggtttctttaaaactttaatttttactaaatttaactaatttttgacctctttgtgatcgggccaagaaatatgacacccacactttggtttatgtttaaagaccacaaggggtcaggacctcaggattgggtctgatcagaaaagtggcatttcgtagaaaagcaagtttgctctttctcccaagcagggatctctttagcagggacacttctggattttcattatgttcccctttggcataccttccagccctaaacttgcatgtagcccgggatggtgctgcgaaaggtttacattcactcgcctggtacacctggagttttgactcattcctctgagtgggttagcagaattatttgtctttgagaaatggtgcttacaaactttattgccatttattattggttttttggaacacatgaagatgaagcaagaactctcaaatttggagatacgctagcagagcaagcaacgtgtgtcgtgctctggcgtaagagcaactactgtgctacttatattgatgctttctggaagatggccttagatatgtgagatgcagaactcctcaagtcaagatatgccagtctctctagcgttttgggtggaggcgatattgaagttaggtctgtagacgtgatctgtgtaagtttgacttctcatactgactcatggtgtgacttttgattagtcaccttgagcattagtttgggttttgcagagtgggtttcagactgcttcaggggtgctctaagcactcatttggtaatagcttgtaaaaacacaatcagtttccatctagcttattagcaagtgtccatgggaaaaaaaaagcttcagtttaatttgctccctcaagcaatcacctgtaagtttcctttggagcaaactttatgcagcctgatgactagattgaaaatttatggtattatggtcaagttagagtatatacaaatatagagtatatacaaatgtttcaactaaaaaaaggttgcttttggtgaaatagaatattatgtgtcgataaagaatttagtgctaaaagagcaatgacttctgtctcacctgtgcctttgtgaaaattagacgttgattacaaaggtatagaaaagctgcaaggaatgaaagaaaatacttttctcttgtaatagagagaaaataaatttcttttgtcattttttgacccagacgttcaggattatattaaaatatcaatttttatgatagctgtaattattttttatcagttatatattttaacacatgtggataatgccagctaaaacaagtcattgcagtaattagatgagttgtagtgacgctttagagaaattctttgtattttatgttctttcagctacttatgcatccttatagaattattgtacttttgcatgaacttcatagttcacatccctacaaagggcattattgtgaaactttagattcagctatttgaaatagaagaaagagagggaaaggagaggtggcttctatctttgaccccctccaaggaaagcaagggtgaatatttaaagcttttctggaaacaggcaagattgtgtgcaattctttttggtatttccctttttctgtgtttgctaacactgtacctcaccatcctggtatcttcaagggtcttggaggtaagtgatcattcagcttccaacatcctgatttttacagatgtagaaactgagggacagaacgtttcaggggtttgcttaaggcaagaaaattgtttagtgacaagggtagcaccagaatgcaggcccccttaattttgccttgatctgcagtctttcatttctattctcaggcacccttgaaaattcaccagccacaaggagatccttattaatggtgtttgttatgggatttctcttagaattcttcagtaatctgatgaaaacttggaggacaacctttgcaaaaataaatgataagtaaataaataaaagcatgtacacaatttgttatatggtttcaggggctgacacacacctcccgctgagggcatcctcagacttacaaactcttgctctgggagtttacattttgcctgtttgtttagttgggtaggtctgtggagctgtttagtctaagtaggagttttttgaacctttcaatttggccctaaggggtttagggaatagactgtgcattgactgaacaataagttgaattacatgcacttacagcaaaaagaaaatatgtgcaaggcaagtaaaaatgctaaatacttttttctttttttcctcattatcccaaactgtattaacagacaccttgagcaagttcatgatccagcagtgaaccttagatgaatgttttccttctccaaaatgaaaggtgggaattgagattctcgggttttaaatgtaaaatattagcacctttctccccacagttgtacaatagcacaaaagcatttctaacataaacccaattagcacagttaaaaaataaggtagggccagccctatggaaaattatgaagttggcaagtttgtcttctgacaccgagattctgattctctccttcctttctcgcctctttctaaacctgctttctggagagcacctgagaacctcaatcacaaggaatccctgagtaaatgttggggtgttatttgctactttcagggacatttgtattattactgaattcagcctagcaaatgagggtttccagtggagtctgtgatctaagctaggggcctgcaggattttactctacgaataatggcttgttactaaggtttgggcaggtcctgcccattggaggccacctttggtcaccctgactctgacagcaactttggatggcaaaaggggagatgctacacctgcaggtggtgttagttctttctgtcagaaggcttgaggatctgccttctcagaacacagtgctagaaactcctgccaataatgacctttaatatgccaatgtcacagcagaagttgtgcttggtagggcctggctgctttgctcacaaccatcttgaaggtgtcttctcaggctatgttgctggtgtgtaaacggaggcaaacggtggtaaggtgacttgcctgaggctacgcagcctgtaagtggctgaattgaggctaaaacccaggttttatggcccgagttgtctgttcttttcacggagagaagaacattcattgctacctcactgcattcgctttgcagcactgcatattcagaatgaaccaggtgagacaaagtggtcattggcttctgcaggcttctggacatgtttcatgttcaaacatgaacacagaagcttatgtttccatgaggttaataactacaggttgagcttccctaatccaaaggtccaaaatgctccaaaatctgaaacttttgaccactgacatgagcattttggatttcggatttttgaattagggatgtccaactctaagtatacaatgcagatatctcaaaatctaaaaaaatccaaaatttgaaacacttttggtctcaagcatttcaagcattttaggccaagtccttctcagcctaaattgtgtatttgaaacaaggtattttctgaacaaggtgtttgagaagtagctattgccatgtaataattacctagcgcttccttcatactctggaagaagaaaatagtgcgttttttttctctcgaggtcataatgtgaatgttgtatgcagtggccatgtcatcagaacaggtgtgccagccccctgcatggaacatgtacatgcttcaggttgtgcggaattaactttctttagataagggataactagcattcatttcagataacagatattcaacctataattgtttttatttaaaacctcttccaccttgaccaggctcctgtaataaacaggattccctccagactagaagatttgctgagtacctgttatttgaatttacttttattagttcatagaacctttcaacaacagtgtgagttaggttatatccccattttacagattagaatgtaggcccctgagacagtaaagtaacaagctcagtgtcacatctagtgagaaaatggcagggttcctacctgggtacttagattccaaagtccattctcttctacaaaatgttaccatcttaaagaatcaaacagagtttctccctgttacatattaacttttaatacgtgaagcgtgagtcaggtgtttgtatatggatcttttttccattgctttactttatgaacatgtttcccgaggaaaaagtttggctcagagatgtcataaaggtggctcctaaacctgacatttaagcactgaactccttcaactcttctgttcaaggggcattggaattgtttctatgtagattctgcttgtaattctctcctagggttcttctaagaaaagtgaggaagctgattagcattctgtctgtgtgacctttcccctactgatagcatcctgcagggtgtccctctgtgattgtaagtgaaagtgaaccctggagatgtcgctgcaggtggatggggatcagagtgactgctgccccaggtagacactgtgatccaatagaatagaaatgaaaggcctatgggaatattctgtttctggaacataccacacccaatgcctccaggacctaaggctctttaaaagaaaaacagtgcttaaaaaattataagcgttatacacaggctgagcacagtggctcatgcctgtaatcccagcactttggaaggctaaggcgggaggattgcttgagcccaggagttctagatcatactagcctgggtaacacagtgagatcttatctttactaaagataaaaaaattagctgggcatggtggtgcacacctgtagtcccagctacttgggagactgaggtgggaggattgcttgagtctgggacattgaggctgcagtgactgatgatggcaccactgcactccaccctggacaatagagcaagaccttatctttctttttttttgagacagagtttccctcttgttgcccaggctggagtgcaatagggcgatctcggcttaccgcaacctcctcctcccggattcaagcgattctcctgcctcagcctcccgagtagctgggattacaggcatgtgccaccacactcggctaattttgtatttttagtagagacggggtttctccatgtggtcaggctggtctcgaactcccgaccttcggtgatccgcccacctcggcctcccaaagtgctgagattacaggcatgagccaccaagcccggccgaccttgtctttcaaagaaagaaagaaagcaagaaaaaaaaaagtatgcatagcctctgtggaagattgggaaaatacagaagattggaatacataattaaatttctttcctaattctattataagtgttagccactattggtaaactttgatgtagtcagtctattctagcacatatatatacctatatgtttatgtggctctgtctctgcatatccaagtaccctggatagataggttaattattatttaattaatggtgagtaaataatgaattcaacacatttttcttaagtgtcttgtttgtgccagacacttatgtattggagctggggctacttcagcaaacaaaacaaactcctacccattcaccttaccattctagtctgtcagttttgtaaagttgaagtcagactttaaatgtatttttggatgttattttttttcctaacattatccaagggcatttttctgttctagtaaattgtttggaaaataggatttttaaggtgtgattttttttttttttctaacccatggttggaccagagtttgtttaaccatttacattttcttacatatattttatttgtttattattattttgagacagagtcttgctctgtcacccaggctggagtgcagtggcgcgatctcggctcactgcaaccttcgcttcctgggttcaagggattctgctgcttcagcctcccgagtagatgggattacaggcacccaccaccacacccggctaatttttgtatttttagtagagatggggttttgctgtattggccaggcgggtcttgaattcctgatctgaggtgatctacccaccttagcctcccaaagtactgggattacaggcgtgagctacagcacccagccttcttacatatttaacttgttttttttttttttcctcattagaaatagtctgtaatgggtttcaccttgttgagtgttttcttcttgactagggtctctctctcaaaacacaatatagaacttcctgtcctgtcctccctaactccccactccaatcccattctgggctatagctgtttttaaggtgaacacccatttagtgaagtagccatcattaaatgactgcctagataaacatttgtaggtgttaattggtcctgccagggggcctttgaagctccactgctctgttctctttgaagttttgtttttctccagccaaaatcctccctggtctcttactgagcagacatccctagacttcactccaagcactgtgcatataaccttgcctgggatttcagaatctgcaggccttacctaggtagatgttactcttctagctaattgtatgcagtttatcaaggatttgtttctgttttctctttggttgttgactccatggaccataggaggtaaatttggacaggtcgctttgacctctgggcatctaagtaaggcctgggattttaagtgtaaaggaggcactattctaagtgatttaaaaatggacagaaaaggagaaatttgtgaggatacacagcctctttttgtgtacccttttgtcttctgtgaagccctttaaaagggagagcctgtggccctgcaccataacagtagctgatcccccaaagttcctggactaggtttttaacttctcagcctcagtttccacatctggaaatggggatcataatactggtctcatagggtcgttaagaaggtcaaatgaggtggagtatgtgagactgtaccttgtaaacattaatgtgttctacagggtggtggtattattaaactcatcttcctgctatttcctaatcaacaacagaggttcatttagtttcgaaacttagctcttcctaactaagccacagcaataacttatctctactttgatacttaagtcctcaggaaattgtggtaggtgccctggaagtccagccattgtttctgtaaagacctacaggggtcttcaagctggggcttgcatgtgtgtggggtaggggtggaagcagttgagggggatccctggggcagtcagatacttccttgactccatggccttcaggttcccaggttgactgctctattaatgcaggtgatctcttttccagttgacttttttttttttctttttgagatggagtctcgctctgtcgccaggctggagtgcagtggcgcgatctcagctcactgcaacctctgcctcctgggttcaagcgattctgctgcctcagcctcctgagtagctgggactacaggtgcatgccaccatgcccagctaatttttgtattttgaatagacagggtttcaccgtgttagccaggatggtctcgatctcctgacctcgtgatccacctgcctcggcctcccaaagtgctgggattacaggtgtgagcctccgcaccccgcctccaattgacttttaagtcctcgccagttgagggtaacatttggagggacaccgtgtgtgagtggagctcagctactgggaagcctccctcggccggttcagcaggcccttatgttgcaaagagccgaaaatcatttgggctaccttaagttttgggatttattgtgaggggacatggggcagaaactgaactgaaactgctctcgtaagttctcaggacccaccacaatacctgggccaggctcctttgttcctgctctatgccttcatgtcttgcttggctagcatctctggccctgtgtgtgtcttccaaccactggccagtctttcctgaattctctcgtccagggcctggaggagaccagtcggattgacttttccagtaagcattgcttgctggggagagccattcatattaggccacgtcttgggtatggtggtgacctggtcagtgaaacgactgccctgtcatgttgccactcttgatttacttggtggtcatcctcttgtgaaaacagcccaaagttgcttcctgcaacagaggactgtggttaggggaagttggctgtggcaggcgctgttgaagccatatcctgttggcatgcacatatttgaccccagttgatgatgaggataacagcaacagcaactcatatctgagggcatcctatgtgaggataacagcaacagcaactcatatctaagcacatcctatgtgcagggtaatgagaagtatcttctttaatctttatgtccacctagcaggaagatacccattttatctccattttacagatgaagaaactgaagcagacagtctttaaaagtggtttgcctaagagcatacacatagcagatgaactgaggccctctgacttttgaacctgtgtccttaaccacagcaccgtactgcttttgaacagctggaactgatgtcataaagaccacacactcacaaacaatagtatgattgatttctagagtatcacttggatttctaacctagaatttatttaatcttacgttagacaattctaacctgttaggtaatctggtttctcagcctgcagtagattagaagcagtacatttaaaaatgaaagagggattcttgcagatagtactgggaagaaaggacagctggtaacccaaatataaggaagtgggccaggaaattataaaatgtaatgcccagaagaagtaaagaaccatggcaattgaagaacagctggcccaatgcccaagaatgtgttctacaccctcctcaggaatgaatgtgcttccaagtccaacacctactgccctgcctgtcaccaagcacagcttctgtggatatttgatgaactataacatggtacagtattggctctgaaacatcatttgtgttcactgtcctttgtttaagaatgtagaaaaagaagtaatgtgttttataacttttttgaaaaccgtatgattaataaaatatactgatggtcttaagagtaagatctccatttgaaaacttgtctaccaactttagcaatttccgccaaggctccagagagacagggtctcctttcggttagcatttgatttctgctacttgttgctaactctgatttctgggttttcaagatgcatatcagtttaaacctaggtgaaatggtaagttttctgatcctgtggtgtaggcctgtagtgctagctattctttttttttttttttttgagacagagtcttgctctattgtccaggctggggtgcagtggtgcgaactcggctcactgcacgctccgcctcccgggttcatgccattctcctgcctcagcctcccaagtagctgggactacaggcacccgccaccatgcccgactaattttttttgtattttttagtagagacggggtttcaccatgttagccaggacggtcttgatctcctgacctcgtgatctgtccgcctcggcctcccaaagtgctgggattacaggtatgagcgagccactgcacctggccactgtgttagctattcttgatggactagtatctagaatgacttgggctgtgggctcaggtaaagagagtagctagcctagggctagggctggccctgcctgcctaaggcgtggcatatggatgttagggtttggagaagggaggggcccaggagggaacaagggacatctcgtctcttgtcctatggttgtcctggcaggtatgttgggcatttcacactcctagcgggggcctagcttggacgtgtagcaggcacacttcctgcacacatttcagtgtcctgacggattggtagaaatcatccacagtgccactgatagaaaatatgatcaccaccctgcttgaatgggccttgggggtgtctcatagttaattcacatgttactaaggcaggcaagctctgcctgccttctcatccccagccccagggcagagccacactcctcctccttctccccgctttccccacacacctcctttccactttctggaaagccagcacccagctgcatctgacttcttccagagtcacttccttgatgcctcagacaaggccaaattctcctggtatgtgctcatatagaacatttaacacccagctgtggttttccattcagttagctgtttgtttgtctctctccagtagattgcacagaacctgaggggaggattcatgttggtttttcattgatttactcaacagatacttattgagtgcctacggtgtgcaggcactggggattcaacagtgaataagaaggtgcacgtacctgccttctagatgctcatagcctagtggctggaggctgaggatcatggcatacacattttgtcatatattagaaggtgctggatgctgtgaagtaaagcaacgtatggaagtgggttaaggcagtgggtctcaaccttaactgtacagtagactctcctggggagcttctgaaaaagccaggccccagtccaggccaattagggatgaagttccagattttatttatttttattcatttatttttatttttttgagaaggagtcttgctctgttgcccaggctggagtgcagtggggcgatctgggctcactgcaacccctacctcccaggttcaagcaattctcctgcctcagcctcccgagtagctggaattacagatatgtaccaccatgcccggctaattttttgtatttttagtaaagatgaggttttgacatgttggccaggctgatcttgaactcctgacctcaagtgatctgcctgctttggcctcccagaatgctgggattacaggcgtgagccgctgcacccagccggccgaagttccaggtttttaaaaagctcaccaggtcgtttggatgcaaagtaggagtggggatgaggaagaattttgcagctttaaatatggagggaaagaaaggcctccttgggaaaatgacattgagctctcgtaccattataccttcagagcctcagcaccatgcccgactgactcacaggaagcactcagtgtttgttgcataaatgaaaaaaatttacatttatttaaccgaagggaatgttactactgttgatatggtatattcaaagtatggagtctctaaatgttactgtctttggtttgtagctcaggcattcctgttcctactccaagttcattgtgttcatttgctggttcacccagagtttcttgtcatgttcaaatgggaagtttctcccaatgaacctttttttccccaaggtatcctttcttccttcctttccttccctccctccttccctccttccctccctccctccctcccttccttccttccttccttccttccttccttccttccttccttccttccttcctccttccttccttccttccttcctttcttgacggagtcttgctctgtcgccaggccgcagtggcgtgatctcggctcactgtaaccttccactccctggttcaagtgattctcctgcctcagcctcctgagtaccaccacatccagctaatttttgtatttttagtacagatggggtttcaccatgttggccagcatggtctcgatctcccgacctcgtgatccgcctgcctcagcgtcccaaagtgctgggattacaggcgtgaaccagtgcacctggcctcttttctttctttttctatttttactattgtgtttgatataagtatcactgaagccaaattaaaatgaaccaaagggttttgctgcataacacaaatccaaataatttattggtacaggaaaaaacattatgatctttttatcatttaacagtctgtagatattgaaacttccccccctttaattgtagtttttctcccaaaagattgatagaataaaacttttggctcacattttttgctcaggttacgttcaaactctgctaactgatattgaagcattgccccagagaatgcagtaacacagggcttaattgagctatcaggctgctaatgaattcatattgagatttatcatttaattaaaaggcaaagcggggaaaagcaaagggaaggtgtacaattgttccttccgctggcctccatttcctccatttaaaatcgtggcttgtttgtttagtttgtagaatcctgtgggatattgcatagaagtactcaaggtgcataggtaaaatagagggtgtcctgtattgcaatgacttgacttcttagtgggtcttaaaaattgattcagatttggtgacaatcatatgacacttgattaagtagaaattatgttttatgatgtttttacaaaagattaggaaggccattttccaaaattattcctaggtctgtatatctgaagcaatctgaaaattcaatcagagggaatctaatactgagatgcttttgctttactgacagagagtaaatttttcttgaaaacaccatttcttatatgctacatgtgtctttaaaattcacacctgcattgaaaaagctacctttaagcaacactttttatgataactgcatttttaagtatgcaagtgcaatgttgcaaacctgtcaatgcagggcagtcagtcttttattgattcagagtggaaatgtataatattttttgtatttagattatagagttacatgtttttaaaaaagaacagtattttatgataagttaaaatttaagtacctcaatgcttagtacggttaaaaggtggagtagtgttttcctgcacttagtttagacttagctatatctaaggagtaactcaagcagggataacagagggcaaaaggattagatgtcaaaacaaatcttaggtttctatgaaaataagctaagaaatgagcccccttggatgaaaaatatgaagtgagaatatagggagtgttggtgaggtttgaacctctttgggcctcagttttcctcatctgattttcctacacagagacctctgattgaagctgtcacatctgtacatgcacatgtatgtctgcatgtgtgttgtatgtttgctcagggaggagggcatggtgttcaactgactccaaatatttgatatcagacagttttgtctggagagaagagcaataagattgtggaagtgatcctaaaatctagtttaactcttgtgtagcgtagacaaaaagtagagatccagggaggttgagcaatttgcccaaggtcatgtagttgtgaccgaatccgaaatggaacacacgtctcttgacttccagctgaggattgcttagaggttacacataagggttctggtttgaattcagatggtgactctgtcactagctacgagaccttggtcagcttccctgtttccgttcttcacttgtaaaatggagataacaatttcaacttcatagggttgctgttacagggattaaatgagtaataatacatgtaatatgcttagaatagtgcatggaacatagtaaacactcaataagaaactattgttactgtcattattattctgtctgttccattaaactacatttgatgcctgtaacttcaggcttaccgtttgtatgtgtttatcatggttttaatttcatttctttcatttgacctgtttacagctcattataattgtagtgtgcaatattgtacattagcttgccagtcatatagaagctcctggtggtttggcaagtgcccagaattccaaccacctgttggaactgttgccaaaatacagtagatttttatttcccagatgttgttcaaccgagagtacaaatcattaatatgactttgtgtctttaaaaaaattcgttctcctattacaaaagtattatgtttcccactagttctgtgaagctgagcagtcacagaggtcttgttcctgcctcttgaaaaaacattaaaacgggtagcaaatgtgctgggggtcggtcacctgagatagctttcagagataaacctgtgcgagatagagaagggaaaactatttttcttttctagcaatccaggtagccaagcaagtgattccaccgtgcaggggcacttagcaaatcaggaagcgcgataacagtgaatgactttctactttcaacaatttgaagggctgctaacaactgatggcttcttcttgaggatggcattatcagtagcagcaggacccagacctctgcaccgtttctgcatgttaagtttaaacagtgtatgcctatccttgaggataaacttataacagggccaaggtaaaacttagagaagaaattctagcctgtgatttgaagatctgggagcattcagacatattggaacttaagttttcattctttttctcaggagacaaagctgcaattatgaataaacacattgtaagagcctttctgtgataccgtgttggccaccaaatccagatgtgatctgattcctatccagttccacattgtagcaggctttgctgtcattgggtcatctgtgttccttgaaacttcaccatatccaaaaaaagcatgttagaacaggattaaattcttcttatacattacagaattatacagagggttctctaacatccactgttcaaaaagagactctggcaaatggttcactaagtataagtaaagtgagatggaatgtctgatcccaaatttgatagtgcttggctcaagacaggaagcagggtatgtatgttatgcacaatgatgattataggcctgtatttgtatgtggaacatgtattcaaatttcaaatcttttttttttttttttttttttgctgggaatttttctggagcatgtggtgtatattgttttctgccaagcatcaaggggctgttttataaagggcttttttggggggtggggggagtgtatcctctcctttcttttcccaaagttttcttgtatcttctccacaaaataaaaatttctttcttctagttcactgacttggagattcaagcagcagcacgataaaaataccatattgcatttccaatgaactcctttaattagatgagatgaattaattggatttttgggacatgtctgtgaaagtataagatactcacttttggaactcccaggcatggtgtggcctgggagctttctcagtttgctcctattcaggacatggtgtaagaactgtcatttgaagcctgtcattttagtcccccttgggggttttacaaatggcctagtgatttttcagatagcagagaataaatcagcagtgatttggcctgcccttcagcctagggcattccctggttatcaccagcctcatcatcaggtgcttgtattacacgtttttctgtccacaccggcaggtgagatggtaatctaagagttgatttccaacacgtgcggagggactttcgaaagtccccctagtcccggtattctcttgccctgtataattttaggggtccaggcattcaggcttggatcgtcctccttatgtctttcagggccttggaaaattctggaatttagacaggggcagtaagtcagtggctgtagcccttgaatcccatttgggaccttaactcattctaccttgcattataattatttggtttttaactgtctaggtttctgtactttcaggggtaaagctgattcattctcctctgtatcccagagtccacctccaaggtggtaggttgcttgataggtgcttagtaaatatcatatttgattaactttttgtagcctcctctttagtctagaaattctagatcccaaatagaaggtaagatatggtatattctggacttttagttttctatatctccttttcaaatacagacctagggtgacagacaaaaaaatattgtgatcaaagtatatagcatttcctttcatggtggaaaaatgtgcctgataaatgttttctctgcattattttcctccaaatatattttaatgacagttatttggatatttcacactttatactcgacttgggctcagattaagtcttgtgttagttataaccttgaataacaattaggttcatgagaacagggatggtgtatatttgtttttaatctgtttcccagcacttaacccagtgctgagtttatagtgggtctccaagaaatacttgttgaatgagtggcttttggtcatggtggccttttagtgcagaaaaacttttggatctgaattgttagatttacttaatttttttgtaataacacagagaatgttgaatagaaaaagtaagtttagaagatacatatatatatagagagagagagggagagttagatttatttatttatttatttttgtgagatggagtctcgctctgtcgcccaggctggagtgcaatggtgcgatcttggctcattgcaagctccgcttcccaggttcacatcattctcctgcttcagtctcccgagtagctgggactacaggtgcccgccaccatgcccggctaatttttttttctttttatttttagtagagacggagtttcactgtgttagccaggatggtctcaatctcctgacctcgtgatccgcccgcctcggcctcccaaagtgctgggattacaggcgtgagccaccgcgcccggccgacttatttatttttttgtaataacacagagactgttgaatagaaaaagtaagtttagaaggtatatatccatatctctatatattttaccctccttgaggttcgaaatagtaggagtgaaattagagatttaccaaaatcggatgatgatttgcacctttgaaataactcatgcctttgattgtcactttagctacaagtaggttcctggtcataactgtaatatccctacaagcctgctttatggaacttgagctgcatcgtattgtctaagataggcctcggttcttggccgggtgcagtttatgttctttgaaactgtctccttttggggagcaggctgagagatagtgaactcattgaagagaattgtagcggaactctctagcaacttcctaatagaagatgtcccctccttgacttctttggtgtttcagctgccccattgaaggaagggacagactgtgcccttgggaccagagcctccttgctaactgtctgcaaatgaatgaggcaccagcatgccatgctcagccaaccacctgtggtacaaaacagctttcctggactctgatcccttagtataaacctgtgtatacaggattcacaaggatataattctgtggtgtcatctatcaggcacatgctttttttttttttttttttttttttttttttgagacagaatctcactgtctcacccaggctagagtgcagtggccctatcttggcccactgcaacctctgtctcccaggctcaagcaattctcctgcatcagcttcccgagtagctgggattacaggcacccgccaccatgcgcagttaattttttgtatttttagtagagatggggtttcatcatgttggccaggctggtcttgaactcctgaccttaggtgttctgcctgcctcggcctcccaaagtgctgggattacaggcatgagccactgcacccggccagggacatgcatggttttctacagagtggcttcagcttccacggttcatccctagacaattttgcctttttttttcaagacacggtcttgctctgttgcccaggctggatgacagtggcactgtcatggctcactgcagccttgacttcccagggtcaagcaatcctcccacctcggcctctggagtgccagcaggacgtgtgccaccacaccctgctaattttttattttatttttttagagatgggatctccctgtgttgcccgggctggtctcaaactcctggtcttaagtggtattcctgccttggcatcccaaagtgttggggttacaggcatgagccaccacttgtggcctacttggctcttttttacaggtttttggttgacacttctctgcagaatagcacctggcacctctcaccaccactgaaaaggatggaattttatacacctctttttcctaggttctctctagcagttaccaagggaccatcggaggtacttattgtggctgtttacaaaagccttgcctccagtctgagtcacctcaccctactctctgcttcttccttttagctactctttttttcagtaaccctccctctttcctctgaaggcttgtgcttgcacacacaggcagacatactcatgcacgcgcacaccacacatgcttcctgtcctctggctctcccgtatcctatgtaaaacctcctactgtcatttaagtgaaacccttctagcacataagagttttcatctcagaagctcaattttacctttcacttttcagatagagaacacccaaggtttttaataatctggcgaatgtgttaaaaaaggacatattttttaaaatctagattgcaaaagtaatactgtagcattgttgagttcagacattatagaaagtgaaagttccctatcatttgtttcccataaccaccttgaatagtttagtggatatattttattctaagcacatgctgtttatcttcttgaaaacaggatcatggcatagatatactcttttgtaatttctcttattagaaaagaagattaatcatatatcaaacacgattccatgtcactccatatagatctttccctcattctgtttttacagctataagggagtctgctgtgaaaatgctccttcgattagtttataactgagtgtaaaatttggcatttcactcttgattatagtctttttctgtatattcacccccaattctttgagaatgaggagtaccctaattttgtaagcaaaattttggggggctttggggtgaaaactaatttaaatgcttattttctcagttgcctacctccatttaaaaatcagttttgagggctataaaaaaaccttatgatattaaggcctttttttctgtataaaaataacatacaatttattttttccatttattcaaaagactgaattacactagccaagaaatgatcagtctcgtgtaaaagaataacacacgttctccttgaatcaagactactctgagattcagaaatgccagtagcggaaggtggggtgtgaccccttaagtaagtgtgactagttaaaggtgtatggatattctttgtggaaagcgggctgccagatacaatttcaggctgtttcatattacttcacacggtgctttcaaactgtttattttctctcttggcactagtgagtacagctcataactggccagataatatctaagtctaggaccaggacagtgaatgggttttaccatgatttgatcaaaagtaaacaagaaaacaaaagcagaggaaaaaaaaaaaaaagagaaggcatcacatttttctcattgtggggctaaaatgctgcatgttgaattttcactttctgattagaacccacagttgaacagatctgatttatttttttggggtcaggaagaaactgtcaaattttagtttgactgttcttttctttaggtctcccccctttcttcccctaccttttttttttttttaagcattactatattaatcagatagcagccactgtttgacatgtccttctgtggtggctgcagattaagtctgaaccgtgccagaaatctcgttgcattttttgatgtagcagaaatgaacctggttcattccatcttaacagctttagccaaatggctcagaagggatctacccgatttcataaagaagagttaatgtgcagtctggtttaatacaggtgcccttaaaatacatttttgttttgttttgttttctcacttccaagtttaacatgtccatggacattggctttagtttccccaagatgagtccatgaatgaccttgttccagtatcccttgctgatttgagttcccaagtaataagcctgggaatgttttcagtgcagcagccgggagaagaagggggattcagcagttgctgttcaatgcatttactctctacctgctggcttcaaacagtattaactttatgtgctccttgtgcattgtgtttaattaaaagcagttctcttcacagaggcacttgtaggatttttttttttttttttttttgccctgaaacgaataaaacaaataggcgtctggtatttgttttgtataacacaatccccataaaatgaagagtaataaaacataattatctgtaaaggcttgttttataagcctgagaatgggcttgtttctaccaggtttttatgttcattcataggagaaagaatctctttgtacattaatatgtaacaacaataagaacaaatgcttcccaattacatgcatgaatcaaacttatcttttattaaaaaattttttttctgttgtagtaaaagtttgtcattaaattctttctgtgtaaacacattagattgaaggaaaatgttttccttcaatattctgttcaactggcataactttatgatttttttctccccagcataattaaagaaacaactttatggttggttattgacttttttaggtcagagagcactctgtggattctaaaaccgccttccagaaaagtacacatcaaacttctacgtacgtttttatagggtttgtagagctctgatccttggttaaagatccctgacaatgtctaatagctgttttgaaaactgtacctccaatctgaagctaaggttttagttttagttttagtatgtgaatatctgatgaaacgattcaatggttttgtagcattggattcaatttcagggttgggctcctttctaggaatagaggaatattcttatctcaggaaaaaaaattcagagtgtgggaagtacgaaaattattaattcaaaggtgtatttgctgtcagattggatggcagtacccacatccctaggggctcctgttcccaagactgttttcattgtttctatccagcgctgggcacgagccttgaagtggcgaattcatcctctgaagttgtgtgtccattgctgcaagaataaaagaagcagtaacagaatcatgcagcgcagtatttcatggtgacagttttatgtggttgtgtgatgttgcagagtcttgtaggtgatatctacccttttcttttgaatcaaaacacggggttttactggaggagggaagtttcagaaacaacctagtctaacacaaaattaagctcctaaatagttatcccattctgtctactacaaaactaattgcttacaggaagtagaagtacacatatctaatatttatatcctgtttgagtagtggtttctaattttagatttctaacccctttttacattatctttttgcattgaaattatactgaaacattcatattattatgaatgcaagctgaattaaatagaccaagattctcggtttctcccttcatgttgtcatctactagagaatgaacagcttaaaataagtgcatcagttcctcatccaaagggaagctgaatattccaattcaagatcactttgcgtgcttactggaaataccatttttgaacgtacttggcaacttaaagtgcccaattaaaagctctgttgaaagaggaagtctgtggatgtgcaattagtccttaggattcagagcatttcctttatgtgtggaaggccataatatgaaatcactggtcacaatagctttatgccaggtgcttagactagaaggcattttcaggatggattatttctgtactcttgctcctaaaatggtttacctaaagaggctcccaagtccataaaaatactggtgatgtcaagaaattttggaggtggcctttcacaaattttaggcagtcaataaatataactagccatgtacgtgataggcaatacacaagacttgcttatattcctagactttctattttatctgattgacagtgttcctcttcccacctttttattcatttatttatttttaaaagatgaggattgggtaccagaaaattagccagtattgtgtgcttttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaaccaaaaaaaaaaaaaaaacaaaaacagccccaataacaaacaaacaaaacaaccctttaggtaccataaatctataggaaatactaaccttctgatgaagctggcccgatgccacttattgttgtcccccacgcctaagctatggtatatggctttaataacaaaatggcaacacacaatagtaccacaacctggagggtgttactctttcttctgctcacccttcctcccattgttcccatgggagagaggacagacaccaaggctgtagcaaataggttattttaataacctcagcatccttgtttctatatgatatacatttgatagccaagttgaatttacccacctctctctaaacactttttcctaaccctttgtcaatttgtcacaccatctttggatgaagagtggtacctgatggtgtatgatgcttaacaatcgaaacatctgtaccttgttagccataaaggctcatcccatttccttccataaacatctattgtaatacaatatggattgtgtaaggcactgggctttaggcccccagcccgaatatctgtcatctattaagtacttactgtggataaagaaggcagtatacttaacatgcactatttcatctaatttttgcaaaagctctttgagtacattaggccagtctccattttattaatacggatgaggaaagtgagaccaagacttgagttcaatgacttgcccagagtcgtgcaaagcataaggggcggagtaggatttgaacaccgcatgaactgggctctggaatcaaacgcttccctaatgccatgccctaggtctcagcctggactgtgctcccagagtcacttaagcacttttcaaaacactgacatatgtggacccagcatttcgaggagctgggctctgggcatttgggttttgaaggttttacaagtgaccctgatgctctgtcaggcaggcttaataacgactgaattatataacatgcccagcttggtttcttgcttggttgttgaattgctgcatgaaaatctgatccctgcagtctttgagcctgcagcccagtgaaagagatggatgtgcacacaaccaagcatgaacaagatgcattatgacaagtactatggtagtacagactttgtgctctgtgataattcctatgacacgacttgcagttgatcccaggaggtagcatctgggacatagtcactttagcaagtcctatttattctagcttgggagagttccttgcatcttaactctgtatactctgtgatcaccagacagtcttggtctaggttattataaaagtcctagttgaggatcttgaatctctcccattcagtttgactgagagagcttggtgattagatcagtggtttgtatattacctcatttgtcttccaaactaatagataagttcctcaggatccactccagtgggattactaggtcaaagataaatcattaccagactggttgatggtatcacccaggctggtgtgcagtggcatgatcttggctcactacagcctctgcctcccgggttcaagcaattctcctgcctcagccttcggagtagctgggattacaggtgtccaccaccacacctggctaattttttatatttttggtagagatggggtttcaccatgttggccaggctggtctcgaactcctgaccccaagtgatctgctcgtcttggcctcccaaaatgctgggattacaggcatgagctactgcgccccgcctccctcttttcttattgagacccattgaccaatagcttggtcaatagtgcttgattcttgagtttagaaaacttctattgagcttcttactatgtcctggggactgtgctgggcagtaagaacaccagaaagggtgtggcgtcttaggagcctattaaactagattaggaagagaggtgttgaggtgtcacctagggcataggcagagaacctgtctgcctaatgatactgggtttagttcttgaattctttatattcagaatatggattagggccaggctggccttgacaacctgaatcattaaacacttatggtgactggtgggtgattagccacataagaagaagatatattcataacagatataataggagcaatggggactcgatggagagtattaaatagtacagtgtcttccataaatgttctttaattgtggagattactgttctgtagattattcactcaggcattgagtatgcgtttattaagtgctttttgtgtcctaggctcattcacaagtctaaacttcaaatttggttcttaaattcctcaagaccagagtttagctaaaagtatcattatatcctgagatggaattttatcaaattgtatgcttaaaatgaggagatatgtctgtttctccatctcgcaagccccaccagtttaactgtcaattggtcttgtcaatcaactataagaggtgtaaaaatgtcttgggctataagtacatactccagggcgtatcctggtgacagagattgagaaactgattggaagagagtgtaatcagtagtgctggccttactgttctgaaatttctggtttctttccctcgctccaaacttaattctttcttctctattttcaatttcagaagaaatttagaatgagtgagggaaattaaaatgaagtccagaagaccagcagagatttcaccgggcatgtgggtaggaaagacgtgtgagaaaaccatttgaaatggaattaaaagaaaacgtgttcagctcactatataattatagttagcttggcctggtgttttgggttgcattacctgtaagtttggaactcatttgttgtatagaaattgataccccacatttacttaaattttgcccatctgtttcttgttaaaagaaactggacatctgctaaaatatccttgttttggattactcaatcttattgtcaccttataatggttttattttgggggaggtttattcgtattagtatgatggggaaagaacagaaagatcttattggaaaataaatttagaattttccaaataataaaatcaaaagatttccagccgtaatcttaagatgccttttcatgatgtctagttttagaaactttttttcctctcagatgtgaagaacaatgctttttaggacaatagtgaaacttacatgagaattgttctttttgcattgtgttatggtgcatgatgcgaaagtttagaaataaatatatccctggatacaacaggcctcagttaagacttcagctatttttaatgcattttgttatttttggcctggcatagtatcttaggatgagaaaatccatccccttcccctagtctgaggtcacatgttgccatcagttctctgtaatggagtcaatgatgttatggttttaaaataacgggaaattaacatttcttgtccccatgattgtggccgcaggacttgatcgtttttatactgttaatcacactcctcttttacaagaactccccgactcttgtttcccccagcagttaaatgccatattttcatatatttaccttatatctggctaaaaccttgcaattttttgttttgctctcggtttttgtgacaattttaagaggaaggcaaataatgtacagactgggttgaaagaggagaaaatggagcagttgtaattccccggggcagggtaagagactgttaatacattagtggtaggagggcttctgcagaaaatacgactgcacaattaaatggggctattaaaagcacgccagcatcaattcattaaatgacagtggcaatttctttgtaatccccttttccccatctcctcctgggactcagtatatgcagggatgaaaggcagatgggcaaagatcagaaagactactgaggaagaggtacagttatttagatatctgcttcctcatcttctttgggggcagcttctgtgatgaaaacactttatgaaaggtaagacccccaaatacctgttctgtagacattggggatgaaaatgtacatcctagcagatgatctggttctgcattccagaacactgctctgactttagaagcagttatctatgcatagtatatctacttggagctaaaacaaagagagaaattgtttgattgaaaccttcttattgcaaaagtatgcagaattgacattcagcaatcttatgtaaaaatactgcaaaatgtttctttttctggaaaacagtgtattttaaaaatcagttggaatctggttacctgcatgacctagtgagaacttcaaggcttggggaaatggttgaggttagtggttatgagtatttgatatccttttgcgtgtcatttaattgtctaagcccccatttcctcatcggtaaaatggtgattctggtatctgtctttttagtgctgctctgtaaaattaaatgagatactgaatgaaaagcattttgctcagtgcctggcataagataagtgctccctaaatattaactagttttattatccattgaattttaggactccaccctcccccctagccctccaaaagagttaatggtcttatctgcctgctgaagagtagggttatgaggaagctgagacatggagagatgatgtgttaattagtgaagaaaccagaatgggaaccacattttatgacttcccactgcattgaagtgcctctcatagtatgagacttctgtatttagtaaaggagggccaacacttgctccacctattataatagatgaggtatgctttttatctatatacttaaaaatgtagttttaagttcattgctcaggttctttcggtggcaaaaatccttgcactttaaaaggcattattattggccgagttttaaaagaactaccttcagagaaaaatgcatttcattttgattatgcccaacgcctgcagaataccatttaaactacaagtgatataaaaggttaagtatttgattaaaactaatctcctttaaaaactaatgtttcagtctccaccagaacttcttcagggaacttcagtgttttgctgataactggatccaatttatgggaggtaaaaaaaaaaaggcagttatttacttaattcatctattagtttccagacttgatatattgaatctaaagaatggtgaaattaatagataagagaagaagtttgagtggttaaaaaatggatgatatctcctatttcagggaaacagtatttgatcagatttcagggtggtacgaagttcttgttgatgataaaaggcaagtcacatttatcagctgaacaactcagaaaacacagatgatctgaatttgtggaggcgtcctccataccattttctctattgctttgatgattgtctgaggtctctaccaaacagatactcatattcatatttccagttcaaatccctgttgcattgtgaactctttgggaacagagaccacttttgccttttcaaccagtgcctagcagggtgcctggaggcattagggaatgtttattgaataagggaatgactcacactgtatgccaaaatctggcttccctgagtttatatgcctctggtaaccttttgtaaatgacaccttttctatatgattagccacttctttctttctattgaagttatttcttatttccaagtaaatcttgttgcagccatcctcctcctgactacatccaatgtggttcatgttttttcttttctttttaattttgggaggggtgtgaagtgcaagatagaacataatgtgggctaaatccggggctattcaacttgactagggtctttggccttccagaatgttgagaaactaattagtgggtggggtgggggtgggggcggtgttagaagaaatggctgggattctttgtatccaaaagaatgtttctccttggtgatgaggcaggtattgtcacccctctgaataaatccttaggcaaagtacaaaaacaccagccggctgaacaatgcctggccactctggccttaggattgcaataccttacgggtaagtttagaaatgagtttcctgttcaggttttaggcctgtcatactgttgagtggctgtctaacctttgaactttctgtgtttttgacatcaaaaggaactctaagctttaccaaaaaggttttattcgagtaattaatactcttcatgcacagagggaaattagcctccaacttgtggacatggtgaaaaattagtatcttcccatttgctcggcttgtttgaactatagttgattatttttaaagataaggagatcaaatttccttaatatttcagtatgttgctttttgtacccttaaaattattttttcctatgcagaattgactttgattaaaaaatgtttttgatgactattttcctgattcgtcagtatatctaattgtgttcattttactcatgaaaaatcttgtctatgagggacgtatttttagtaacatttttatagcatataagaacttttacagcaaaaacaggaatcattaagtgtgtgtgcttttatcataacttctcttttaatggaacttaaaatcttaactcgtgtttttgcagcactttttttgcacatggtaggttcttaatatttgaatggaattcagtgtgactgttctttgtgttctcaaaagtctgatctttgtaacaatttgtctttcacttgagactttttttttctttgcatatgtgcacgtctcactcttggttttccttaatcttttttaactaaacacatctatgactcatatttccctatttatgaataggagcaatttaaaatttcccaacatggtggtatgtgatgtaacataaccaaaggctacatgtttacccttgtttaattacccttcatttgtggaaagatgacgtatgtatttatgatgtaaatgtctttcagaatgacctttgggactaagcttttttttttttttcccaccaaaaaatggtcatgacctaggaagccttgttagtaaaatttaaaaaggaaaagttggctgggcatggtggctcatgcctgtaatctcaacactctgggaggctgaggtgggtgtatcaattgaggtcagagttcgagaccagcctgggtaacatggtgaaaccccgtttctactaaaaatacaaaaattagctgggcatggtggcctgtgcctgtgatcccagctactcgggaagcagagacatgagaattgcttgaacctaggaggtggaggttgcagtgagtggagattgtgccactgcacgccaacctgggtgacagagcgagacttcatctcaaaaataaaataaaataaaaataaacaggaaaaatctggtcaaatgccccttgttcttcttcaacagatacatagtgagttgtgtaaaaaaggagttggaaaaggaatatgtagattcaaagtgacttaaagaatagaaaaaaaatttgttttaaaaaatggccaagactaaatcatagtgtctagggaggtacacctgaataataaaactataaagaaatacaaaatatgattactactaagaatagtctgttgccagtagtacacagaatgagcactcaaattataacagaagcattttggtattcataaatgttctttttttaaaaaagaacacaatcgaaattataatataggctgtaagtactgattttaattgtagtgaatgtgaaagtgttgttaatgaaaatataaagaatatttgttaaagtgtggacctagccaggaatactaggtagaaaaggtaactctttaaaaacatttttttaattgtgaagttaatttattgtcactttgtttgatatttattattagagtccctaggttaattctgtttttattgcttttcagaataattaagacctaaatcttctgccgaattctgtttggtttccttatttcttttgccatgttctttcattccacaaatgttattgagcacttccagtgtaccaagccttgtgtttactgctttgatgataaatgcaataaggtaatgctgcttttaaggatccttcaggataggctcttgtagcagtaaggacttagtatttttgctatagaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactgtggaaagcctggtggtggtcctggaaggcttgagaatacctggagctggaagctccttgctcattggtgacctttttcatatgcagcagagctcttggcattcctagcatactaccttgaaaggactgtgtcttgcctcctagaaattctggacttggtagaatcatttgtttatgttattttaaaaagaaaaaaaactctgaaatgtactttttggaagaaaaatgaacttgtttttggacttttctgtgtgttgtttctttaattgaaaattctgtctggagattgattttcaacccccttcctttccctctagttttaaattgtaacattgctttccaagcatttcaaaaaaacaacaaaaaagaaatattttattattactctatttttatttgctcattaataattcttgattttctatctatatgaaatcaaagaaaaattactgtataattttcatccagttgcagtcaattctataactgaaatacaagataaaaaataagtaattgatttacttaagaaacaaaggcatctcgacctcctaaaaatttcatcaaatattcactcggcagacccttctttgtaataggagctcacttactattgtgagcactgacagtgtgagcacttgtggcagggattgggtttcctgaggaattcataagatacttgcattgcttctgggcatgagggtgaataacacagccattggccttcaaggcctttgaggaggtgttctacggggagaggggctgagacagacatattcctgaaaggaataattactgcgtgatagtggaaatatacacaaagactttgggagtaacagtgatggagggacccattgaaaacttactaacgtttacagctgttgttaaaattcatccaaaccagccaattatatctacattctctagaatgaaagtacaaaatgattacagtggatgttctaaacaccagtgttgacacaatccccttttcctactggaatggggatctaatggggaaagtgaaattctttctcaaaaccttatcggtgttgataccttacatgtacatgtaaaagcagctgactttgtgttttgtggcctttgagatcatataactcttataaagcaacttacaaattttctgggaggttcttttggaatattgctttatgttttgttttaggaatatacttccctctcccctgaattatctcagtggggatatataaatctactccctatccaaagcataaccatgtatgtatttgttttctctttatcatatgatatagtttggatatttgtcccccttaaatctcatgttgagatgtaatccccaatgttggaggtggggtccggtgggaggtgtttgggtcatgtggactgatccgtcatggcttggtgctgtcctcaggacacaatgatttcccatgagatcccattgtttcaaactgtgtgaaacctctcccctactctctcttgctccttctcttgccatgtgagatgcctgttcccccttctgccttgacttaagcttcctgaggcctcaggagaacccgagcagatgccactgccatgcttcctgtacagcctgcagaaccatggccaattaaacctcttttctttataaattacccagtctccagtatttcttcatagcaacgcaagaatggcctaacataccatatataaactataaaacaaaaaaaccaaaacccagaacaatgacccactgcagtacaaataataactctttcttccaaaggaacttctttcattgtttaaataatgagaaacttgtgtcgttagaaacactgtgtagggtgcagcgtcccctcattacaaacatttctgtgccttagaggacactcctcctgctatgtatccttaggaggaacacatagatcagcctctcttccttttgtccagctgcagtatcgggaatggagacacaacacggtcaaggtgcctaaaactagagtggcctggggtgagtctagacttgatcttcccagatactgtcccttgtcagactccaacactgtgcacagcctggtctctctgggcccaggaatttgggcacttgcccaaagattcctttgcaggtgctcctggaaatcagagcagtgttgaagcaggatttaaagcagtaacatctgtcagatgtaaccatggcattatatctgagacaaaaaattgtaggaggaaaaatgcctgttcggagtgtggggttactgaaaacccgcttgttgactagtgttttattgtagtgatgggaaatgaatgagactggtatctacacctactggcacgggtctgaataaaacccacagccggctctcctctccctgagcttccagccttctgtggtccagattttcatattccttccaatttgcccagagcaagctgtgaccctcatccatcttttttttctcgttttgcatttaacagagttgtaaagggatttatatgctttccattagccttagcaaagctgctgtcatgaatatttaatggaaaaagcagtttgttttcttttactctttcccagccttccctccagcccccagctctccctttctcttgcctggagaaatgtaaatatctcgcccctcaccccttggccggatcccaaagccccgggctcgctcaattcaatgttctcacccgtctggtggggactttttttttttttctctcttctctctctctcgtagccccctacgaggcaactaaggtggtggccgcggtgcgcggggccggacacgcgtggggctctgcctggcccgggcctccgcgccctctgcctgcaccacagctcagcagcccggacagacggtcctttcctttgaacttcacgggagcacaatagcttccctgcaacttagctggagctccctcggatgcattcctggctcttcacgggtcgctggcccctttctctttgcaacaggaaaaggggcgaatgtctgggacagaaaatgacttctgaagacacgaaaagatttaccgtgtctggagcaacctctgaacttttgtggtggtgatctcagaaaaatgcatattttcctattggttgcttagatcatctcccatccttcttccctccccctccccgtccccgcagttatttatctaatttctccatttctgtcatacctcaccctcacccccactcccaccccacccccattccggttttgccttttccttaattctttgtccgctcttgtgctgcgggagtggaagcgtctgaaaggtgaggctgggagagggcctgaaaagtttgtgttaactgagaaggaaggttccaggcgaaccctcctcccttctctaatgaagtcatacctgctggagtgtgcctgtcccaagggaccgttggaaagatgagagaaggaaatccatataaaatgcttaacacagtatttggctttagtaattgctcagtaagtcatagctatatgttattaatatgatacacagtcattcttctgaaatgaatgggcatgaatgcttccctctctgcataaggaattatttgtgctggatccttcttaagaggcttctcttctcttctcttctcttctcttctcttctcttctcttctcttctcttctcttctcttctcttctcttctttctcttctcttctcttcctttcctctctctgtagcccaggctggagtgcagtggcatgatctcagctaccgcaacctctgcgtcccaggctcaggcagttcttgtgcctcagactcctgagtacctgggattacaggcacgtgccatcatgcccagctaatttttgtattttttgtagaggtggggttttgccatgttggccaggctggtcttgaactcctggcctcaagtgatccgcccaccttggcctcccaaagtgctgggattacaggggtgagccactgcaccctgccagagctcatctatttctgatgaatgccgtccacagcatgcttcaccgatggaggtgtcatttcatttctctttgagtaacctaaaattagttagcgtatgtcactaatgtatagcatatgtcactaatgtataacatagttctaatcaactaaaaatttgtacagactcctagatgggctactaagtgaatatattttcctctgtcctctggtggacttcactacaacttttacatatttcgatactgaaattcttaatagatttggcttcaaattccagcctgatgagataatattggcatctgcccctgaagtccagtatcaggtcattcttgctccacttcaggcttctttcaaatttggtaatcgtgctcctcgtgtcttggatggctatattggcaagtcagaacccttcaattcatctctgtagacctacctgccttgggttcccgtaacccattagtaagtccctttgggtaagagttcccactaataatgtttttctctcgatttctttatcatgccttgaaactgacttgaaacattttgttaaatgcctagctaaaatcccaacacacttgtgaacagatgttagtatgatggaagaacagaaaaaagacacggccaagctaagatgttggtatgattaagttggatgaacagaaaaaatgtgcagccagatctatctccagaatcaaccaatttccacattgctttcgatctcatcctattatgttttctgtaagtaaaacttccactgcaaatattaattgatgttaagtcaaaagtactgacggtctggtcacaggggcttagggagaaacgagagaagcaaaaagggtctccccccttagggtaagctagagtcttgctgggtcagacaattaggcaacaatgtaaggcagtatataattaaatgctaaattatgtagagcagattatgtgctatggaatggagaaaatggctctcacaacatttctaatgtcctaaatcagtttcctaaatcagaatggtttcatacatccatatgtacttaaagcatgctcagtatcattggtcctttcctgcttttttgaagccatggtaatagtaaacattttctaagtatctactgtaggtcagggaactggtctaagagctttacaggtatcaactaatttcatgctcaccgtgtacctctgagataggtatgcttttctccattttgcaaaatgagggaaccaaggcggggagtctaatacctgcccaaagtgagtaatgataaattccttcctctttttgatttggtgggtctgtggtgagggtagactaggagaggcagtgttgcattctgggaagtgaacctagattttcatcctggcttcttttaacctactcacctgtgtaattaggaccttgggcaaggtgcatcatcttttggagcttctcctttgtaaaatgggacaggatgctgttttaagatttaagtgcttcttatgcaataggagctcaaagagtgggagctgttgtttattaaaaataacaatatcattatcatattctctacctaaagagacctgttgaaattggacagaaaaggaacgtttctgtcttgataagtcttaaaactccagtaccaagtgcagcattcgtttcttgtgagatatttgtagaatgggtggatagaaggatgggagaggagaggggtctgaagaattcctgtagcaagctaaagaggtatcatcttccaattgagctatttttagccttactcatcatttgtaatcaaaacaatccttttcttagccttactcctcccccacccctgcccccctactacttttgcgatggtaatcgtcattgccaacttactttctttggaatacacaaacagagctgtctctttccgtcatggagattttaacagtaaaaaactcactgcaccattacctctgccttgtattccagacaatagtaaaggacattgtaacatcactgtgtcagcgcaaacaaagaactatgtaattttatcccatattaatacagtgtcacgcaggaggtactatcattagatggcaatctataaaaatggcccctgagaccaggcactggcacaattatttattcttcaattatttattcagtcctaaggatggaaatgctgacagacactgcaaaatgctctacctaccaatttacagaaattgaatgacggaatcatttgtggactgaagtagctttttattgaccctatttttatttatttaaattctcactttcacagcttaactatgtttactacacccacttacatgatagaaatgagaggctgttttgttcataaaagctacttcaaaacaaattaatatttattctgaaagggtcagatcacaaatggaggctttaaaacggcctcaggaacattcaaatcgcatccttaatatttcatatggttttatatttagattggctattttatgtagtcttttttccctttttagtgctcatacctcttgagatcccttttctagccaggatggagggaacagttacacatagcttccatttgcagtaagtaatttcaacttaatttatgtcaggggagatttccagaaggttcccgctcctgtctgctattcttgtgattctaatatattatttgtacatgataaaatacaattcccattaattcacacttaattaagtcataaaagaatttgtttggtcttaactcctaaagtttaaaagattatttgcatttgtattaatactggagtttaaaaattatggctttctttatagatcagttccgattttccctaaatcagttattttcagttttgatttttcaaacacttgggtgagatccaatttatctcaccttctgatagttttaaaagagaagtaattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacacacacacacacacacacacacacacacacacacacacacacacacagaaatttatgatgtcctttaagaatcttgggactatcagaaaaaagttaagtgaaataacaattttcaaaaatacatttttgtagtaaaaacgcaccatcggtgttacattactgtataaatcaaatttgctgaagtttataaatatttttatgtttactttaaacttggacataatcagatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaaaaagaaataaaaacaaaaacccaagccaatgcctacgacgttgctacaagtatcctttaacctgtggtgtgaagttatttccaaagatgaagtttgccattcaaataccatttcctggtgttcatttgatttctgtaacacctctttttctatctccgctaactctagatctgtagtccttccaaacatgctacctaccacttacactttgccaaagtgtaatttttgctctcttatctgcttcataagagaatgtttgtagtttcatgatttgtaagtgggagggggtgcttagcaggagttgagatcaccagcccagggaggaggaaatggaatcagaataagcaagaggaatagacggggtactgggctgaagagcactgtgggagggtgctattagtgattcacactgctagagtgagaccactctttgattctgtttgtagaaattttaagctaaaagtgacagattgttgcctctctttatgtaaagtattacacatgggaagttaacctctgctacaggatactgatcaagacaagtcatgggcaagtgcaaagagctaagtggtttactttatacactagtatgtcccttctcagtctttcttgttatttcgtatgacttgcttcctccagctagtccaagctatgtttgtgtaaataagaactgccatttaatgaacccttgctatgaaccagatactatgctagaagggggtgtaggtactccaggggaaaggcctctccagcagattagcttgttcacgtgatactagagtcccaaaagggcaatagtggaagctctaaagcttcttgcagcttaggcttggactgaataaataacagcagtaacacaacagcaatggtaatagtaataatgaaaacaactcttctaaaaaatttgaggaaagtctcttgtctattgaatataaaaaatatttaccattaaagattattttaaaatttattttgagtgtttattgtctatcaggcaggtgtacttggaatgtgttttttgtaatatattctgccgcctaaaaataggaaatatatatccaggtttaggtgttaggcaagtttttcacttctggtttctatttatcttgaatgtattgcattagccacactatttaacatggggattaaaaaaaactgctgtgcatgttctcacttacaagtgggagctgaacaatgagaacacatggacacagggaggggaacaacacacacacactggggcctgtcgggggagagcggggtggggagaacattagggaaaagagctaatgcatgctgggcttaatacctaggtgatgggttgataggtgcagcaaaccaccatggcacatgtttacctatgtaacaaacctgtgcatcccgcacaagtaccttggaacctaaaacaaacaaaaactggtgtgatctccctgtaagacaggattttaaaagcatgtctacatttttgagttttctttcaaggtgccaagaagaggctgaccacattgtttgaagaatggttaagaacttgaacttcggagtttgccagacttgcattccaggctcagctctggcactgtaagctctgtggccacacagctttgccgaaccaacctgcttagcagtaaaaatgagaataataacatttccattgaaaggtgttatgaagattaaatgaaagtgtttttctaaagctctagatatatagtgggggcccttctcaggtaatcagaaagttgtagttgcagttttgttactaatattgcaaatgctctgaaaatgtgccaccatggctatgtcttgtagatggtgacttaagcttaccttccacagtgggaaaataaatgatttatttccctttaatagccatcactctgttgatccagccctgcaaagcttacagcatggggcttatgaatcatgaatcaacacaaatgtcaccaagctaaaagagagttagcagaagtagcctatgttaagattaggtttctgatttaatgtgcagtttctaaaaaccaagtagcatgtaactggtcttatccttgctgagttaagattgctggatcgttaatttaataattgagagaggataattcttgcaacttccaattagtattgacttgaccactgctttgatgtaggatgaaaccgcttcacgttggtgtgatttcctcagctatggtgtgtatagtctagtttaaagctaggctctgttatgtactatgtccatcctggaaagttcattagacaaggaacagaatagtggctctctcaagcagtcagtcatccagtgaatgctatagcacctgcttccatccagcccatgtattccttcccctcattcttctttgttacttcacaccacattcttccttcagctagtccaagctatgcctgcataagtaagaaccgcagtataatgaacacttgctatgagccagacacagtgttggaggtggtataggtactccaggaggaagacgtctccagccagttagctcaggtgtgtttgtatggcaccagtgccccaagatgacaatattcaaaaatgccagacttcttgaagtttagacttgagagtctcccagtgtcatttctactacattcttttggttaaagcaagttacctggctaaacctagagtcagtgagagaggggattgttcaacagtgtgcatttagggagagaattgtggctatgttacaaacaatctaccagagacttacagacggcagctgtctattccccatttgacttcatcatttatgagcagacgtttgttaagcacatattgggtagcaaaacatctataatattagcttttaattttttaaaaaacttttatttccagaaagcttagctttatctacaagtacagttggtccttgaacaatgtagattagggggtgctgaccctctgtgaagctgaaaaaccatgtataatttttgactccctgaaaacgtaacaatgaatagcctgttgttcactggaagcattgctgatgacataaatggtcaactaacacatatttgtttgttctatatattatatgctgtattcttacaataaagcaagctgggcctggcgctgtggttcacatgtgtaatcccagcaatttacgaggctgaggcgggcagatcacttgaggccagttgttcaagaccagcctggtcaacatggtgaaaccccatctctactaagaatacaaaaactattttgggtgtgggtggtgcgcacctgtaattccagttactcaggaggctgaggcaggagaatcgcttgaaccgggaggcggaggctacttgagccgagatcatgccactgcactccagctctgggcaacagagtgagactctgtctaataaataaataaataaataaataaataaataaataaataaataaagctagagaaaagaaaatgttattaagaaaataataaggaagagaaaatatatttactattcattaagtgcaagtggatcatcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttgatgcaactttgtgaaatcatggtgttcctggtttttctggtctggtttttgttgttgttttgttttgttttgccacagtttagttcctcacctgatctttccttgtatccacttcagagtctctgaaatgttatctgtttgttggttcctgggaaattgagagccttttcaaagactccatctagaagcatatttaaaagtgtgaaagaagacatttatgcgaccaacaaacatatgaaaaaaagcttatcatcatgggtcattagagaaatgcacagcagaaccacaatgagataccatctcataccagttagaatggtgatcactaaaaagtcaggaaaggccaggggcggtgactcatgcctgtaatcccagcactttgggaggctgaggcgggtggatcacctgaggtcaggagtacaagactagcctggccaacatagtgaaaccccatctctactaaaaatacaaaaattagctgggtgtggtggcgggcacctgtaatcctggctactcaggaggctgaggcaggagaatcgcttgaatctgggaggcagaggttgcagtgagccgagattgtcccactgcaactccagcctgggtgacagactccatctcagaaaaaaaaaaaaaaaaaaaaattcaggaaacaacagatgctgaagaagatgtagagaaatacgaacacttttacactgttggtgggagtgtaaattagttcaaccattgtggaagacagtgtggcgattcttcaaggatctagaatcaaaaataccatttgactcagcaatcccattactgggtataatcccaaaggattataaattattccgctataaagacacatgcacacttatgtttattgcagcactattcacaatagcaaagacttggaaccaacccagatgcccatcaatgatagactggataaagaaaatgtggcacatatataccatggaatactatgtagctataaaaaagggtgagttcatgtactttgcagggacatggataaagctggaaagcatcattctcatcaaactaacacaggaacagaaaaccaaacactgcatgttctcactcataagtgggagctgaatagtgagaacacatggacacagggaggggcacatcatacaccggggcctgtcaaggggtgggagctaggggagggatggcattaggagaaatacctaatgtagatgatgggttgatgagcacagcaaaccaccatggcatgtgtatacctatgtaacaaacctgcacattctgcacatgtatcctagaacttaaagtattaaaaaaaagaaaaagaaaaaaagtgtgtagcgacttgacgcggtggctcacgcctgtaatcccagtactttcagaggccgaggcggatggatcacctaaggtcaggagtttgagaccagcctggccaacagtgaaaccccatctctactaaaatacaaaaattagctgggcatggtggcacatgtctataataccacctactcgggcggctgaggcaggagaatcgcttgaaccagggaagttgaatttgcagtgagctgagattgtaccactgcattccagcctgggccacagagcgagactccgtctcaataaataaataaataaataaataagtaaataaataaagtgtagctctggtcttactaagtgtatgatgtttgtctccatgaaataataataatgtaagatctgagaagttaatacttaaagtaaaacctacagcaaaacagtctgctgaatttgtctgtgatctcacaggagagtctagttgtaaaccgaagcaaggatggtagctaatatcgcagcagtgtttgtaagaggatttttagtttgtcatgcttaaacagacccctcagtattctcacagagaactgaagcaattcattttcaagactaacaagagcacagcatctgcatgcatgtggcaggtatgttagtgaatgttgtgaagtaggtggtcccatcagttgtcatggttcacctctgtccagactgtgattgtgtgactcgcagttggcacttcagcaaagcttaggaaaatgcctcatcttcttttgtgggaggtggaaaaataagtagctgctttcaatgaacactgcaagccttgttaaagtctgtacctttcatacagaaactcctagatgaatggcaatggaaaatacgggtttgtgataactttgaatgatgtgtgattgccttgattagcactatagttactaagcagatatgcacttctttgttttaaaagagaacttgaattttttttttactataactgccagttgcttaatttctaccactttgtctatttttttaaaaaatgaatttccacctaatttgtgcttgtcagtgatgacaagttttaaaagtaactcaagttaaaaaaaaaaattctccagaaaccatcatctgtcaaaaagtttgtatttaatgttttctttcaggtagaaatgagacattttctccttcttctttccagatttgcacccttaatgttccagaaagctgagcatccatattattttgagtttaggaatttatagtgacctagtcatagttatgaggtgtttgagggaaatgaagggaaggatgagtagcaaagacacattaaacagaataaattatatagtcttgtttttggcaactagtctagcatgcagtttccttgctttgttcagtccacatatagaacaactctgtctaaaacagtgatccagttaggccagtttcctgtttaaaagctttctggaccgtcccttttcctgctggcaaaaccccaggctttgagacatagttctttctaaactgaccctaattattcttcccaggtcatctttactgccactactgttccttgtgaatatttcgcatctctgggctgttaacatatgattccttccactttgaatggcttgtgaaaaagacgggggtcttttcacaagctggtgatactcttttcagtcatgtatttagaccaaatcctctcactttgtggagtcttggaatagtgtccacgtaaggctggcctggttagtttctcctctgcttcctgagtccttgagtggtctttgtatatagcgtgaagtgcacagcattgggaagtctgtgtctgcaagcccatcaccttcactaggatacaacattttcatctttggacctctaggctaaccggagattgaaacttacttggcctctacctaaacatttcttgagcaactcagtgagctgtccatgtagtttagcagacgttccgatgattgtttcatggagtttgtgtcaacggggaaggactgctgagaggcagaaaccataatgaccagaaagctggaagtcatggaacacgtgtccacgtttcttcagttaatttttagaaatgagtgaatgtcacctgacagttggtgtctcttgtttttttttaatgaagctgtaccattgcaagccattttctctctctaagtttcctgtggaatttctttccttatcaagatagtaatactttggagttttgaatttttaagagattcagtcaaagcatcttgtcattttatccagttgctccacttcttaatctgtaaaacggagatagtgtctttgctattaatttttcttaagggacacagaatccaaatactctttgatctacaaatcttttgcaaagatgcataactgtttactgaacattttactagaagtcagcctgttgcttttaaaatctaggaatgttatttggcttaccaactaaacatattcatattttgcttagcatgccccctttcagatgacttgctgcagaataatgaggtgcaagttgaacaaagtacttttcaaattaccacaggacctcaccagttttaccacttacctccagatgtgtggaggccatcatgggagaatttacctttttatgtttggacatttttgtaaaaagcttgtggtgttgaatcaatgggttatgaaatggttttaggaatgtaacgagccatcccgtgattctacagagagagacaattttatgagcacattttctattgaatgtgtttgctggttgtacttgaaccaaaccaaacacaatctctaaatcataacacatacaacctctcaacttggagactcttgatttacaaatgtctctctgtgactgaagtggctgccaagggaatcaccttccctattttggttgaatgtgtttttaattttgcatgagctgtctttgttgataataataaaatgataacagtaatttcagcctttattgaatgggtgtgccagccactgagccacgtgttttgtgtgcagtgtttagttcacttcactatggtgccctaataaggatggattttagatgagaaaaccagtacagggagaagggaattaacttaccccaagtgcctcagtcaaagtttgcagaaacactttttgtggaattttttgtctctgtgatgcttcctcatttcagtctcaggcattttgcctgcaaatccctttcacttgagaacacccattgtgcaaccatttctgtttttggtttcaccatctcatgatgtaaagaaagggaaagtgataccaggcagtgtctttttactaataaaaggcagataagtcttcctcaaattgctcttcttggtgaagaataatacttgtgctccaaatgctttggtgatgtgatttttacacgaagcagctgagccaggtggtgttccagcttgttcctggacatgttgatacagccctaattgcttaaggtatgtgcctcttcttaatcatctctcctttaactggagaactgtgctacattatgacctggaaaatgggggcattaaaagcaaccccaaatgtaaatggcccttaccagcaagtcaccagctgaggaaatgcagacgtcacatgaagagaacctccttgatcctctaaggcccctggggactggcttcctgagagtgtacaagttggtggttgccatcttagttattttcagggcccaggtagatgttatgagtggaatgcagagtggtaactgagatggttgtcatgcaagaaagtggggccaggggactagaccttcgagtctttcagaagttggaaatgtggaattttagggaaaatctcccaatttccaaaaattgggatcagttcaaacattcgaaaaagtcggaggtccaaatcaaacacgtctgtgggccagaatcagcttgcaagaacccaatttgtgaccactggcttaagatgtgttgataaatggatctattggtccttgactaaagggaatctaggaaagatttgttttatttttggggggtaagaacataacgcataagaaagaagtcacttactcatttttacctgagagttgtttatttgtcttgtgaaatactgaaaccttagcactcattgagcgctctgtggtagcaagtgatttgtgatgatggtagtatttttggagaagatttttagaggttcagtgtggttctaagtgtgtgtatttgggtcctatgtgtggcagtaaagaaatgtgttctttggtgaacagtttttgcatccctgtgttcacctgcatggaattgcaagttgtttcataaatggatcactagtatacgcagaggctatgcattgaggtcttttctctgtattatcctatttatcaaccagctgtcagtcaaagaaacacaaacatggtgagtattatgggattaagggatttattatagaaattggtccttcctcaaatagtagaggagctggcggaagtaaaggtcttgaaggaaagtgagaggattagagaaagtttcaccagaagttcttgcgtagggttgggcaggtcagaactgcaggatgctgatgagggaccatagcagggaacggatgaaacattccaaaagctgctgctgcctctgtgtctgtggagttccaaaccctgtggtctgcagccatgtgtctggtgctgggtggagcccttgctgctcaacagggccgcttgttaggaagaaacagggatcagagcagaagaaagcaaagacaagctggaccccattgggcacctgccgttgtccatcatggtgtttccatcaaccttatgagagtggtggcctgttttcaggttcactttccaagtctcattaagctccccatatggctagccgtaccccaggaccatagcgggaagggtattccattaaatgagagttcctggcttaccaagttgacagttgtatgattcagtgtactctacaaataaggacaacatccttaggactatactgccgtgagccgctggctactctcccctgttgccctaaaaggcttgtacctgctctgaaacacagtattgaaatatcaggatttggaacctctgccttggccaggccaaagtaggtgtatttctgtttagggtcctcccagcatagtaccagcaatttacatgcacattagattaatgattttatctgatctttcttcctggaaaatttgggtctggtggggtggagaaaagggaggtactcaagaccatcatacagagaagcagaaggggagaacaagagaaattttggaggttggattgagggaagctgaactcaattttaatttgggtccagtccatgtaaatcctctacttttttgtctgcctgcctgtctgccaatcaatcaatcagtccattcattcgttaatcagttatgtatatctatatctattaatatttttctgtagatctatacctatcatatccatccatatgtttatattatatttacctaatctatttaatctatatcatgttatgcacatatatatgaaacatttttgagtggaaaattttatggaaaaagtattctatataaggtggattagtaatcctcttttgaaaaaaaattctagttcttctcaattgtgaaagatatgtctaagctttctaacaaaatgaactccaaacagtcttagatgtctgcctctttttaatcatttagtgaaataattggtttctctttttatgagaaggtgttaggataagtaagaaatcctgatacttaactcgtctgcctattgcttgactacagagttattagagttcagtctttgcattaaaaggaaacatacttgtaattttgcactctttgccaaagtgtgagctgctttttaggcggtacttcaactttttattgaggtattggctacttctacttcttgctggtagtgtggctactaaacaatataaagtatattactttcaaaccttagaaaattaattcagaagtcctagagcacagaaacaggtttttcctgctgctaaaatattttccctccttaggttatttgtgtgtgttgtgtatttgtgtctgtctgtgtgtgagtggggaagttatttgatgtggaagtgttgggagatacattgtcatttgggaatatactcctgaagccactaaacatcccaggtagtgacagtggtttgctctggtgcagatcactttcgatttttttttcttttcctttttttttttttttttcttttgagatggggtctaactctgttgccaggctggagtgcagtggcgcaatcttggctcactgcaacctctgcctcctgggttcaagcgattctcctcctcagcctcccacgtagctgggactacaggcgcctgccaccgtgcctggctaattttttatttttagtagagatggggtttcaccatgttggccatgatggtctcgatcttctgacctcaggtgatcctcccgcctcggcctcccaaagtgctgggattacaggcgtgagccaccacgcccagcctcactttagattttttttttaaagagaccagacattttttgaacccctcaatatgttaggcactgactggagtgcttaacaatcctagctacttagtgggaagactgccttttctttcttctttttctttttctttttttttaaattaagatggagtttcgctcttgttgcccatgctggagtgccatggcctgatcttggctcactgcaacctttgcctccctcctgggttcaagtgattcccttgcctcagccctctgagtcgctgggattatggcatcagccatcacacccggctaattttttgtatttttagtagagttggggtttcaccatgttgaccaggctagtcttgaaatcctgacctcaggtgatccacctgcctcggcctcccaaagtgttgggattacagatgtgagccattgcgcctggccaagactgccttttcaaggctcttaggagacttgttatggcccaggtgtagaacataagaatggaagttgaacattcacgaattaaccaatcacaattcagcacataactgttgagcatctattatgtgatgagggttaggaaaggctttttagagagggcagtgatttggggtggaggaggagagcagtcctgtccttcgtgtctgtgttcacctatgatcatcataaggaagagcatcctggaggacgttcctgtcctgtatcccagggcctgtgtttaggaaaccaagtcacacctccatggctttttggtaatggcatagttggttgtgaggagttgttctcctaagtctgactgagtcgtcatcctgtgctcttaagctatgctttccaagcccaccaggcccttcattcccagctgtggttggaaagatacataaagttctcttccaggctctcttctctggtagaactccttgacaatttgccttgtcaaagcgttcttctgataatgtgtatgtctagttatcacacctgccatctttttgtgggaagcttactgtctaggccagaggaccccccagcactaggctccttcctagccttcctcatggatggtcacccaggcttgaattacagacctttctctccttcacccagggccaagtacttctctttcaaacggtcccttttcagacttgcccgcatgtgtgaaaatacaaggggtagatcttaggggcctgataggtagtaagtggtaagatgcaatgtaagccggggtaggggggatgtttatcacaggcttcctggaaactagttgggtttcactgagtccattcatttccttctctctgatgaatgagtaatcagatgattcacagggagctgctagttagaagactgcagcatgttctcactagtgctgtcctgttagacccaggggaaaggttatattggtgtgtttttaggcaccatgtgtcaattctttcaagatgtatatatatttttgtttttctaaagggggcagggtttcaaaaaggtttgagaagcattgtgttagaccaagtttgtccaacctgtggcctgtgggccacctgcagcacagaatggctttgaatgcaacccaacacaaattcgtaaacttttaaaaaacattatgatattttctgtgattttttttttcctagctcatcagctatcacaagtgttaatgtattttatgtgtagcccaagacagttcttcttccagtgtggcccagggaagccaaaagattggacatccctgtgttagaccatcatttgtttgctatatgatgtcatagtggtagaatggtcacttaaggtaaaatctgaatagagaaatttggcagaaatcataggaatttctgtttgaaggcataatgagggttaatcatttttcataatagatgttaagattaatagtaatcatagcccatatttattaagcactcgccacacactggtttgagattaagattttgcgagaataataataatcatttaatcttcccaatagccctatgaaggaggctctattatattgattttatacataaggaaactgaaattagacttagttattatcaagggatgggtccaaatgacaagaccagccatctgtcctggaaaaccatgccctggtatgcattcaaaaagagaatgaggttttgtttctcatctccatttctttatactggaaaaaccgttcaaaatttaatacagctgtatgatctggcaaaattcttcttcagatagaggtggattttaaagagaatggtgatttgtctacacgtgttcacagcagctttatttatagtagccacaaactggaaacaacgcagatgcccatcagaggtgaatggatgagtagactgtgctatatccatgcagtggaataatattcagcaataaaagagaacaaactattgatacatgctgacatggatgatcccaaaatatgctgagtgaagaagccagagaagaaagaatgtataggttataggatgccatttatacagacttctaggagatgcaaattaatgtacaatgacaggagacagattagtggttgcagtacaatggttggagtggatggtaaggaaaagagagtgcaaaaactttaaagagtgatgggtattttattaacttaatattggaagtggatgcatgagtgcatatgcatgtcaaacttatcaaaatatacagtttaccaatgtgcaatttatcgcatatcaattatagctccataaagctgttaaaaaatttatatatatatatatacatatacatacagtaagggaaggcaaggagaatgacccattaatgtgtgggagtaataaaagagaaattgtacaatgagaggctcactctcagagcggcctcggaaccccagagaggttattattgtttgatcagtcagtcaacaggtatttattgaaattcttccaggtactttgagagaatgagagatgtatgtgagcttaactgtgcctggtagtgggacccatttggaaagagctgggctctggagttagtctgatgtgggtttcaatcctggttttcccactccttgggttaaagcttttgaactcctttaccttctcttagcttctctttagtcctagggaaaaatggagatggcagtatctttattttagggtcgtttgaaggattagcaataatatgtatcaaatgcttggccaaagtgtggggcacatggtaggaatgcagtggcagcgattattatcatcactttaattgcaaaactggaagttcagattccaggaggaggatgtagttgctgtggactggccttctcaggcaaaacttcacttggaataggcttggaagactgtataggagttacatgaagtggaatggtttgactcaaagtgcagaaatgggactacataaatctgttaggtttcttgaggaagtaggggagatcaggtaggggaagggcaagaaatcctacttactaggaaagatggcttcctagctagtttggggcacaaatactcaacagaccattgctatggtgaaaatggtagaaatgagaagagcaatggagggaggaagacctgtgtcatgaaaatacttatctgactgttcagcattattgatattgtggtctggatgactctgtgtcatggagacttgccctgtacattataggatgtttaacagcatccctggcctccacccactggatgccagtaggtagcattcttcacccccatacacatgacagtcaaaaatatctcctgactgccagatgtgccttggtggggtcactgaagaccactgctttagtaattagactaagcatcagtgaagatgagattttcatttcagtgttggaagggagaaaggagtggagttcatttaaaataatagaatgaactgctctaattatagaggtgtagcagaagtaacatggttcagagcattgacagcaaggccacttataagctgtatggtctttggcaaataacctgttgtacttcagctccctcatgtgtaaaatgggggcaataattgcacctaccttaaatcagtaagttaaattgtaactgaggccaccgattatttgcttaaagaaaacagcattactcctcctttattggaaagactttgaagaaaaggggatcttcctgtctctagctctcttgagttgttttttaaaggacccatcttttgaaaagacccgttaaaaaattagtcagacatgaggctattgaaagatcaatgtggaaaatgtactttgtccctgagttgattctttttctctgggcccactgaaagatcttcagattataatgtaaaagtgaagtctttttgaacagagcagaagaaaaggatatcaagggcatgaagtggatgttactgaagggagtcgtggtgtgctgtaaaggaactcctgagagggacattggccgaagggtcatctccctcttcttggcactgaacgaccaccacagaccacaaaagggcttagaaccgacctccatttcaatgggacttttcagtgacacttgagacctcgtgtcatagccagtttgtgaccattctccaacccaagcattctgctgcttttacaacagattattttagaagctgcttaggagatgctactagggatgtgtcaggcttcaacaaattaggatttcctccccaccactctgatgatggtgagaccagcatggagactggcagagtgatgaatgcattggcttatcaaggtcatgagtggcagccggctgcattgtgtccccaattcaaacaaggatcccccaacactgcaacagtctaggattgtctcctaaattcttcacattccaagcacacaaaggaggtgtcctggagccatgtaccttggggaaggcagattatttgtaagctcttgtgttgccttcactgcagacagatgggcctcctctatcctaaacagaggctatttaataacgtttgcttcttgttaactttccttactcacctgatctaatgaacctatgctgctttggaacatcactggaaatgtttcagaacaaagcaagaatcatttggactagtacttcttttggagaggtggctattaaatggggtttaaagtttttcatttgtttgtttttttacctcttagatttggagcttcttctatggccttgcacatatcattctgtgactatgatgcccacattagcccagttgtcttacaagtatgtaaaatccttccagcagttcaggttcatttggcattcttgttaaatgtactgctgttaggactggaatgagaaaaatgatagaaatacaagtaaccataaaacaaaactagaatagaataacagacactgaagtaaaaacaaaatgtttatccatattttgtcattcaggcctattcattgaaataaagagtacaaagattttaaaaatccaactatattatgaggaaatgttttaagaattttttgacagtctttcctaaacatttcaagttgattgacaaaagataacaatccatcatattgcctactagccaatgttttgtggtgccttcacctctgagttctaggaagtggttttaatcatgtttgcgttcagctccccttcccatttattaaagattggaaaatgctaaggtttagttgacatgatgaccttaacgtaaaagggcatgaagagggcaaagactcccagcttctaagtctagttcatctgttactctcaaaggtgtctttgacacttagaaatgcttccacacccttgccgacttttactttttaggaagtgtgcagtatggtaaccccctttcaaaggccaatagcaaggccacgcctgacttcaaaatgaggttatgctttatgctggagatgcacagcagaaaacagtagtccagccaggtggggaaataaagccagaagagacagtatattttcaggagcaatttagtgcttgattgatcttacgatattgttagcgtagtgtttatagctgattgggtttacctgaagcaactgaccagcactccgtgtttggaaacagtcaagggagaaaacacattgattagttggtaagttaactctgtacctccatactctaaaattagtaaatcagcctgtcattgacagcttggaaagatgttcctgtgtctcactgatccctggccagggttgccaggactttctctttactttgtgttttccctggcccatcaattcttcttcaacttttgtgacttttttaaaactggctttattcaatttttgtttaactgaaaggcacaggatgcaaactgaatttataggatgttttatagcgagaataaaaggataaatttcaaaatcatatgctaatatgtaaactgaatttactcaaaacattccttttgttttgtttttttgagataggatcttgctctgtcacccaggctggtgtgcagtggtaccatcatggctcactgcagcctcgacctccgagctccagtgatccacccgcctctcagcctcctgattagctgggactacaggggcatgccaccgtgccctgtcaattttttatatttttggtagagatggagttttgccatgttggccaggctggtctcaaactcctgggctcaagtgatccacccacctcggcttcccaaagtgctgggattatagacgtgagccactacacctggccaaaacatcactatatttgtgtgtatggattataccttctctgctgatgttaatagcagggattctttttttcccattctttctgtgaggtgtgatggagaaaacttatgtcctataatgaaatgggaataaggatctaaaatacattaaatagcacagaacacctccctccaccttctaattcttagagcaatatcatctttcttcttctttagttccctccaagattaatcaagatattatttatggatggtgtagacctggtgtggcaaattagagtctgtgggctaagaatggctttcacatttttaagtggttaaaaaaatcaaaagaagaatagtactttatgacatgtgaaaattatatgaaaatcaaatgtcagtgttcataaataaagttttattggaatacagccacactcaattcatttacttcctgtctctggccactctcctgctacaatggcagaattgagtacttgcaagagagaccatatggcttgtaaagcccaaaacgtttactctctgactctacacagaaaagtttgccgacccctgctgggaggcagatcgaaaatgaataatcatcagtaatagaaagagcacagcctttagaatcaggcagtacagagtccatgttatgtcttggtttcctcagagctgcaactattacacattattattccaccttagaaggtttgggtgaggacgaaatgagataatgagtgtaaagcatctatacatgtatagcatgctgccaaatacctcacagatattcagccagtgctggtatctttccctctccaggttacaaatatttcgggttcattgccttacctcaggtcctctgttcacacagaactggagtgaaaaataccctttgcaagtctgacaatagccggagagacaaaaacccatgtctctctctctctaccttcctttatttagtgtcttttcctccataaactggtggcgtttagccctgtgaaatgtcattttaccttaaggtgaatgggtatatagaattggtcttgaccttgaataaaagaaggacacaccaggcaatcatcatttgggggaacttcagagaaattgctccatgagagtaacacagagcagtgacttctgctggaggggttcacaggtgacattttgagccctgtgcagcctgtgcctccgagacagtcagcgagggagccctggcggtcgtggggctgccttcgccagcttcagaactgtggtttttcccccattaacacacttcttgttaagctgatgtggttgctttctaaactgaatcttcccttggccagaaagaaagaaaaagcttccctgcgtgaagatgaaggtttattggcaatgtcttctttagtctcttagcaagaacagcaaacagagaactcccttctttctgacttaagttacacatattttttttctcttttttactttcaaagctggcagcctcataagagcagcattcaaatagaccgtgccagggatgcagggcaccatgaatggggcatttcttgtccttctggccccctttccctttgtgctgtctcttttccatgtgttattagccaccttgcaaagtcggagctttgccaacaaattctgggttctgtgggttgctgtctgaatctgctgcttattcaggaaaatgagttagtttctgctgtttgtagaaaaaaatcaacaaacccacttataggttacatttaggttactaatatatgtggtagcacagctaagtaaactggagattatgctgatgctatgtgcttattattgcagtgtgggttttaatgtgaattttgcacaaatccatgaatgatatgcccatttgcctttttaattttcttgctgttaaaaaattagcttattttgtagccattgaaatatatataaagaaaaaattaacttctacctgttttttttcttttaaaaatatttttatgtgatctaaccagtctgaaatagttggctgtaaatggatgtgggagtgtcatttcaaaccttttacaatttgggatttcttctggggggagtgggtatcagagctttagttcttgttattggcttatgacgatagtctggaattttatagattgtgtttggctgtcagcatggtgcttgggtgtgattaatttgtgtagcttgccattggatagataatattcattccttggatccttgttcagaagggattaaccaagtgaactggaaaacatgtctttgcaggagagctttcactgtttgtgataatcagtgaacaatctagtgctaatttaattccactcatagatctggctgactcattggctcttaatgcttcttaacttctatatttttaatcttcagttttttacacatatacaaatattatagtagacatagttcaaaacttaacatttctccagggatcttgctctgggaatgcaaagtaaataccctctaaaataggtttctggaatgttgtttttctgatgggtctgttatttctgcctttcttctaatgggaaaaaaaattgatttgaaagggtaaaataaacttagcttttttggaaagggagggttaaaataaaattaacaacaacaacaaataaacaggtgataccttagagacctatctggcataggacttttgaagcctataacatggctttgggttttggtattgatcttttatagggctaaataatttatagccaggcttttgccttgtgggatggttggagtgtgtgttccaccaggaggcaaaggtttctgttcaaatcttcctgttcacttgatttaggtgtttgataagtgactgcaaaatggagaggtcactttaggaaaggtttctctcttcttgccctctgttgcctttgagtagtttcctcctgtgttttgttcatctgaacaatgcattgacttgccctatgtaggaaggctggagagctgcttatgaattgtagtaagatgtcttatggcttccagggagcaaacctagggagttcccaggtactgattttttttttttttaatattaattcttgttctgttgtccaggccagagtgcagtggtatgatctctgctcactgcaacctctgcctcccggattcaagcaattctccagcttgagattacaggtgtgcatcaccatgctaggtattgattgattaattgattgattgattgattgtggtgcctccatggactagactctgcctcccactttacttgtagcctaaatgtaggtgacaggtgaatgtagggttgccagatttagcaaagagaactatggggcatccagttaaatttcaatttcagataaatagcagatattttttcgtattaagtatgctctgtattttatctggcatccccaagtgagtgttggggaattagttttctctatcctgaaggccttcaggttcgatcacatattcagagataattgtgagtgagatgtatggatgggaaaagagagcaccatttattaggtactttttatatcaagtactttgtatttagtccttagcttgggaggcaagtattgtaaactcactgtacctttgatgataaaagtagctaacgttgattgagtgctctctatgtcctgggccctgttctaagaactttgatgtatccttatttagtgcttaaaataaacctaagagggttaagtactattatgatttccattttacacgaaaggaaactgagctgcaaggtcacatagctagtaagggattgttctgggctgaagaaaaaggatgcatggaggggagtatcttgcccaaggtcacgttattagtaattagtggagtcagaattccaatgcaggttccttcactccagctcttcttacctcagaaaacacacttgcctggaccctcccctggagttggatttagttggcttgggcatggcgatttttaaaacttccccaggcgattttaatgcacagccagactgagaaccactgctttaccccatttttggagtaaaatgaattaccctccttaggaaatctggtcgctctatgtggccattcctttagttcctgcccctcctccacagaaacacaccattccaaatctggcagctaatttttcatggtctttgtttcttcaaaattattttcaggaagtcttggtgaatatatgttggggtataaacagaccacaaagaaagaccccataggggtattctgttgatggattttctgcacgatcttttctttttcattcttccattatacttcctggaggagggactacccctttgttcgtcatttagttccagctgggtaccaggttgggtatttggggaggtttacagattaataaaactagaccactaccctccaggagttttcaattttagaagggaagtatataaatgtaattctaggtttaattttctaaaagtcacttcagaggaatacaaagtattagggaattcagaggcagcagaggcagagtgaggtggtgtgaagtgtgagctctgcagtcactgccttggtttgagttcctgccccaccgcttcctacccacagaactctggccagtgcttgagccctcctggtctccaggactttgttggcacagtggacatgccaaattttttgatgagagacatgacgagttagtgctggtggagtgcacaccaccgggcccagtgtgagggtcagtcctggtgagctgctgtgctctgtgcgttgcctgaagctttccagcaggccttagctgatgctcatggatccaaaacatcaatagtaagttactaagccttatctgctgctccttaaattgacagagtcaagaattaggtaaccagggaggagccacagaggtgtgtgaatgggaaactagacccagtcctggaagatgagcaggaaatggagtgggagacattgataccccaagaccctagttaggcaaaaagaaaaaaaaaaaaagacatctaggctgggcacggtggctcatgcctgcaatcccagcactttaagaggctgaggctggcggatcacttgaggccaggagtttgagaccagcctggccaacatggtgaaaccctgtctctactaaaaatacaaaaattagctgtgtgtggtgatatgtgcctctaatttcagctactcaggaggctgaggcatgagaatcgcttcaacctgggagttgaaggttgcagtgagctgagatcatgccactgcactccagcctgggtgatggagtgagactctgtctcaaaaaagaaaagaaaaaaaaaagacatccagtccatccagagagcccgggacccttatctagtaagaaggcagctgcaatagaaagaggaaggcatttggtgtgaggactcagatacgtattatgtatatgtggtggcaggtgggaggagggtggtgatggaagcttctagtcttggtggtaacattcacgatggatgacatagaagaggctgattgttaaagggaaaaggatgatgaattaggttttgggtaaagttatattgcagccttcattgcaagcaatgcagtgccacattctatgttgttaatacgcacatgccccagattgcacatttggggatgagggacctctctatatctaacttttactggtttgagagcgtgaatgaagaaaggctcacaccactgctaccatcccatctgtcttttatgttgaacttgtgctttcttcccctagtttgtttaggtctaagtagaatactttgcataggaaatcgataaatcttctattgctgtttgagtgatggggcagtttctttattaccagacagttctgcgagcaataaatatttctaatatcctgagtatatttatttctaagtgggagttagagtaatgagacatttactaacgctgggctcgactcagaattcagaaacagaaggtagatgactggcaaggactgttcctactctagagttttaaggtcattagaaagcttttgttttgttgaaagcactgtactttgtgtacgatatggttgagccttttagaaggttgctgagacttacgtcttatctttgcttatatagtatcgactagaggttggcaaactttttctgtgaagcgccagatagtaaatgctttaggttttgcacatacattctctgtcacagctagtcaacgcttgtaagaggatagcagctgtagacaatatgtaaacaaatgagctatgttccaataaaactttgtttacaaaagcatgcggtggggcgcctgtagtcccagctactcgggagaccgagactggagaacggcttgagcccacgagttttcgaccagcctgggtaatagagtaagaccttgtctctataaaaaataaaatcagccgcgcacggtggctcacacctgtaatcccagcactttgggagaccgaggcaggcagatcacctgaggttgggagttcgagaccagcctggccaacatggagaaacctcgtctctactaaaaatacaaaattagccaggcatgatggcgcactcctgtaatcccagctactcaggaggttgaggcaggagaatcgcttgaacccgggaggtggcggttgcaatgagctatgatcgtgccattgcactccagcctgggcaacaagagtaaaactccgtctcaaaaaaaaaaaaatcataaagaagaccaaaaacatttcaggctggatttggcccacaggtctaggttttctgacccttggttcactatatgagccatgggggcagcagttctggtttgatcaaccattaactgtgtgacttaccttctctgactctccattttatcaactataaaatgagatcatagaagaacaagtttgtggtgttattttgacactgaaagagatcacaaaagtagttttgtatagttgctataacatagtaaggtacagaaaatgttagctaaaggggaacaaaaaatccatttcagtcggcgttatacgtaaccctgatgtttaactgcgattatcttaaggtaagaaagagacactggcaaagcagaatttttgaagggccaattaagatcacaactctacacaatgagctgatgtaaataaggtatatattgacttttaatagacttaaaaagagttgatgagatcatggaaagctccacgtggccaatattgttattattctgtagatggtatttcttggaaattttgtttcattccctttctggaagtgagttggacttttacctgttttttggcatagatttggtctctcctcctcccagtagtggaggtgtaaggagtaaaaacttttcctagaaataaaacataacaagcacttactgagtgcctggtgtgtgttcacattgtgtgaggtgttatgactgcagaatgagttttccataatcactgtgtctgcattggagttggaggagaatatcttacacagagctcccaaatcccttgcaatttcctgggtgatcaactatcttttgttctaatgaggttacccttagtggacatgatgctaaggcagcatataaataagtgagggctcatgtgatgtgggctgtgtaaatgtgccaagatacttcagtgtgagaaaaaaagtcacatgtgatggcattagtctgtggaagcttcgtggagaaaactctggatagggactttggaagtgtagtttttcttggctgagtaggtctctttcctaggaaataattctgtcccattccctgcaggtatcaagtttggattttgatgaataaagtgtctcttcgttttaaaaatagggcactgaatcgccaaggcagtggcatacagggtagaacttcgtggccatggcccacgtggactgtaatggcttcaggcatttggttttgcttcacacttcaaagaactgaaaagtgaaggggatttatttattcatgaaaacctgccccacacaactgctctgtgtgcctggaattcttgttgtgggtgggcaggctgatctggtgagaacagtagtggaaagaggagaggaacatttcctccctaggatggaagtcccatagagcacgcatttgagactgctgagttcattgccatatgctagcacattaaacagagtgcgccatagagttggggctcaaaagtttctttgtaagggagtgagataataattgagctatgccttctgctcttaatttggtgttaggcatacaagcagggtaatctaatgacagaatgaacataaaacaagtgagactgattcaacagatgaggctgtgttgaatgtataggtgggcagaggtgagaaggagcaactgtccatcttggagttcaggaaggttttggacatggtgttgtacgaacttggtctttaagtatgaatggagatataagttgaatggaaatataccaggtatttcaggacaaagagaacacaggagaacatgcctaattgtaggaatggcagggcaaaggagtactggaattaaaaaacaaggtgggggccaggtgcccccagaggctcatgcctgtaatcccagcactttgggaggctgaggtgggtggatcacttgaggtcaggagttcaagaccagcctggccaacatggtgaaactccatctctactaaaaatacaaaaactagccaggtgtggtagcgtgtgcctgtaatcgcagctactcaggaggcagaggcaggaaaaatcacttgaaatcaggaggcggaggttacagtgagctgagatggcaccactgcactgtagcctgggcaacagggcaagactccatcaaaacaaaacaaaacaaaaaacaaaactaaaccaaggtggatttgggaaagacttataagccctctgattgagctcctttgttgttgacttcttgatcctctttaattcaggaatcacagttagatttcttagaatccttctttgtgctccaagtatcaaagaccttatggggctccccagccataatggaaaaagtaatttctttaacaggggagacaccagagcaagagcggagatgggggtacgagggggtcctcatttatgcagctggccagagctcctcatccaacccggggcttagtgaggtgacagatgtgatgttggccaatgtagtcttccttttctttctttttttttttttttctgaggcagagtctcgctctgtcacccaggctggaatgcagtggcgtgatctcagctcactgcaacctctgtctcctgggttcaagcgattccccagcctcagcctcccaagtagctgggattacaggcatgtgccaccacgccgagctaatttttgtattttttagtagagacagggtttcgccatgttggccaggctggtctcaaactcttgacctcccttttctttttccttccttccttccttccttccttccttccttccttccttccttccttccttctttctctctctttctttctttttcttgtttaaaaatacatctatatttcctctagcttgtatataaactgacctctgctttaagtattagctatttattgaggaacacgatgcatgggccagacactgtgctaagggcttcacctgtaatactcggtatagacttcttataatatcctatgggtaagatactattattatccctactcctattgttttggggcaggcaccttatccatttgtttgctgctgtattccccatgcctcaaaaggtgcctggcacttactaggtgctggattttaaatggattaatcacatgcagagtaatttgaccaagtcatactggttgtatatgggagttggagatgaagactgtagggtttcaaagtctggactcgttaccctgcaccatctctgctttctgatgcctagttagagaaagaacgtcctatctgttttagacttgaggacttctttttaatgactttttcagacttgaggactcctttttaaagttgtagactgttccacctagatccttctggtcattctctactttgttgtggataaaaattttataataaattaggtaatgtttaaaagtggctttgtattttgtacatttgcaacaatgtgtgtattaacctctcctaattccatctactggcaaagcttgatttgatgagaattgggtcccctgcagtaatgtgactctgaagctgacggattagagagcttgtggttcaggcatgaaccttgtctcttgggttggacctgagtctagactgaccctagagttggaaatttagtagcttaactgacagaactgacgtgaacaattgctgctttttattaaacaagggcagttcatctcattcgcaaacattttctaagaccttgtgcaccaaatggtgagaaataagaaagttccctgcccagggagcttattgcctgctggaggagataaaacttttggaaatggggtagaatgtggtaagtgttttaatagaagctgcaggagcttagctgagggaggagatgacctttggatggtgtcccacagacatatcagtggtctttggatctagaaggaccccactgttgtctgccttgttgcaattgtagcatgggtgttcttgaaggaagcacaaaggaaatgtccactgacagagttgaagatgacactggcccagtaggtttgctatccaatttatggaagcaaggcaaaaacatagacaaagcacaggagataatgaaggtgtgaaacatgttcaaaataatcaagaacccaaacagatacctcaaatttcttcccaccccatctcccaggtaaccaaaatagctacctggttttttacaacttttcatcactttaaatacacttgggattcccatttctgagaaacaaagacagaggaagagagaattgcaaaaggcgttagtatgaatctgtggtttgcggactggtaattaggccagcaggcttttttgaactacagagcagtttgttaaaaataatgttaaaaaaaaaatacaccaaaatcaggtttctcaccataatgagaaggaaagttccagaggtcaaacactgggcctttctgcttctcatttgagatttttatgagccagaaagcttcttcattaaacagcaatttcaacattgcaggactgtatgttttttgggttgttacgctttcacagaatttttgaatcatagccacacttcagaatgaaaattcaaagtcaaaatgcttacatggacttaggagaagtgctattctctgcctttctactgtagtggctttattttgtttatgtacttgtttatttatttattcctggaagaaatcatcaggcctgctcagtcagtagttcatcccaccagttcaactggaagggattttttaaaccctttcaccttcactcataattcatgtcttatgaattatgaattcatgaattattggtgcctgcttgggtgatcagtaaaaataattcatcagcattttcttcaaaaattttcactcttctggcatgttgatagtaccagtcggtggtcttttcattgtaccttctggatcttattttttttttttttttttttttttgtgacggagtctctctcttgtccaggctggagtgaagtggcgccatctcggctcactgcagcctccgcctcccgggttcaagcgattcttccgagtcagcctcccaagtaactgggattacaggcgtgcacccttaggcccagccaatttttgtatttttagtagagacggggtttcaccatgttggccaggctggtcttgaactcccaacctcaggtgatctgcccgccttggcctcccaaagtgctgggattacaggcgtgagccaccgtgcctggcattaatgttgaaatagaatagaggtttaaccttggaataaaagaaagaatcagcaaatacattatctgagcctacatacactttgtaaaaagtatacttccactgttcagaattagatgatggcacaaaacctgttgaggtcttcattcatccttacaaatgtttattatgctgagtgtcccaggtgactggatacagtggagtgaattagaaatttgaaattattgccctgaggggacctacattcttcttgttggagtgcgtctgtgtgggataaggtagacaaataatataggaaattcaaaaaattgtttcagaccatagtaagttctatgccagaaatgaatagtccatatgataagaggaacagacattgtgagatgttggatctataggaaaagaggaacagacgccatgttcaggccatggtgcatgtacaaaagacctttttctgaaatcagtgcaggcagtgagtggccaggtgtattaggatcttttagatgtagtttaatgaagagtttatggcttaaagtgagacagtattacttcagagctcagcttctctccttggattttctctcagcaaatgggagaagtaacgtctgcccttcggagttgttacaaggagacaagataaacacagggtccaagtgcttggtaaatggtaagtgctgttattagagtcaggtgttctagtcacaggtcctcaacagatacagctttggcagtaggaggtgcagctgacctgagctgtttttaaattaaaattaaagccacctaggtttcattagtcagctagcagagaggaggtctgggggaccatgcttaaccagagtcagatgcttggaggtcattggactctacagggattctgcacagtcactgggacagaagacgtgctccacaaataggcaaatatcctttgacttcaattgaatttatattttatccattaagggagccaatttacctccagtgttagttgttattttagtcatttacccactgttcaacgtttttgccttttcatatattttgtgttttaaatgccattaggatatctaccccctttcccactttaaaacaaaataattttggaactcagaactcaaatccttaattttgaacttactttcactttttaaaaaatcttggccgggtgcagtggctcacgcctataatcccagcactttgggaagccgaggcaggtgaatcacctgtggtcaggagttcgagactaccctggccaagatggtaataatacaaaaaaattagctgggcatggtggcgcatgcctgtaatctcagctacttgggaggctgaggcaggatagtcacttgaactcgggaggcggaggttgcagtgagccgagatcatgccattgcactgcagtctgggcgacaagagtgaaactccatctcaaaaaaaaaaaaaaaaaaaaacaaaaaacactcttgttgatacaaagaaagatctagaattaaaaactttacaggaggaaagtgaaaaggctggaactaactcacccaaaatatttagcaagttaatcataaataagataatagattttgagtctttcggttttcagtggagaactttatatttgattttgcctaatgtgtgaaactgtataaagcatactctatagtatatgttcctgctgcctggaagcagacacatcatcaaagtgtgtgtgtgtgcaagagaaaacacattaatttctctttctcagtttgtcataagaggggagtgctataaagaatcttctggctgggtgtggtggctcaaacctgtaatcccagaactttgggagaccaaggctgcagtgagctgtgattgcaccactgcactccagcctgaatgacagagcaggaccgtgtctcaaaaaaaaaaaaaaaaggaatctttttacctgcaaattgtaaggtactcgagggcagacattggcattttcagatacatgtgaccctgtgtgtttgtgtgaatttctgtgcacacgtacatccccctcccacgccttgacataatgcatacagataaatgttgaggttcagtggcagctgttttgtttcccacagacattttacttagattattctggaaaacattctgaagagaatcacaagcattgatcataaagttagaagatgtgatgtttaagacaacatggacataggaattgaaattttctttcccattgtctctcgagtgtttttgaggccagtgtttcttactcttgcttgagtatacctggataacaaaatccagtttctaagatttctgccctagagattctgatggatttggtgtgctgcgtgcccctagaccctggagattcttaggacaaagcaaatttgggacactggggaagaaaagaaaaagagaataagataaagttcacctgaaaggatattccaggaatggggagcagagtttgcaaggtcatagaggctcaaaagaacaatggagaaagggcagtagatggtgggggtaggaagaacaaagcctggaaggtggttaagagacacacaatgaagggcctcctgttcaaggctaaaggtttctactctatcatggacccagtgctgtgaccttactaaatgtgtacattttttgtctttactgatgatcacagaagtaacattttctattaaaaacggaaacattactagaataaatgacccccaaagggaaattctcccataattctactctgctcaactcaattgaaattactatcctcaagggtttgtgactaaactggaattactattgtaaagcagtggataagatggaatgagaagctcagtcctatagataagttatcatgcgatttactatcccaggcaagagatcagtggggctttgaataaggcctaggaggagaccgaaaaggggcggccactgagagatatggagactatagaacaggtcagactgtggtaaagggaaggcgatagggggattctaaggggctctgaggtttctggaatggctaacagcctgaatactggtgtcattaagcatgtaggaatacggtgggaagatcatatggttaaggacatgtcaactttgaggtacccagggggatatctgtgtgaagatgtctgtaaggctgctggaaatttaaaagtggaatctaggagtgagttggaatttaggaatatagatttggaaaccacagatacatgaaaaaaaaaaaaaaagactgagatacagagaaagggaggcaagaaacagaatagtaaaatgggtcattactgcctaagtgtttttgtttgtgaagcttaatgagctaagggctcattcttaggttacagtagtggaagagagatgagtaaattatctctgcaggtcaaagaggttatagaatctgttctcatatgaattaatcaaatttaacttctcatgttgaaaagtagacaactcataaaggagctatcatgtaaacctttttttaacttggaagaagtccaaatacagaatacttacagattgaagaaaaatgttcagtttagatttcaagtgtggtcatttccatagctatgtggtgaaagaaattgtgtttccgaaaatcgtgtttccgaagaggctatgtttttaaaggtgccactgggaaactatgactattatgagttttgcagttttgacattggatggggtgtgtgtgtgtgtgtgtgtttgaattgagttatagaacttacatgtaaaattattcatctgacttccggggaaaagtctgttttttttgaaatacctttttttttctatttattcctttaattattatacattagaaagaaatgacaaggattgcatcctagttttaaaatgctgaacttttaaaaaggcaattttatttttaagactttaaataactcttattagtaattggatttgtggcagattccaagagggtggttttggaaagcacagtggcttccggtggcttcagaccttggtttggaattgcaggcctaccgcacaccgactctggagagtgacttggagcctccaaattccaagcttcctgtgtgcgagtgaggctagcaaaccacattgagtaggacagcctgagggttaagttacaccatggatgaaaagctgatgcatggttctaacttgcccgggcttgatattcaaaaaatgtctattccttttccattttctctcttttccaaaaatcctcttgctctgtttctgttaagacccttttgcaacactctgttttaacatggtgcttaatatattgtcagaaaccacattttccagtgcatatggtgcagtttttaatttctaatttagctttttaattaaaaactcaccttttgctcctaatacctataggggttggtttccaattctgcttttctggtggtaactgaatctctgttctcccagtgatgagtgtaaccctctgtgtacaagtaggaacatcatgactgccatgcttgggccattggtataattatttctgctacctctgaagactgtggtgagggtagaatcagagtggtccctagccatcgtcccccttttgaattggtagtcatcttgaatgtcacagcagcctagacttgtagaccatatcaggaaagtagaagcaagaattctgtcgtgtgctactccactccaagatgctgtaggtcatcagaagctctgtgacttcagatgtgcaagtgaggccaaggcactgtcacattaatatctgtgtgatctcggtggcattgtgcttttccatcattgtcagggctgctgggctctctgtgcctaaaagctgcttcaaacaagcagctcacattccagagctctgagagatgttgtcagcctttaacagttttctcttcgagaagacattagattctgtacaggttgcagaaacgttgtcttaaggtggctggaaggaagtgtttgaaataacacatgtgcttgtgattttggtaaccaaggaaacatgtacctgatacaaagcttcctttaaaaaatgatggtacccttctgggattgcctcagaatcacccacagcaagattccaaagggatttaaaattaaagtaggtcacttccagcaactgtatcaagagttaacagagaatcacctctttaaaaatgaagaatcatctctttaaaaatgtactgtttagaagaggaacccaatacattgtggatacaatatgctaccatctgaataatctgagtcttgcttataatggatgtttaataagtcttacctggattaaattttcctctgcttctgccttattatttgtattatttttattcttagtttgccttctattccaaattaatccttagcttctcgccatctcttttctaacagtttgttattaaaattatatagtgatggttaatgcagccactacctgtactttgcaaacagattttgctaatacatccatgatatgtagaatgatagaaactggagttgacttagaagataatcatatccaaacttttcattcaataaatgagaaactgttgctgggtgtgatggctcacacctgtaatcccagcactttcagaggccgaagcagaaggattgcttgagcccaggagttggagaccaatcagggcaacacagtgagacccctcgtctctacaaaaaccaaaaaattagccaggtgtggtggtgcacacctgtagttccagctaattgagaggctgggttgggtggattgcttgagcccaggaggtcaaggctacagtgaactatgatcatgccactgcactccagcttgggcaacagagtaagaccctgtctcgaatgaatgaatgcatgaatgaataagaaactgaatctttaggaatagttacttagagtcctagaagtctgacttaagtctgacttaaatcttaagtaagttaagagtctggcttaaatctgaacacagtatgtacattttagtaatgttctggacacagagacctgagccttggtacagattgtgtggtattattaccaacaccgttttaacatttatgttacaaaagacttctgcatgttggacaacaggaaagaaatacagtacttaactcacaaacaacaaaaggattaggacagtccttctgaaagcaggggtctcaacatcaaatgtgacaacagccatacaggctttacaaatatgtagactggcctagtataagagaacagggagtgggcacatatttagcgcattgcaatgggcataaatacctgaagttacttgacccgtggaagagcccttgacagccagataggcagcaacccctttcctagtctttgttgtcatacactgtaaactgaaattgtgctgcatttttttaagtggtacatttcataagaggttgaagtgaaaagaatgtacctagaattttcacctgggagaaaattttattcctgattcttggttatctataaaattatatacctggggataaaaatttcagtttagcttaaaacttaaattgttggccaggcgcagtggctcacgtctgtaatcccagcattttgggaggctgaggcgggcagatcacctgaggtcgggagttcgagaccagcctgaccaacgtggagaaacctcgtccctactaaaaatacaaaattagctgggcgtggtggcacatgtctgtaatcccagctactcaggaggctgaggcagatgaattgcctgaacctgggaggcggaggatgcagtcagccgagatcctgccattgcactccagcctgggcaacgagagcgaaactctgtctcaaaaaaaaaaaaaaaaaaagttgttaccctctgtgaaagacactgtgaagctttgatggtattttaaagacactagattatattagagagtcatgaaaattagcacagaccctgaaaaaaatctttattgttctaaaacagtggttctcaaatgcctcggaatcccctgggggactctgtggagcacagattgctggacctcactctaaaatttctgattcaccacgtctaggaggggacctgataatttgcatttctaacaagttcccgggagttgctcctgctgtttctgctccggggactacagattgagggtcactgcattaaaagaaacccaagttaatttaatacaagtattgcatttattaggtcggtgcaaaagtcatcgcggttttggccattgagtaatggccaaaaccgcgatgacttttgcaccaaccttaacgacttggcatttttattttattctcaacccaattgctcagccagtcactgcaagggtgtggcacttcagatagcacattatataatcagtggtttgctggtaaatgcttgacaattggctttagggttgaggagcagccttgatttgcagtgttgccagtttctgtgatataaacagtctcatcgtagccaattaaaagctgtcaatctgacattggcttgtaaaattcctgaaaatttaacagttatcttcagtacaccactgagtcataaggaggcgttaaaggtcaggttgaaatttaatctcaggttgaatggacccttactatctctttaaggggcaggtatggagggagatgaaaaataagcccttgtttacttctcggggataggacagagatgtgtgtcttcaaggggaaggagacactatagttcaaaagtcaaagcctggctgctcacagagggttttattggctcaaaagccttttaactttaaattagtcactgactttaagtaagatttttcccttgaaaaaaatatttgaatttttttttttttgagatggaacctcactctgtcaccccagctagagtacaatgactcgatctcagctcactgcaacctccgccttgcaggttcaagcaattcccctgcttcagcctccctagtggctgggattacaggtgcgggccaccacgcctggctaatttttgtagttgtagtagagacggggtttcgctgtgttggccaggctggtctcaaacaaactcctgacctctggtgatccgcccacctcggcctcctaaagtgctgagattacaggtgtgagtcaccttgccggccaaaatattaggatttgtatattttattgaatggaaaatcagaaattgcagcaactccggcccagattcttactcaatggcacttagctggagccgaggagcagctgttccccccacaccccatctgtactttgtttagactggacaggctgtttctagaccatccactcccaggctctcaactagggtacacatgggacctgcttcatcattgatactcatgccttcaagaatttgtatgctccttcttagatgcatgtttcagaagggggaagggaagaatttgatcaccttaaaaggacctttagaaacgtaagagtgaaagtgaaccaagtatccctttttgtttcttcttcagtgttttcactcctcctcctctttcctttggaaggggaaaagcaggaaagaggaattacattttctagaaacagaagccaagacctcaagaagcctctaactggccaggcacggtggttcatgcctgtaatcccagcactttgggaggctgaggcgggtagatcatttgaggtcagtagttcgagaccagcctgaccaacatggtgaaaccccatctctactaagtacaaaaaaattagctgggcgtggtggcacatccctgtaatcccagctattcgggaggctaagccaggagaatcacttgaacccaggaggtggtggttgcagtgagctgagattgtgccactggactccagcctgggcaacagagtgaaactccatttaaaaaacaaacaaacaaaaaaaaccctctaatttctctttctaaactgtagacctggtatctagatgagtttattcctgataaaagcatacatgctcctaggaggtttaattactatttatatggtgtacgcacttttcttttcagaatactgttatttatttgtcacttcagtgtttcttttcccattgctcttctctcagcctcttgtgtcagccctgcccaggctggcttttatatccttagcctttttttttttttctaagtatgggaaaacatagtttagaagtaatcccttctcacaaaatcacctctctcaaccactctgtggttattttatttgagggtggtggaaagagggagatgtttgtagagcctcagagagaaaagcacggttttaaatctaatcattatcagagtgagagctaaatacttttgcaaccttcatgagagatatccctgggaattttctggataaatatcattctcaagttttggcagtgtgcagaatttaggccacccacattgtatggggcataaaactgtttagtgaagttcaaataatgtgttgcaagagtttggttgaacttgtaatttaaccttgaggaaagcaaatacttgtgggaaaatatttgtgctcaaaatcaataaggaatgtgcaagtaggatgccctcactctgagagctgtagtttgcagctgaagctagtacaaagtggcatttgtcagtagtaagtaaaacgagcaaagtggatgggtggcaagactttgacattattggcctatcacattcagatcaagttcatctgcagatgaatagtcactaagatttgttaagtgtttactttgtgccacatagtacaacacagaactttagcactataagaccctgacctgtgagatggggaaattgactcttggagaagttagttactttgtggtggtctcatagctcaaagggggctataatttagtctcagatctacctgacctcacatttcagataacttattatctgtgcatgccatggcccttaaaagaggattacttgtaactttttatttattaatttatttaataaagagatgaggtctcactgtcacccaggctggagtgcggtagcatggtgcctcattgcagccttgaactcctgggctcaagtgattctcccacctcagcctcccaattagctaggactacaggtgcacaccgctatgtctggctatttttattttttgtagagactgggtcttactatgttgcacatgctggtcttgaactcctggcttcaagcgatcctcccgccacggcctcccaaagtgctgggattacaagcatgagcctggcacattattttttatattcatcaatgttgaatctacaaatgtatctctgtacaactgtcttattttaaactcctaatctaggtacatgtagtcctttgtatattgcctagaacatactgcctaactagacaatcatatattttgattttaatgtatattgatatatatttatggtgaatatatcttacagtattattcattgctttatggctaatttatttattttttttctttgagatggaatttcgctcttgttgctcaggctggagtgcaatggcgcgatcttggctcagtgcagcttctgcctcccaggttcaagcgattctcctacctcagccttccgagtagctgggattataggcatgcaccaccacacccggctaattttgtatttttagtagagacggggttgttggtcaggctggtctctaactcctgacatcaggtgctccttccgcctcagcctcccaaagtgctgggattacaggcatgagccaccacgcccggctggcttactttttttttattttattttttcctttttataattgactcatttgtcaactactcatatataaatataatatatatgttagtcatatgtatataatttatatacactagtgtcatatgtatatctatatatgtatatcttatttcatttggaaaaattagaaactaccaggctatcagacacccacctaaataaaacaggaagattcttatattctataaaaaacacagcatctggtgaatggaacatgttggaatttctatcaagaattcttttatgcatcaattttctagaggtatctggtgtttttccaattaacctggaaatatgttttggaaagaatttatttttcctagaggccagatgcgtccttgccctttccccaacatggcccttggccaccagtggagtgttgggagctctgggaagagagcggctgccgcagacgtccaggcatgggcactttcgccatctgtcccgtgttgtaggttttcattgctttagttgttatcctcaacacaagggcctttaggggctgggaccacaactctgcctcctattctcccattacagctgcataattagttgtaaaacttttacttgtaggtgaaaactcattttggcaaccattaattcccactgtaattcatttagtaactgcagtacttctattaatgggaaagtaaggtcaagcatcaagcagcatgactaatatgtgttgataattgcatattgttgataactgtaaactctgagattgcactaataaaaggtaataattcccaaggcaaccaggaagggaactggggagcggctgcaaatttagcctttgccattttgccagttgtttagcgtcatttacgttggtgggaattctagtgctcataatgcactggaagatttttttctggactacgtaagagtaattggagattgataatgtgtcgatatgggggcatgggaagtgactgatgctggggcagatggtttctctagacaattgctaagagggtgtgcaagaaagttgcagcttagcacaagcttgtgtggtcaaaaagtaatctgcttgctctttggacccacattttatgtaagctgatactgagagcaagcacttgtagagagagggaggtgtgaagatagtccaaagacttgagctagagtctggctctgccatttaggggaatgcccttgagccagatctgttaaattcattgagcctcagtttcttccacccttgtagaatgtagttattcttgtaaagctgttgatagcattaaatgcgattgtgtgtgtgtgtgtgtgtgtgtgtgtgtgtgtgtgtgtgtgaaagaaactgatttggaaactcgaaaacccctctataaacaggaacctggaagtctgtttgtcctttcttaattttctgatgatacaaatagatatatcattgtaaaactattctgtgtacttgagtttctttcaaaacactaaccctgagtagtgcttgcaatttctctaaaaagtaaattatcacagaaagtcagtttatgacccattttctggggctagaactacctttctttttggggatggggtctcactgtgttgcccaggctgggctcaaactcctaggctcaggcaatcctcctgcctcaggctccaaagtaactgagactacaggcacatgccactgagcccagctggaagtaccatttttggtaactcagattcctatagctgtgcatggggtcattaccttggacaatctgatgcctgagaagactctgttttgtgtttccaaatggaccatcttatggaccatctttgcttggaaaaggcactgtccagaatgtgtggctaatggattgttgaaggagctggacatggcccaggcagtccggtgaatcagtgactgatggttgtttgtagtagctaatgctgttccctccccccaaagataaaagaaccaaaaaaccatcaagtggcttgatttgactatagcagcatttgtgacagaactgggaaccaaatgaaaatcaacttagtactactcttcaagagattttttttttctccagaggcttagcgtaggtcataccccagatgttgatgatgaatatattgattgctatctcagggcgaaatctcaaaagtttgtgttgcccttttaggaatttcacagtttatattgacctataaccaagaggcaggttcattatgtttaattgcattaaaagataaaagaagtagagaaattgaaaggaaaaagagcccagagattgttacctttttatcaagcaacagcatgccacaaactttgcataaataaaaaataataacctgagcctttcatcttgggaatctaatgaaataaatgtgtgctgttttccccattagccctcaccttagccagcccttacattgtggacagaggagtgatgtcattatttgtgagctagatgactggctcagtaggtgccgtgtggttcctaagaagattgtaggtcttgccattgcgtcttgtgtctcttgctgtacaggtggaaacatctgtgtgttttcattatggtgaccgctgggtaactggtcgccaacctctgtaactgaagaaacagccctcacaatagagtacactcttttcccatccagagtgtggcagtccttttctgcgtgagcctttgtctgcatttttacctcttgcaaaccctcctccagccagagattgatatgcctggatgatttatggcagtgattgtcagaaacttttgaagcccatccaatttcaggattcgggttctcatttcttgtcatttatggcacatttgatgaattctcactatcagctgacatgtttcataattgtcaaaactttgattgaagtggtatttttgaaaaaaaaaattatggaagagaaaaaaaggaaacaagactccttcatcacatttttttctcctgtgcctaaaaccgctttgccggaggttcacagccccatcatttagcctctcagctacttgctggcctggcaagtcagtctcctcactctccttttacagtcttgtgcctgcatttactggggcttttcttttgcttgtttgggccttttttagtccagatgataaaagctttcgaaagtagccctttggagaaagtttctaagctttcccttcagctgtctttcaaggtatatccggtggggcatgaatagataataatagcaagctcttctctcattttgttatcttgacctagtgcggtttgttttgtttttgtttttattccatgagccaacattctttggctggaatgttggctctccaggtctttggctgaggtcaaaacttagaagtctgctcctgtactttggagttctcctcctcatggtgaagcccacagcggtgagccaggagtggatctggttccttcatctgtagagttttgtttttgtttctttacctaccttagtcctgtgtctctttctaggtcagagaaaacttcttatagcaaatgactcctgtcccttcccactctgacccccagtacagtgacagggaattcctgcttctcctagcttgtcctttctcagtttctttcctcagaagcaaccactatctgcagtgccttttgtctctttctagatatacttcatgcatagataaggattcatacatacacgtacatagaaacacacatataaacacagacatgcgaatatcaagatatagtttgaaatcataattctgaactttcactctagtgtttaaaacacatcaatatttaatatctcactgctgctagttggatgaaagatgaccattttatcatgctctacaaggatcatgcctcctgtgatctgatttccctccaactctccagcctcatccagcacttttctcctctttctcagacctctaggcccacttcctgttcttctgttaattcctcaaacaagccttcccttgtttcttatattagctgtcactctgttacattctgtagtttcttgactgttcatttagggcatttagcacagtttgtaagttccatatttgtgtgattatttaaatagcatctttctgcctctactgaactgcaagttccaagaagacagaaatgaagctgtttttttttttcttttttttaaagctgttttatccctagagtctgtgcattacctggaatataataggatctccgtagatcatagttgaatgaatgaaaaacaaatggctggctggctggatgaatgaatgtatgatgtagaaacttcctttgggtagggaggaaatgctaccttttggaaaacagttgtgttttagtatccaaacacatgttttctctgtagaccttaggtattttctttttgttgtttctaaccattttctaagaagtcagttattctagaaaggctgatcataggcaccgtcaaggaaaatcttggcagttattaagggtattagcttacagggtttacattttctcaccttccttgatctcttttgtttctaccgtggtttattttttgaaacataagtagtccctgtttttcttctaagatttctcccacattttcatggcttaatggggcatccaggagataataagtggtggatgggagatagggggaaggagaaagtgagcaatgtccactctagacttacagtcctctgaaggcaagattagggtcccacatctttgtattcccagcatgtggcacaaggtaggaacttcacatgcagtgtggagccacaatgtgagggtgaacaaatatgcaggaagaaaggaagaaatggcattgctaattctggaactggcattatcgttaatgagcggctctgtatctgtgctcaagtcttgcttctaataagctgctggggatatgtattacctgctgttgcagctgctatttctttcaaatttactattgctttttccctttttagtttcttcatctacctctttagtgttaatctttgtgtctaaaaaaagaaaacatagagtttggagcaaggacagaaagattaatttctacgtacagctctgcatctggacgtggtcctcatttatttttgaaggctgagggtttagtttatgatgactacattttcctagtagcctgagagcctgctaggaaggctgtcagtttatatttctattggtccacttcttgcacttaaaatggctcagagagtgaagccattcctattttaaagctccccttctgctgacagctttcttcttagccaaagccaggaagaagtatttgctattacccattgttttagatgtgctaacaccatgctaattgccaatagtcaggaatggtctttcttaataacaattcctgagttatttataattaacccattgtttatatcctagtaatgttattgtatttgaagtgattgaaaatagcttaatctgtcttaagtgaataatttctccttgtttaccttattcccagcaaacttcctttttcctgataatacaaaagtaaactttattctatttcatcctaagtgatgaaactattttgcccatttatgaaacattttgaatacttacaattggttattttccaggaaatattgggaccttgccttgaaatttagtatggtttatgacttggtttatgacaccagacagaagctacagatatgaatcctctaaccacctgttcctattttcctacccttcattaatttgacttttgacttttgataaagttatcacatattaaaatatacgtgggtgctaagccttatactgtgaatgttccagggttcaaatattttatttttactgccttccccaggcattacctccataaatgatagaacatactttctttttgtcatgagaagtaattggttgtttcttttaacctgtctcgttgcattccagaaaaataataaatctttaaaattattaaaataatgagcaacagttatagacattgttgggttaaccttgggagtccaaagctgatcctaagaggaattaataatatatcttttttttttttgggccaggcgtggtggctcatgcctgtaatcccagcactttgggagtccgaggcaggtggatcacctgaggtcaggagttcgagaccagcctgaccaacatggtgaaaccctgtttctactaaaaatacaaaaattagctgggcgtggtggcatgcgcctataatcccagctactcagggggctgaggcaggagaatcgcttgaacctgggaggtggaggttgcagtgagccgagatcgtgccactgcactccagcctgggtgacagagcaagactccatctcaaaaaaaaaaaaaaaaaaaaaaaaaaaaagaatatatatgcgcccggccaagtatatctttttttaatatattgcctccccctgcattaatttttttcttgctttcccagttatatatgcatatatataaacttcacagataccaaataggttattgctcataggtaatataatttgtacctgatgtaaaggctgcaactgaggtttcactgatggttggtttacctggaattttgtgagttggaaggcttactgaaatgaaggaaaatgcttatgtatgacccagctctctctctacgcattgaccaaaataggttgatcagggcaacagaaatgattaataggatagtgcagatttggataaagagcaaaaagattaggatttgaaagttggaggatgaagggagtcatgtaggatatagtcaggtggaattcggacttgctcacaaaatcccagaatactgtaacaaaagggcacttctttatgctagaaggagataatttcactttaaataaagggaaatggaatgtctttgcccagaggataacaagcaaatagaactcattttcccgaagaacctgtgtagtctggggtgtcagggatgtgtgttcaagaaaaatttaggcaaaacccaatgatagcttctcaagggtaagtttcaaacattcagacaatatccctaacccttgagtgaaccatcacacagggaaacgattctgttgtacagaatatgttttgatgccactgtcagacataaagtctggtgggaactggacttctactctgacccagggtgacaatttttatgtttttaaaatcggccgtcttccagaagtgttcattttacagtgcttatatctcagtacctgaacttctgcagaagagttttatttgagtcataaatttctaatgtcaaaacctccctgacaattattagccaaatgtttagcccaaaagagagattaaaaacatatatcttgtaacctagctacccaatgagttaacccagagagaattttcatgttggaagtagtttcataagactttggggagagatacctgcagatctgacatattagtggtcagaacaaaaacctttgtaatacatgatcaactgtctgccatatgaaaagcgtattcatagaagcaactcaaagtgcacagttaggcagtccttaccaattaaagcctccctcttttaaaaattttttaaataagagttcatatttgcacaataaatgatttattgagaaattttaatgtgtaagcttcccactgactctaactgaaattagaaagctttgaaatgaactcataaatattgttcttacatacaaaatacactggaagctgtaaaatgtaaagcagtttatcattgaaaagctaagctacattaaagaatgtagatttggtttaactctatcttccccacgtgatgccgaagaatttgcgaagtactttttatgtgttttgttttatttgatctgtgtaactacccattaaagttagaaggagggtgggtattactgtcttggttttatagccaaggttgctatggtcaaagaaggctaagtgacttgctggaaggtcactgatacagcagagtgagggctgaagaacacacatactctgtgactctgagatctcctctccttcatccgtgctaacccataatgtaatactattcgatcaggcacagtcctgaaataacctcagagtgcttaatgctgaagggcatattctgtgttttaatcaaagaagactatgacagcaagaattagctgcaccagcccctttgtcaaatgttggttagctgaatatttgaaaaagctcaatatttgtgtctttgatcagataatgcactaaacattgatttatagaggattatcatagcatctataacgtgttttaaataacacaattaaaatagttatgattttacataataggacaagatcgtaatgtagtgcaaccactgaaagtgaaggtatgtaaagaccagagtcttttccctagactactagaattagtagttccttctaattctagcaaggctgaaaacttgtaaatagactctttagtagtgttagagtgaactgtttacattttatgtgtctgtaggaactgaggccagatgggtcgattgcatcctctagtaatttccaaatgaagttttattaaaatcctttccagacaagcatttttataagaatgactaataaaaccccaaacacaaattttaggttctcttattttataaaaacatgcaagttgcttctgaagttattggaagaccagtaaaataataaatcagtaaagatggaagaagagcagagactttgagcaaccccaaaataaccaggggtgagcaacattgctgggcatcttttgcacattgaactgctcagggctctgaaacatgagactatgaaagaagcattcctcatgcaatgggtttattgcttggttatttcaccaagcaccatttattgaaaggcagtgttcctggtggctaagagggcagagtctggaatctgccaccaccacttaccaagtgggtaactttggtcagagttatttaagttttgtctcagttcctccaacaataaaaaggggatgttgacaatacttaatacatagcgagtgcttaaaattgtgtgtgacacacagaaaacttcattctgttcaggtcaccctgtgagcattgttgggtatggtgggaaaagaaagacactaagatcttagagatgacttcaaggttccttttctggtccaagacgatgtacgatgaatagtcacaggaaatgactcttttctgcgatagaatctggacccaccatttaccttgtggttctgctcactgtttagtgctgagttgctaattttaatgattcttcctgttttaagaagcatggctctgagtcgtattctctctctctgcctgtctttctctctgtccacaaacacacactttttgagtacaacagcacagaagacgatttagagatacatgtgctcaagacttacctctctctgtataaaagtttgaatctcaattactcccatttcctctttctttctttctttctttctttctttctttctttcaatcgtactgctatgtcttactgcttcctaagtgaaaggggaaaagaatcaaagttagggaaatcaaaggtttcagaaatgaaaaactggatttctaaagcactcacattgtaccaacttattttgtgcctgttcctttaagtttttttttttctttttttcctctgcctctagagctaccaaaagcacactgatcagtttttacagctttgccatgataggtgcagtagttgcttttttattgaaccgtagattgcagcattataaaacacactcattcagaggagtaatgaaggccatttttaattgcatttgggaagcagggtactattattaaattatacctatgtctgtattggaaaaaagagagagaaaaccaggttgtgttttctttgggatttgaggtttcccagagctggagtgaattcagggttgcgtgacaaaatttggaacttcagccttttgggattgtgagtcagaatttccccagtcctgtgattaacctcatgcacccacaactgttgtaaatcaaacatccaagggcttagtaataacgaaatttattatttcctggaagataactctcaatgtatgtgcgtatacaagtaagacagagtggcacacacagatttttacttaaagattgttgttatacactgtattagtttcctaggtctgctgtaacaaagtctataaacttggtggattaaataacccaaacctcacagttctggaggccagaagtcaagatcaaggtgttgccagggctgttttccttccgtgggctgttagagggagtctgttccatatctcttgcctagcttctggggattttctggcaatctttggtgtttctggctttatagaaacatcatcctgatccctgctttcatcttcacctgttttttcccgtgtgtatgtgcatacatgtgtgtgtgtttttccaatttttccccttcctataaggacaccattcatattggcttaggcacccaccctactctggtatgacctcattctaacttaactaattacatctgcaatgaccctatttccaaataaggacatatttggaggtacttggaggctgggtcttcaacttatgaattttgcagaggacacagctcaactagtaacatacacctatagatctgtctttagtggatatgtatatatcacactgttctatacattggagaagggtgaaaattaattgtaagaaaaaattgcttgtgcaatgaatagcactataatccccttcttgacagttaagggaatcattctggaaagcgaaattgctctgagccaatgtgtggaaaattctgtgcaagagctcattccttttgttgcattttttcaaagattcttttggcagtgctgggctcggtccagatgccttccacatcaggtggtttaagcatgtgtgtacatgatcgtgtgcagggttgtgggaagccaattacggttggaaacagttgtttagctggcaattagattcctcacagtctcgaattatgttgctttaaattaagattatgcagatttgagttgctttgataatttgcaaaagccattttggggttataactaaaaatgtaatctgccaattaggagattttctacctgatatctgttttgttcattggactgtggacccattttaaatatttatcatctgctttctaaaccaatggcaagagtgtctgcataccagtgtggtgaggggagatacagtggtggaggggagatacagtggtgaggggagataagtccctgaatcagacttagctttcttgaggactcagtgctgactttgttactgtttactttagcaactcaggtaaaaacatgcgtcaaataactcttttgtttcatataaaacctgaggttttgcaagagacaaaacctcttaaaagtgagatttgttgtttaaataagaaatagtgttctattattaacccaggccagctgagacaagctttttaattagcctaaaaagagaggataatgtataaggagaatgaggtaggttttacttagtaatgtcttggagatttaaaaacttatcctatggtgatcagattcagattcaagcagactaacggatagcagtattttccgttcaagatgatggacatcttatctttataaatgattataccggtccgtctgggagaacaagatgctaaatgttacatattccttccttctttcattggaagttcattggaaattttatacacgtaccatgcatacagagaagttcgtgcatcacaaagattcaactcgataatttttcacaaagtgaacacgtctataaccagcaccaagatcaagaaatcgaatgtcaccagaactccagaggctgcttgtgtctgttccagtcactgactcagaattttgtgatggcatggaaagcttggcttgttgtctgccggcagtgagtattgatgattttgggaacacgtttccattcacagtgccttttcagttgtaggttagtttttactgggagcagtttcatgcttcttgttcattctgctagagactggggttagctccttagagttaagccttttggtgagcataatgcagagcagaagatggcctttactgcagccgggacaaagtcttccaggtgctgcctgccttcctctcttcccaccagactaaattctttgtggttccttgaaacaaaggtggccttcccctttacctccaggtcttggtcctgtggctttcctacgtcaggatcccatgccctctggccccgtcctactgcattcatttcccaaggctgctgtaacaaagtaccacaaacggagtggctttatttattcatttatttatttttgagacagagtctctctcagtcacccaggctggagtacggtggcgtgatcttggctcactgcaacctctgcctcccaggttcaagagattctcatgcctctcccacccaagtagctgggattacaggtgtgcaccaccatgcctggctaattttttttatttttggtagagatggtgtttctccatgttggccaggctggtctcaaactcctggcctctagtgatctgcccacctcggcttcccaaagtgctgggattataggcgtgagccaccacgccccgcctggagtggctttaaacaacaaaaatctattctctcacagatgcgaagtctagaagtccagaatcaaggtgttagcagagtcctgctcccttggaagcctataggtttccttccttgcctctggtagcttctggtagccccaggcattccttggtttgtggcacagcctaactccagtccctgctgccaccttcacttggccatcttccctctgtgtctgtgcatctctctctgtcttcacatggcattctcttctttgtgtctctttcctttttttataaggacagcagtcaactggattaagggccctccccactccaggctggggtgacagctgcaacaactgctttttcaaataaagtcatatgctgaggtgctggggtttaggaatttggcatatctttttgggagacacagttcacccataacatctgcattacccccttcttagtttagatgccgtcttttctaggaactcttctgccgtgttccttcccccaacatctggctttgatgtccctcttgacactggaactctcttgtcatgctttctagcatctctcataattgtttttttgtttttcttctctgccggactctgagcaatttgatgtcaggaataatttagggtattttagaattttttttccaaattattagaaactttagatcgtggaattttggatacatttatgcattttgatgtaacctgaaatatttgtaaccgagtcatggtcttcatgttcattttgcggggaagaagtgatacctattggtaaaagaaaaggcttgggttaaacattaccccctctctcgagtttctgtgatcatgacaaacatggattctaaatccttggcttgagagcacatgaattgccgagcagatgtggcgtcagcgcttgcaaggctgtaagcagcttactgatccagcagtttaaagactgtttactggcagtggcaacattacttctggttgcctgtcttaattcattttagattaatctgtcttgcagttcgaaggaaaatgaattgagtcagtaacttcaagagttatgtaaaatctgtacagtgctaaataattgaatggggttttatgtatggtctttaaattggaatgtcaatttgacacaaatgctccaaaacagagtgttagatgagctgatctgttcctcatataaaagctttgaaaattccattcttgtatcactctggaattcaccgttcccatcccttgcagaatattaatgttaactttggggaaggtgagtctgcttgtgtaactcttgggcctggggttgaggttttagggtaatggtacccaaacttgaacgggtttaagaaccacacgaggagtttgttaggaaggatgcttggctgggcatggtggctcctacctataatcccagcactttcggggctgaggcgaggggatcacttgagcccaggcatttaagaccagcctgggcaacatagcaagactccatctctatttaaatttaaaataaattaaaaagaaaaaagaagaaggatgctttctgggtccagctccagaaattctaatttggttgttctgtaactgggctcagggaagtcctttggcattacaggtggttctaatgctgacattctcagaccacattttaaagaaataactggttgaagggatgcacggacatgagaaggagagtatgtgaactcctgagagaaaattcaagactattttgcataaaatacatttatcacaaccaggcagaccaaaaatgacctttttgggtgggataaaggggatattttgcagacccaaagaaaataaattcttgagattttttcccagaaatccatgggaggaaggctgaagtatccttattcttatcagaaaacatatttgaattttattaccaatatctttaaccccattttgtagatgggaaatctttgaggctcaaagagcaaagaaggctaacatttgttgagcacttaataaatgaaactgtcaatattagtaattattatcgccatcatcattatctttatttaacctatagcacagccctgtgaggtgttatcactgccatttacagatatgtaaagcaagattcaggcagttcagataactagctaggattacacattgagcttgtagtgagccaggattcaatcgcagttcaacttaactccaaaatccatattctttttactgcatcaaggtagatttaagatctttacatgacaagagttgccaggtaaaatgtaggaggcccagttaaatttgattgtcatataaataatgactagtataagtatatcccatgaaatatttgaacatacttacatttaaaaatagtggaccatagtatactagaaaattcgttgtttatctgacatacaaggttaaccaggtatcctgtattttcatttgctaaaatcaagcaaccctgtatgtgggtagtgggttttcagattgtatgatcgtactttctgacttctgactccaagtccatccatcctttctatgtgccacattctgttctgtctcattcttgggtctctgctgtcctcttggggaagagagtgaatggcttacctactctagcccctgtactaaggggcccagtggctcatgcctgtaatcctagcactttgggaggccgaggcgggtggatcatctgaggtcaggagtttgagaccagcctggccaacatggtaaaaccccgtctctactaaaaatacaaaaattagttgggcgcagtgacgggctcctgtaatctcagctacttgggaggctgaggcaggagaattgctcaaacctagaaaatgaagattgcagtgagctaagattgcgccactgcactccagcctggtgacagagtgagactctgtctcaacaacagcaacaacaacaacaacaaagtagccaggtgtggtggcccatgcttgtaatcccagctactagagaggatgaggtgggaggatcgcctgagcctgggatgttgaggtgcagtgagctgtgattgtgccactgtactccagcctgggcaacagagagagattctgtctcaaagaaaaaaaaaacatcagtgaacacatagaagtagttcaccttttcttcacccacattatgcatgttttcatttgcttaattttagagacgaaggagtgagagccagttagttgccttactaacgatagaaagaatcaggccaccattctgctacaacaaatttaggaaaaggcttttattttgggtatgattacagtcagagcaataagggtgagttagaaaatggaacaacagaacctcctggggtcttttttgtgagaaaaataataatgttttggttaatgttagattgaatgtccattatgtgccaggcaatttacatgcatcattgttgcaggctgccctgagaggtagttatttttatcagccccattttaaagatgtggaaactgatagagatgtgatgtgcacagccccaggtcaaacagcagtgagacgcagagctggaatttcagccaggtgtctccaccctggaggcctgttcttagtgcactgtgctgccaaggctaaagccttttatctgggcctggtctctgtcctagagactgccttgtcgggtggccttgtggaaatctgctctttggcttggggaggcagacactgcaccagcagcttgttccatctagccttaggaagcttcaccttcccggacaaaaagggtcaatccaaaagtggcttttgacacctgtgccaaactaggaagccgcagtggcttcttcgggaattaggccttagccccgtggaagaaactctgtcctgtgtggtcttctgtgtgcagtggaaactttcagcaaggcttctaaattcttgatgatcacaggatcgctttgcaccgaaaactggcatctggcctgcgcttcattgagggttccctacttttggcgagagcttttgaaggcctgggtctgtgagttttcctttattagtaaatgataacaaagcactttaaagaaaggagacacgtccgtggtggtagttcttgctgtgtgaagaaagggagcactggatctgagaacaaacctctcccaagttggtccctggggctcctcctgctgctgctgctgggagccccttccttgcaccagtggtcggctgcttcccatgttctctcgcgctctctgtaggactctgcctgcgatgactgtcctcccttcctgagccatttataaaaacagactgtttccatttctaagtgactaaagggattccttgaagtagtgagatcaaagatgcgtttggaatttgtctctgagtgaatactaacggcttgtcatggagacatgtcacaggggagcccgatcttgggaaaaccaaatgaaagccttaggagccagagagcgatcagggtggggagtgacagatgcagggaattttggatcagacaaaccagaaatgatcactttccacatatgcgactttgggtgagttgtgtttgtatctgtgaacctcagttttcctaatctgaaatagcattagtcatgccgacctcagagagtcctagaaattaagtgactattatgtataaaatgccaggcatggtgactcagatccagtatttactcgatactttttcccctcttcataccctaatatggtaatggaaaatggattttgatggattttgtaggcacattttaaaattaaaagctattgcagaattccagctagtcattcactggtgttcataaggttagtgggtgcctactacgttccaggctcactttaagtggctggggaatggagtattatgagacagacacgagtcctgcctctttgtagcttccattctggaccgggaagtcggtaacagacaaagcagcagagggagtacacttttaatgtcaggcagggaaaagagatatgagaggatttggctgtggtagtctgtgagggcctctttgaggaggtgtcgtttgcatataacactttctcatggtgaagtggctgctatgctatgctgacaaatagccatagctgaccagatgagtccttcccacattgcaaacaggttttcatgtgcacatcttgatggctctcccatttccttacccctcttctttcctgcaagctcctgttgtcctctcagtgtcatattactgaacagagttgaattacccacagaaagctttcattaatcttgctgtcccattggggtgttactgtaaaccttggcacccagagcgtctgccacggaagtggcttctagcaaggggagaaggtgaagcctgagatggggtagagtgaggaagagtgagatgtgagccaagagagtccttaaacatttcatgaggttccacagagcctgcgatcacactcttgcggccgtgccgttgccagtgagaattgatgccttcagcccagggtactgggagcctcccagcaaggtgatgtgccacgtaaacatgctcctaaaggacctgaatgctaatatccataggaactgctctgcagcttcttttaattagctgagatggattttgggaggtcagcgtaacacattcaagtgaaatttatgttggttttctttgtaaactgttgcagttggaattcttcccagtgagtggtcaaagtgctcttttttgcttgttttgatgagatttgggtagaggtgaaatagaggtggggggtgaaagtaggccaaaaaatttgaaaatatacttttttttttttttttttttgagacggagtctccctctgtcgctcaggctggagtgcagtggcgcaatctcagctcactgcaagctccgtctcccgggatcactccattctcctgcctcagcctcccgagtagctgggactacaggtgcccgccaccacgcccggctaattttttgtatttttagtagagatggggtttcactgtgttagccaggatggtctcgagctcctgacctcgtgatccgcccgcctctgcctcccaaagtgtgaaaatatacttatatcctgccaactctaagtcctaacatccatcttgcaataggcaaatgaagacactgatggacaaaggttattcttactttttatctgagctcagggatttggttttattagctctttagcctacctgttagctcttagccacttcttagaacccaattccctcagcagttgaagacctccttgttttgcactaaatacgcatttggtccaggtgagtatagactagcggttcccaacctttttggcaccaggaaccggtttcgtggaagacaattttttcacggaccaggagggtggtgtggggatggtttcaggatgaaactgttccacctgagatcatcaggcagtagttagactctcataaggagcgtgcaacccagatccctcacgtgcacagttcacaatagggttcactctcctatgagattctaatgccaccagtgatctgacaggaggcagagctcaggtggtaatcctcgcttgcctgtcactcgcttcctgctttgcagcccggttcctaacaggccacggactagggtcggtctgctgcccaagggttggggccccctgctgcagacccagtgttggtatatgcaaatattgcttgcccttttggagtctggaaatgttggccactgtctggtcattcacttgctttgactcaccctttctccacgtccttttctcaactttccctctgtggattagagccacaaatctatgccctcattttccagtcctgaaaatggagacatgtgacctggcatagtttttgttgtttcttccaggactgaagtaatctgggaaatgtagtttggctgccaagaatttggcctttcctagacacattgctggttgattagaacaacagaggagaatgttagtctgggaggcgtgctcacattcccagtgtagctcaggggaccctttcaccagataggactcacagacttctcaagtccctattgcgatgtggcttctgggacaccttcaacctctgtccctggtaagccaatggctgcttcatttcccatgttggtttcccccaattttctgggacctccacattaatacctactttcccgtttccttttaaatctcctggcagttctactgcttggaatgcattctacagatatacttgcgtagataagagatgacccatttcataatagcaatcacatctaacacttgctgaggatttacctggtttctggaactaagaattttacatatttttcatgtatttcattctttaaaaaactctgtgaggtgggactgatagtatcttcattttcagataaggcaatttaagcaggaagaaagtaaaatgtaaccaaaggtgtatttttttttaattgcagctgtggttttaataagaaaagattagaaacaatgtaatcaatgtgtgtctaattaaatacataatgctttattgccaataccataggatactgtgcagccacagaaaaatggtattgaatatcttcatataatagcgtggaaatccctccataatacatgaagtgaaaacaagtaagtctgtatataaaatgcaggctgggcatggtagctcaggcctgtaatcccagcacttttggaggctgaggcgggtggatcacctagttcgagaccagcctggccaacctgctgaaaccctgtctttactaaaaatacaaaaagttagccaggcatggtggtgggcgtctataatcccagctacttggaaggctgaggcaggagaatcgcttgaaccagggaggtggaggttgcagggagctaagatcacctcactgcactccagcctgggcaacaagagcaaaactctgtctcaaataaaaaaacaaaaaaaagtataatatgcataaattagctcaaccattgtggaagacagtgtggccatcatcttcagcaaactaacacagtaagagcaaaccaaacactgcatgttctcactcacaagtgggagctgagcaatgagaacacatggacacagggaggggaacgtcacacatccctgggcctgtcgggggttgggaggtgaagggagggagagcatcagatttttattattagttaatttgttttggtcgtcatgactagacagtaattcacatggtttaaaacaagtatcaaaatatagtgaaaacagtctcccttccacctgcgtgcctcctctgccagcactgcccctctccaccatagatactcactatcattagtcccttgggtaatgttctagaaattatagggcaaaattgtcctctgtcaaaccccttacacaactgaagcatattacactttagtttattcatttttttctttctctcttccagctctgtgtcatctccctgttcctttcttatcttcccaaacaagatttctctcatctggtgatgcgaatgaaactacagtcttgtagttacctgggcttgaagctctagaatcatgttagacctatcttcttcgtcttttgtatttaatttaattttactttaagttcctggatgcatgtgtggaacacgcaggtttgttacctaggtaaatgtgtgccgtggtggttttgctgcacctgtcaatatatcacctaggtatgaagccccacatgcactaactgtttgttctgatgcattttccttgaaaggaggcctctagttttcaccaagttatcaaaaatattcaagatccccttaggttgcttaggatggtggtaactgttccttgttaccttagaaaggatgcagatattcttatgtaacctgtctgtaggcatgttctctagggccatcaaatgctttttttgttttttttttgagatggtgtctcgctgtgtcccccaggttggagtgcagtggcgcgatctcagctcactgcaagctccgcctcctgggttcacgccgttctcctgcctcagcctcccgagtagctgggactacaggcgcccgccaacacgcccagctaattttttgtatttttagtagaaacggggtttcaccgtgttagccaagatggtctcgatctcctgacctcgtgatccgcctgtctcggcctcccaaagtgctgggattacaggcgtgagccaccgcgcccggccagccatcaaatgcttttaaaaaattgaattaattgccaactctaacaactgaaggatttcacatagaaatgtggattcagtgcttaggtaggaaaatggaagatttggcagccctacgcttgcatttctacatggccacggtcctccagagctaggtagaggatgcctctttcatggagagagtgttctcttttttgcctcaggccactcttacaacctgttgtagtctaaatgacactggcttggcttgagaagaagtgggtcctagtctcttttcttcctaaagcaactctttaaaaatgtgaatattttttcagatgataaaaatgagattcagacagtttagatggaatcagcctcagttgttcactgaagtgggttaggataatgtgaaacttgaactcagatcatctaactttattctaatattctttccactgaaccacagttgtcccccattattgttacgatttttgaccttcaaggcattcctagagataggtagagtattataggcatttcacagatgagtaagttgaaacttggttcagctctgaaaaaggaaagttacgttctaaaagggcagagctcatatttggtctcaggttttttgactcaaacactatactcctttagtggtactcaaaaacctcagagatccatataattctgacattttttacagcagtgatattaatgattctaacatatttgactccaaacagaagcaggaaaggtggagggacccccattgttgatgttgtctcagaactggaagaaagttcctgcggtcagtcagagaataagttatagtagactcactccttgcaaagcactgactggtctgggaccatgggctgcaaagtgggagagatgttaagaggaataaggaattgctttccagaaccctataaacttagatgggcaacctagctgagtatacctgagaggatttaacagctttataaaggccacacctcaagttcatgttaacattattttacctgcattcttacctatagagtaataagaattgtcctgttttatagtattagagctgtcctattgtataacagtagagatggctgctttgatggacacttcttgtaagccgtagtatatttgatgcatatttattagggctgtgtattggtggccaaatttgtaaagtgaagactctgtaataaatgaagaagcatacatagggtgtgttattttcctggatggtccttttcccattgcagagtttgcaatcattttgcaatcttcacctacatgtgacgtagaagaaaaagtacagagagggccaattatcataaaagacactttgcgtagtggtgaaatgctggacttgtagccagtctgccagttttaaatcctggctcaatcacttagcagcttgtgtgaccttagatcattagtttatgtaaccctttgttgcctcagttttctcctctgttaaatgaaaagattagacaattcatatccgatagagttgctgtgaaagtcagctaattgcacgtgaaacattcttaggaagagcctggcatatactaaatagtgcataggtattagctactgctgctgttttgttttgctgtttttaatcattgttgaggtgcctattcctcagttgctatgctgtagcaaatcgagctttgtaactagagctaagaaactggtgggaacctaggcatggaagttgtatatgtgtaccctttgggctgagcactataacatgaggggtttagactaatccctaatagtctgcctagctgcaagcaagtctgggatatctgtcagtcatgagaagcatcattaagcatgtgatggtctctgaggctgggccctttaacttgtatgaaaaaccccagctgtcaaaagttaggtagagagctttggacctcaagtcctgactgccactctccagctctgtgatctcatgcaaatcactttgtctcaggactttgtctccctcacccccatgtaaaagtgggatgataacatcattttccaggatcagggtggagaataaatagaccatgtttactaaatgtcctacggagtgtggtggccaagtaggtgcttagaaagtggctgcagctctcagtattattgtgaatgaaaaattctggcctcatatccggtaaatcaaaatacttcaccctaactcctaaggcaatattgttgcctagaatcatcagcatatttggagaccaataacgcagtttgcatattacatggagaatgtgggtggactaattgcatccaggcatggggtgactggcttgagattaaatcaaaaggaatttcctgagtttgtgatgtaagggaagctcaagagactggaatactcaggaagtgaaatcccagatacaaggactgaaaataatcattcaagtggtggaaaaggtgatagaaagattgatcaatggcaccgagtttagtgggacatctgcgctgtgctccctctttggtttcctccctttcgtggctgagaggtttggtgtatcagtgcttcttcctcctcagccagaaagtttcagtttttctatattctgcccaccctcttttcttgcctgtatttgtccattcattcaataaagactcatttagctccaaaatattcattgaggagctaaatgtgccaggtcctggagatgcaacagtaaaacacacatatgcatatacccacatgcacgtgcatacacaatttgcacacatacgtgcacatgcacacctccatgcatatgaacatggatgcacacatggccacgtgaatccctctcttcttggaattgacattctagttgaggaggacagaaaatttaaacaatagtagtaaggaaaatatgtagtttgtttcacttgacgattattgtaggtttccccacaattttttttttcctgcctctgctgtttgggaggttgtgtgtccaactatttctattctttgaagaacttctagcctaattgcttaagcttcacagaatctcttcaaactgtttcttaaagggctctagttattgaataagttttgattcacaatttcatgaaaaaatttgtaaacatattagaatgtggtaatatggtttttctgtttattgtgctaaaagcaaaagtgtagaaaagtacaaaaaccatgaaaatataccttgtttgaagtaaataaatatgaacatgaaatatattatttaaccatgctggaggtcaattttaaatgaattctgcttttctctgggcttaaaaagaaaacttagtaactagtgggttgctatgttttatgttaagcaacatttaaattgaaatcaaagtagagtaagtacatattttaactaaaacaggtatgtctagttatggggcaagtaaaattgtatagcaatgaaattaaataaaaaacctatgaatattttttgagtttgaaatacaattggcagaatctgagcttgctatacatctagttggcttttaagggaaactgattttttaaatttcccttctttgattttggatcttgacttaaagaatccagattcccataaacattatacagaaagttctaatggtgccaggaattagaaaaatctaatttctttttttttaatttttttttatttcaataggtttttggggaacaggtggtgtttggttacatgagtaagttctttggtggtgatttctgagatttcagtgcacccgtcatccgagcagtgtaactatacccaatgtgtagtcttttattcctcatccctctcccactctttcctctgagtccccaaagtccattttctcattcttatgccgttgcaacctcatagcttagcttccacttatgagtgagaacatatgatgtttggttttccattcctgagtttcttcacttagaataatgtcctccaatttcatccaggttccttgaatgccattatttcatttcttgttatggctgactagtattccatggtgtgtatatgtgtgtgtatatatatatatacacatataaaacattttatccactcgttgactgatgggcgtttgtgctggttccatatttttgcaattgggaattgtgcatctataaatgtgtgtgcaaatatctttttcatacgacttcttttcctctgggtagatactaggagtgggattgctggatcaaatagtagtcctacttttagaaatctccaggccgggtgcagtggctcacgcctgtaatcccagcactttgggaggctgaggcgggtggatcacgagttcaggaaatcgagaccatcctggctcacacggtgaaaccccgtctctactaaaaatacaaaaaaattaggggggcgtggtggtgggtgcctgtagtcccatctactcaggaggctcaggcaggagaatggggtgaatctgggaggtggagcttgcagtgagctgagatcgcaccactgcgctccaacctgggtgacagagcaagactctgtctcaaaaaaaaaaaaaaaaaaaaagaaaaatattcacactgttttccatagtgattgtaatagtttacattcccaccaacagtgtaaatctcatttcttaatggcttgggcttgttggaaattaaagagacatcaggaaacaggcaagcctttttttttttttttttttttggagacggagtcgccgtctgtcgcccaggctagagtgcaatggtgctatctcgactcactgcaacctctgcctcccaggctcaagcggttctcctgtctcagcctcccacaaaccatttttaacttaaatcttcttagtgtaaagataacaactaatatattaaatatatgtttttttaaatggagtttatgctgaggaagaattattttgaaaataatttatttggaaatatttccattgttagatttttgttgctaaaaatggtatatattcaccattaaaactttcctatcttctcagcttaaaacagcattgaaaaatgactattttactttgtctaaaaaagtctttcaacaagggtctcaatagtttttgaattcattggtttaatttcttttgataagtttgcaagaacaactgatagacattaagatagctgtgatgcattagtaaattttaataaaatcttttcttatgaaattggccaatgggatttaaaagcttggtcatggttttctaagtgtagccccaaatgcacttctatgtggattcacatagctttgttagctttcttacgtagttgtaaccctcattaattccaagttttgggagaaaaaaaatcctgaatttcaaacctgttcttggaatcactggtttataaaatatagactgggttgaaaaataacgaagcatgacctattatgttggttttactacattttttcttacaattaataaataagataaaaattattttaaaatgtatcttaatcttattcttcttatttttgtacatttcacaatatacattttatgtcagtaaagcagagtgtgtacattacctaaaaataaaccagtagatactgcatgttcaattaaaaaaaaaaatggatggaggccgggcgcggtgactcatgcctgtaatcccagcactttgggaagctgaggcaggcagatcacttgaggtcaggagtccaagaccagcctggctaacatggcgaaaccccgtctctactaaaaatacaaaaattagccaggcctggtggcacacgcctgtaaccagctgcatgagaggctgaggcacgagaattgcctgaacctgggaggtggaagttgcaatgagccaagatcacctcattacactccagcctgagcgacagagcgagaccgtctcaaaaaacaaaaacaaacaaaaaatgacagggtagtgtacagtagagaattgagaaaatcaccaaataagatgatattctactggtactgaagagttaataatactcatctatctttgtgttactcacctgtcaggaacctcccaggaatgggttgatcgtatattttattgtacgtgttttatgaatgaagtgcatttttattatcgaatgaagaaagcgtataggacaatggggaattatttttctcttaatctatcttttcagctctcctcgtctagcatatgttgggctccccagttttaattgtgaagactgggagattttgctacattagggatcacatcactttctttgtgtagatagaatctcagtctctcttgctcttttctttctctcgtggagataataatctaactctgacatccatgatgtgatgatttgccaggtgctctatttctagttacagctactagggaattgcaagaagacattgggaaatggtacttggcctccacttagctttattcagattggcttgtttcccaaggacccacaggatcaatgatgcgtgcagtgctaaagggcagctgcgaggtcagggcgtatttattgcttgctggggcatgttattgaccaataagaagttaaacagttcctagctacagctaagacattgcctcttaggcaggaagacaagagatcacctcgggcaactttcgtttacacagagaggtgtgtaaagtggaaccaaggcttgcaactctaggcatcccttgtgtttgtcaggatttcagcttatttggggtggctgcaaggctttgagacatgcccatgatgctatgcatttttctaaactcagcctttgtcaaggtagtcagggattgttcattttgaaacctctgtagatatctgcatgtttgctgcaaaggttttgtctaggtgagatggactggctcatgtttcctaatgctgatgcccttccctcccttccatctgtcttttatacacacagatctatttattactttcttttctttgaaaagtataacttagctttggataaaggaggaacaggatcacatttgattaaacgcaagcaacagtttacctcgcatgggcttggatgaataaggaatccaaaaggagcggtattcaggaaaaaataaactgtgtgtgtgtgtatgtgtgtgtgtatgtgtgtataaagtacagatatatatatacacacacacatatatatatatacacgcacatacatatatatatatatacactcagaaataagtagtgaaaaatctccttttagctttatgagatgttctgagctcagctctgaggtttatgttctgactatgaaaaataaaatgattttcctaagtttttaaagaatctttctttctttctaggtgtaaaaagaactttttttgtgaactattgaatgaagaggtgaggaaggagaggcaggaggaagaaaacaatacaaatcaggctgaaaggcctacagattaaaaactaacactgcctcccctgcagtgagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatcgagtgcatctacaaaggtaataaatagtatgtggctgagttagggcttgggaccattttctagaagatttgccctttctgcaattctagtctctataatgattggagtgtaggagttaagttgtggagcgtctcataaatttaactagaatcatcccctcttaaaatctaaatcaaatattgacatattagtcggccattatttgattacatttttattggtttaggcagtgagagatgttttgtgcagaatctggttgttttcagccctaaagtaaggcattgcattatttctaaataatcctataaagcactaaattaaaaaattaaaacaaccaactttataaatgatggcactcctagttttctatgtgccagcctctcattccggaatttctgaaaggaagaaggaaagtaaattaacattgatcacgggcctactccatccctggctttgtgtttatacatgacttatgttccctcccttctcagaactctggcgtgttagtggtattaccttgcttttacaagtgaagaacggttaactaatttggggaaggttactcagttagggagtaattgagctgaagtaggaatgcagtgctgacttctgtaatctttctctttcagttttaccaaaatggactcattctgactcatttgggggttttacaagttagccctcggtaacaagtgcccagcagccttgcctgtattcagctcttctatatttgtgtgatgggcacagaacaccttcatatgtatgctttcttatcctcatgatcagccaacagaggcatgaatctaccaaaagaggcaaattcctccttaaaaaatgcagaattttaggctgggcacaatagttcatgcctgtaatcccagcactttgggaggtgaggagggagcatcacttgaggtcaagagttggagaccttgtctttacaaagtatttttaaaattagccagacttggtggcacatacctgttgtcttagtgtactcgggagcctgaggtgggaaagtcgcttgagcccaggaatttgaggctgcagtgagctatgattgtgccactgtactccagcctgggtaacagagtaagaccttgtcttttaaaaatgtaaaataggctgggtgtggtggctcacacctgtaatcccagcaatttgggaggctgagacaggtggatcacgaggtcaggagttcaagagcagcctgaccaacatggtgaaatcccgtctctattaaaaatacaaaaattagccgggcatgttggtgggcacttgtaatcccagctactcaggaggctgaggcaggagaattgcttgaactcaggaggcggaggttgcagtgagccaagatcgagccactgcactccagcctagtgacagagcaagactccgtctcaaaaaaaaaaaaaaaaagtaaaataaaatgcagaatttctccatatgcaggaatggcagtgggtttcctctctcaaagaagatagatcctttgcaaaagcataaaactgaaccatgaaggatgttacagggaaggaaaggctgctcagtcagggtgattcactggggatgaggcatcttgggggttccttggggagcagaggtgagccccaatgaaagacagctttgtattaaaaccatgggggttcagagtacttattaacttataaaatatcatcagaatgagctcatctgagctaatgtttcagaccaagcacagagtaggctgtttactattctgtacctctactgaataatggaaattgtattttttggtttagccagtttgtttttatctttcttgatctctttctcaaagcaatttctgtttgagttagtggctttaaccacttatccctaggtatatatcaagattagtaaactatggaccaccagccaaatctggccccttagagacagaggttctcaaccctggtctatattcatgattttgggggtttattgtaccttatgtacttattgtaaataaatataaattctttctgaaagtaggtaggagtagaactctaaatatacatccatcaacatatccaagttggtcagactgaaaattgaaaattacccctttttggtgtgttatgacgatttgttaaaaaaaattatatatatataaagtatattatatataaagtatatatatataaagtgtgtatatatatatatatatagtatgacaactataccatacggggaagggccaatcaatgcctcaatttgagcatctccactttaaattgtccagacatgcagaagaagactctccctcttccctagttaatgagcttcattgcaattgaggattttgagaggggtgccacttccctcaaatggtattccctgtttaacgactgctactgctaaaggtattgtgggtgtaacatggagaaggaactcaaggcatcttgcactttatctctcattgtgtgcgagagctgggtaacattatagagaagtgttccagaattaaagtagtgctctgctggcctgtacctacaagagatagtgatggaaattttagttgtttctcctataaaaatgttagctgcttggcccagaatgggctaagatgttcaatgacagagattgagtgttcaattgtgttacaatgagccatttgaacaatttctgtttgtcctctgcctgtcacttttctctttcccctttccaatcctgctttaagaaatgtaggaatagcagttttgcaaaggatctcagcaattctaatatgaaagattatttttctggttaccgagtctgcattacaaattactccaaaatttactggcataaacagccatttattaagttgatggattctggggccaagcattaagataggacggtgcacagatgacttgtctttgttccacgatgtatagggtctctgctgaagagctcaaaggctgtggctaaaatcatctgaagcagcgttgtgtctggtagaactttctgtgtgatgaaaatatgctatatctgtactgaccaatatggcagccactagccgtacatggccatagggcaactgtaatgtaactagtgccattatagaattgaagtttttatttaattaatttagatataaatacccactagtggctaccatattggacagcacagatctgaaggcttgctcacccatatctagcagttggtgctaggtgacagtagactttagttggggctctctccattggaacacctttctgtggccgcttcctgtagtcggctgttcctcctcatatggtggctgggttccaagggcgagcgtcttaagagaaggaaccaagggaagtagccttggagccagcaatcttgcttccactgtattatatttatcctgtctggattcaaaggcaagggcagtagaccccatttcttgatgagaagtggcaaggttctgggagagcaccaggacaagaaatattgctataatcatatctggaaataatctgccacagttgttccaggtacccagtccattcgttcatttattattcattcagcagacagtgaatccctacttggttacttggcatcaggttacttagagaatggcagttgatgataatgaagctcataaaaatgtgaaggaggtggttgggaaggcatgtataggtatctccaaagctgtatggtatatgccatgataatacatggtaagcagagaatggatgattagcttagacacataggggcatctttgaagaagcaacatgaaaactggatcttaaatttgcagtaaactaaggagtttgccagagagagagaaagagatgtcatttaggcaaaaagttaagcctacacaaagtcagagaggcaaaatggtaagcttttcctggggatgcctcaactctacattgcttgttcagaaaagagcactgtacagctaccctgccaaccacgtccttcattttcagtgtgtgtccccacccacgccatgcatattgaaaaccagccgcatacccagcaggtcaccaatccagaaaaatccatagcccaaggggatatcattgatgaattacagacaagttgcctatcagcaggaatcctggattggattagagaatcctcataccatgctggcttttctaaagaagatctggctctcagagaggaacaaagatgcctgaacacatggtctgcattgaaaacaaatattgattggcccctgctgggttgctgagctagagtgggttagaatctgatgtcaaaaagtgctggggtgtggaaaaccattaactctgctgattgaccagaataaaagctccatctatttttaagatcttaaaaaaatgagggtgaaatctttaagtgggcggaagggcagaattgatggtgagaacccatagttaggcaaaaacactctctctcagtttgtcttcgtgactctggacacagatcttaggccatttgtccctatcttctatatagcattttttggacctgtgactatttattaatgctgcactaaatttactcagttgcaaattaacgtccaaatagctgatgttctgtggtgttcagatttaggattcagaccgtctgctgggtgttcttattacactggtagaaaaatgctctggctgtatctgattgcatccgacagttagatatatttctgtcactgccagatgtacaagatactgtaaaaggagcattttctctagcaaattagacttgctagctccatggatctagattgactaaaacagcttgttgccccagggatgtagctggatttggcttggtcatttcttttaaatataggacttcagaaacctgatctagagtccttttcttttggagacagtatcttgctctgttgcccaggctggggtctagtggcatgatcatggctcattgcagtctcaacctcccaggctcaagtgatcctcctgcctcactctccctagtagctgggactacagacgtgtatcaccatgactggctaatttttgtattttttatagagatgggctttgccatgttgctcaggctgttctcaaactcctagactcaagtgatccatctggctcagcctcccaaagtgctgggattacaggtgtgagcaactgtgcccagctgatccaagtccttttaatgaagattttccaaatctgctgcctttacttttaaacctgagatgtgtttgtctttctagagtagccctcccaatagaacttcttatgatgatgacgtattctaaatgtacgtggtaagcattagccacatgtagatattaagtacttgaaatgtggcttgggcaaatggggagctgtttaaaattcaattaaatttaaatttaaatagccatatgtggctagtggctgtgtcattgggcagcacagttctagcatccgcttttagagatggtatttgcttagagaagagtaagaactttgctagctctgtaactttttagcagtatcttaatttgagtcatctctttcctctaacaacaatctaggaaaagaagccattggccattggggatgccattggccaactaagggctgggatggggacttgagcaagggccactaggctggccataaaacctgtcactttggcttctttactcattttcctgaagtattctccgcaagataaccaggacatttttagtaggttccatagcctaatcaaaggtgtttgggaaggcctggttaattacagttgtacgggtttccttccagaagattttctcagccttaactatactcatggattgtgagtctccagatgaggctgtggtatcactgccaaacatatttgatatgaacagaaccccttttctctttctggtgttgttctgtgtaataatatgctttgggaaatgttggtttaagcaatgagacttcctgctacaatagatgataaacttaaggcatattataggcaattaacatatcccttttctggactttggtggaatttgaaatctgcatttatagtttgactctgttcatccttcactgtgtttgcatttttagttaacttttcaagtacataaatatccaggctggcctggctgtatcctgccgggccagagacttgtgtcaagtttagttcttatagttggagaaatgctagtgtttcctccatcagtaatttttttatctgttgatccccatgcagctgtgagtatgaatgcatacatatttctcctttttttttaaaacttgatcagccagcaggagatgaaatagagcagatcacagctccctgttcatttaatcatatgagttactaaaggaaggaaaaagaaagaaatgtaaaaatggagaaatgtctcctcccctttctttttctctctctttctttttaaaaattgttcaacaagttatctgcagaaaacatctgcctctcaaagaatgaatgtaatttgggttctgaactcatatgtccctctggttggaaggaagagttttttgcacatgaagtgaaatcagctaagatgctgtctgtgaagctgaaatattgagatttataagatgacagtaaagtagtgaaaagtggtgtttttctgcttgacactgtcaccactgtggaataagaattccgggaagaagagacttagatacagggtctacagctgtctgttcccatgccacggaaggttcttccagccaccttgttatggcgatcctcctggcagggaatgagagccatctccactgcctccctttgagtggttatctggcttgtgttgcttgtcttgtcgggagaccaagggccttgcaaagtaggtgcctgtgaagagtgtcagctgaggccctgcagggagctggaagcttggaaggcctgggagaaaatgcctggctaatgtatgaggcctggaagactcttctttgttaagaagattcatgggtctctgaggagtggagtaatcaggactaggagaagatgttgggccaagccttcgtatcctatatccatctgcttgaacatttttttttttttttttttttttttagctagttgaaaggaggaggtcccgttgaggcttatttgaacaaatatttgctctccctaattatatacccagagctgctctcctgaatgtttaatgcaaaccttaatatttacaatagcataaggaagagtttataatgtgtttgggaggcttccgaagttggggcagtaattcttctttgcacttatgtaatacttttcttcctaagagacctgagccatgtttaccttagccactgttcacattgagatgaagtgaagtgagggagggagatgaaaactccagagaaaggaggagcccctgtgggcagctgccaacatgttttataggtgagacacttgtctttgccaaaagttgtgtgccagccacaaacttttctttctggtcaggaataacatgtaagcctgtgcttacaattgccttctgatatggacgtggagagtgtcacagaggtgccatgctgggtttttgaccctgatggtagtagacttcttgctcagtgccctgctgtatgacaagcctgacccattcccttattagactcaagatttagtgagtcttaaaaagatatttggaggctaggtgtggtggctcatgccagtaatcccagcactttgggaggccgaggagggtggatcacttgaggtcaggagttcaagaccagcctggccaacatggtgaaacgctgtgtccactaaaaatacaaaaattagttgggtgtggtggtatgtgcctgtaatcccaactactcaggaggctgaggccggagaatcacttgagcccgggaggtggaggttgcagtgagctgagatcatgccactgcgctccagcctaggtgacagagtcttactccatctcaaaaaataaaaataaaataaaaaaaggaaaataactccagtagggtagttgccaagttcaaaaggccaaagaagagactcagaaccagcaaaagatacatgggattttattaagggcttaattcaggggagagggtccagtggtggtaggctggacacgagaaccaccttatgtacagaaatggtccagtggcaatgagccggacaaagtaaccactggctcagtggcagcaagctggtcgggaaaaccacaactgcttgcagacatcatgcactttatatggcatttcacaaatataaaatttagctgggcgtggtggcatgcacctgtagtcccagctacttgggaggctgagacacaagaattgcttgaacctgggatgtggaggttgcagtgagccaagattgcgccactgtactccatctagtctgggtgacagagcgagggtccatctaaaaaaaaaaaaaagacatcgaagtctggagaactgagtttgaaaccttcttccattccgtgtatggaccttgggaaggctgttaagcctcctggtgccttgtttttctcatctgtaaacaggcataatgaacaccatttgcacatggttggtacgaagattagaaagagtgcaagtctagtacctggctgcataggctcttgtgttggagcagtggtgattattagttctgtcatcacctgtagagcctgttgacacttgaaggccaccttaattttgcagtttgcatgtaagggtcctctgtagtgatttccagagtttttcctccatgcacggtgcctagaacgatgcaaactgggcagttacttggggtttgcatctttccacaaaacaaaagatgaaaaagagagatcctgccaaatgcaagcaagatgaggaagcatgtgccaatgcccaagacttcaaggaagtcaggttgtgggcagtgtttatgcaagtgggaactgcattccccagcactggatctgtgggtcttactcttaggcttgccggccttagcattatggcagcagccactggagaggcacaagtggttcctgagcattttgctgtcagggaaggcataggttcaggtgaatatgtgtaagcactcatcttctaggatgctggaatgtgtcgagatatcgcttcagctgagttggcttttccttcttctccaactttttttgtgaaatctggttctatagatgctgtgcccagctgtcagattgtctcagttctctggaattagtttaaaatgaaagtttttccttgtctgctatagacagttctacaaacagaattactctccttttcttaattgcttctgtcttcaagggcaggaagagataactttctctataggaagagagggagacccagtctgggttcttttcttcttttctctttttttttaggcggagtctcgctctgtcgcctaggctggagtgcagtggtgcaatctctgctcataacagcctctgcctcctgggctcaagtgattctcgtgcctcagcctcccgagtagctgggattacaggctcataccaccacacccagctaatattttgtatttttagtagacccagtgtttcaccatgttggccaggctggtatcaaactcttggcctctcaaagtgctggaattataggcgtgagccactgtgcccgcctccagtctgggttctaagggatcatttgctttttcccattttccacataagcaagtgcatttgtttttttggcatagttgctgtcacatgaccgtgtaggtgagaaagcagtggggctcttctggcagggcatggcacctgttgtccttaggcatggacagcaaatgtgagtagctaacatctcgcccagatggatctcttttgtataaatgttgatgctgaaaactgacttcctgttctgaacttttttcttttgagtggctgagtgggtgactgtcctaagataccagtatgacttggccgtttgcaaaggattgctcaacagggctttccccaagttgttcttccccatgagaggaacagttagcaaacagaatggactttggagttggtcagtttaaaagagctattgagtactgcaggctccattatgaggtctggggccacaggaatgaactgaacacttaagggtctttgttctcaaggagcgtgtaattgagtggaggcagacagacaaaaaacatggaagcagaaataaacacaaatagtggggggcaggggcagtggagtggaagcaaggagaccccttcgctggcttttgatgtactccagaccatagtaatgtggcttagccgacgcaggagccaggtgaggcagtgggatgggggtggggggaggaattccttttgtattttagagctagagccaatgggacttgctaggttttgcctctgctatggcttaggtatgttacttaacttctctttaaaaccttcatttgttttcctctgaaaaagggagatatttcacagagttgtggttaaaataaaatagtttttttttttttttttttgagaggaggggtctagctgtgtggcccaggctggtctcaaactcctggccccattgatcctcctgcctcagcttcctgagtagctgggatgacaggcatcagccactgcacctgtcagattttttatttttagttgttatttaagtagttataaaagaatgagcacctcagactggattttagaggagagccccctagactgtctctgtgtggccacttgtccaattctgggttggaccggcaggagcctgtgctcatctgtccacagggaccacctcagtgtttggcattaccaggcagcggttgcgtccattgcctctactatccccttcttcgcattggagtagacttccctgggggcagcatgggaagaggttcctgctgcaccttgcaggcctctcttgacattggggttgggagggtgctggaggtggagggaggtgggaagctcaggcctgcactgttttcctctctgcccggccgatcctgacccctctctgttcctagcagctaccactgtctttgctgatgctgtggttacctttacagcagtggttctcaaagtgtggtctgagcgtcttttgcatcagaatcacctgagataattattaaaactgcaggctctgggccttactctagacctactcagaatcacttggactgggcccaggaatctacactttgtaatgacctccctaatttagtgagccttgtgtgctctaaattttgagaatctcttatttagaaaatttgattttccttttggagtaataataacaagtaatatttgttagaggttaattatgtgatgctactcagtgttttatatgcaataaccgaattattcctcaaaaataacagtgtgaaagagaaactaatattagccttgtttggccagtgggaaaattaaggcaaagagtatttgctctaatgttgattgaagagccaatatgtatgtatgtatttatttatttgtgacaggatctcactctgttgctcaggctggagtgcaatggcaccattacggctcaccacagcctcaactttccaggctcaggtgatcctcccacttcagtctcctgagtagctggaactacaggcacctgccaccatgctcagctaattttggtattttttgtagagacgagattttgctatgttgcccaggctggtctcaaactcctgggtccaagcgatccttccgcctaggcctctcaaagttctaggattataggcatgagccacagcacctgaccaacagccagtatttaaacccacatccccagccgtatccttcacctactctctcccagcctcccttatgtggtgatattacatgaatgagtcttcttaatttaaactgactactggatggcttcctgttatgttaagaggtagcaacttaaacatagagcattttaaaattgagctttaacgtacatcagagcctaagatttgactctgattttgataccctgagtaaacttaagcacttttctccttcattcactttggtaaatgagctgtgcagccatgctcttctcgtaaacttttacctgctgtgctaggctgtgagccacgaagtgcctgcactgccctgtgccagtgtctggaacattctccaagtaattggccagtgcctgcgcagatagaatgcaggtagaatgccagttctccccaacccttgccattgatctgcatcttgggaggctgtgcaaggagttggaggatctggggttttcccagtgtctggtcactgaaagaaattttttctttttagtgactccaggttagtgtctgagaaaagttggccatcaaaacaggaccagcccgagcaggtttgaagataaaaatcaatcattccgttcatagtactttcttatttcatgttcctttgcttccaactcccataaggaatttgctaaagatacaacctcagagatagcttaaggtggagagaaattttcgaccataagttccttggagaatacgaattcaagtagggtgagtgggaagaggtttctaccaacattttctccttgcatctcaggtcctgaatcttccaaaaagtgctgcttgtgccctacactggctcaaatttgcatttctgaaactagtttggtttgcattaatttcactggagttgtgatcacattgaaaatgcaaagcctaattgttaattaagaaaagtcattttgagatgtgatggtgttttatactcaacatgagcaggttctatttggttgtggcaaccttaagatttatgactgactgtcctatcaacacttggcaaatgtttccatgctatggggatgcattttacaggctgttaaataagaacccacgaagtggtccggtatgtttttaaaaaatgagcctagcaccaatgtatagctttctctagaatttaaatctcattgttaatttgaagttcctctctttattgaaagctgggtattgaatacacctactgggagatgtggccacatagagatagtctggattaatgggctttggtcttattttttagacctaaatttattcttcattaaaagaagagtaaaattccaggtgcggtggctcacgcctgtaatcccagcactttgggagcctgaggcgggtggatcactcaagattaggagtttgagaacaactcctcagttggtcaacatgtcaaaacccctctctgctaaaagtacaaaaacttagccaggcgtggtggtgcatgcctgtaatcccagctactcgggaggctgaggcaggagaatcgcttgaacccaggaggcagaggttgcagtgagctgaaatcacaccactgcactccagcctgggcgacagagcgagacttcgtctcaaaaaaaaaaaaaaaaaaaagaaaagaatagttaagcaaggtgctttttattttcacttggaaagtttctttatattttcactcagaatacttagggttacatacagtaataaaatttttagtaactctattaaaggaattgcctaacactcaggagtcaccgctttccttagtaaaaaaaagtcaagaatacactagggtttatgtaaaacaagaaatctccagtccaaaatcagtgaaataagaatacagcatcaaattatattattgaagttgaagaacagtgcacagggagaaaacaaagtgataacttaattcaatgctatagaaaagtgatttgtgagtcactttaacatttcagatttgtttaaaccataaaagtgataaattagccaaagagctaacaattgatattatcttaagttcacataaattttgatttaactgaagcaaatgaaatcaatgtagttactcccttccgattgcttcatctttgtacagtttataaagctaagaataagtagctctaatgaacagttttttttttaagcttttttgttgaggtttctctaatatgtgtcttttagtaatctcttcatttttttcctcccagttcttcatctcttgggctcagcatctccttctacttagagcaccctgaacatgtagacacagtggtaatgcacctttccttgtggctattttgccacactaggaactctttacattccaggggtcccattccagagatcccaatatgcagatattctactgtctatgctcagtgctgtgaagttctctgttagggaccgaactacaaggcattaacaggcaggattggtgcccgctagaggttttctctctgaaatcatcagggaaaacaaacaaactcaaagggcaaatgtgtgcatagcaaaagggaagtcgtggaaagaggtctgtggcttgtgcctttgagagctggcagaatgagtgagcagcacaggcttggtgagtgttccaaatttattcagagatccctcagatttggtttggtatgtatgggctctttttattacttcctttgttagcggttcggtgttcaaaagtttcaaagagtcgccacagagtttcttcatcattcttggggagccaggcaggtgggcaactctttctcttaagcagccatctgaaagacctcttaagcagccatctgaaagaccttacctcaggattacacttggagagtcagagctgtgagatgcctgcccgtccgtagcgttcctgactgtgttacaagtctggtagcctgtctgcacctggttccaagcttttcgggttgttgatcatttttgaggtggtggaaactgttaatgtttcctcctcattttgagttcgggagagatttgcccagccaacttctaatcagagactctttcaaatcctgtccagtctctctccctccactccttcctctagttattctccatcaggccttcagaatgtgctttttggtgtgtccagtcagatcatggcactcggcttcctgtctacacaaggaaaaaatccacatcatgttcaccagatgcttgttcaacccgcttcagccccccaggtttcctgctgccttcccatcctctcccaacactctggcctcagggcttttgtctggaccactcttcccaaggtatcttccccttttgctcaaagtcagtcatgagggaggcgttccttaattgccacatctcttttcttttcttttctttgttttttttttttgttttgttttgttttgtttttgagacggagtttcactctatcacccaggctggagtgcagtggcatgattgcggctcacttcagcctccacctcaccctgcaccccaggttcaagcgattctcctgcctcagcctcccaagtagctgggattataggcacccactaccacacccagctaatttttgtatttttagtaaagacagggttttgccatattcgccaggctggtctggagcttctgacctcaggtcatccacctgcctcagtctcccaaagtgctgggatgacaggtgtgagccactgtgctcggccagttgccacatctctagcccacattgccactgggttgtcatttgtctttccctgtagcatgtgggcttcctgaaagtaggatagttctctgtcttgttaatctatctagctttagcacccagaacagtgccttgcatattgtgggggctcagtcaatatttgttgcatcgtaaatagtgggtttgtgagttttccatttctcaactacaactctctgaagattccaataggagggagaaacagggtagtcagagagataataaacaaaatcagccaacgttgataaattcagagtatggaggaccaggtaggatgtgtcatcatacctaagaacgctgcctctgcttaaaaattattgttagctctagaaacaatgacatatctatttgtgtagccctttgcagtaaacacatatacattaattcattagattcccctaaaagattctattaaaatggtgtttaactttttagtgctgataatgtaagatcttctttgtaggattgcctctattttgttgttgttgttgaaggccagggagggtattgtaagtgttggatgatgtttagaacatacctgtgacattggggctgttactactgagcgtccatgttgccatttggattttctctctttttttaaaaatattatttaagaaaagatatctgtctgtctcccaggctggagtgcagtggtgtgaacactgctcactgtagcgccaacctcctgggctcaagcaatcttctcacctcagcctcttgagtaggtgggaccacagacacatgccaccacacccatctaactttaatattttttataaaggcaggatctcaccacgttgcccaggctggtctcaaactcctggactcgaacaatcctcccacctcagcctcctaaagtgttggaattacaggtgtgagtcacaatgcctggtctcatagtttttattctgatagtttatgctgttattcatgactccttcttctaaccttccctggctggtgttacttatgtagaaaaggaagacaggtcttgttagttgccttcaggaagactaaaaatcttgttcgggagagagaaaccatgaaatgaaactaatttattggccttgaagaagtgtcaacaacatttaagtcaagagcaggagaatggtgctggggaacaaatttaaattggttttttatcttgtaaaaaatattaattttgaataatgggaaggaatggtaggcagaactctatagtccctaagattttcatatcatggtatatttacatctgtttatctaaactaacattaatgtaggtgctgctctgaaaatatttttgcaaatataattaaagccctagccaggcatggtggctcacgcctgtaatcccagcactttgggaggctgagttgagcagatcacttgaggtcaggagttcaagacctggccaacatggtgaaaccccgtctccaccaaaaatatttttaaaaaattaactgggtgtggtggcgcacccctgtaatctcaggtactcgggaggctgaggcaggagaatcacttgaacccaggaggcaggggctgcagtgagccgagattgtgccactgcactccagcctgggtgacacagcaagactccgtctcaaaaaaaaaagtaataataattaaagccctaaatagttggccttaaaatagggagattatcttaggtggaactaccataatctggtgagcccttaaaaggggctagacactttttttccagctaaagagtcagtccatgaggaagcatcttctttgatggctttgacgattgggggaagggagcgtaggcaaggacgcaagtgtcctgtggtagctgtgagtgaccctgactgatgggcaggaaggaaacagatatgtcagtcttacacccgcaaggaactgaattctgccacaaacgtgtgctcctaagaagacctggggctctagacaaggacgtggccgactgacaccttgtgagacactgagcagagaaagcagccacactatgtccccagacttgtgacctacagaactgtgagctaaaacatgggtgttgttttaagttgctgtgtttatgggaatttattacagcagcaatagaaaactaatcattgagggaaatctcattctgacaaaatctggaaaaaaaatctaaactgtaaaaaatgaaatttagtttagtttctgaaagaaagtactttttccctccctccctccttctctccctcctttctttctttctgcctgccttttttttcagtcttgctctgacacccaggctgaagtgctgtggtgtgatctcagcccaccgcaacctccgcctcccagattcaagtgattctcgtgcctcagccttctgagtagctgggattataggtgcctgcctgcctgccaccaagcctggctaatttttttttttttagtagaactggggtttcgccatgttggccaggctggtcttgaactcctgacctcaagtgatctgcctgccttggcctcccaaagagggagggatctcccatgggattacagccatgagccaccatgcccagcagaaagtactttttcaagaacaaatgaccaacatacatcaccaatgggatcaagctccatgctgcttgccttgcccctttgagacctggttaaatgaatagataagaagtgttgtaattagtagatcaagtatttataaattagtgggtagctccaaagtactagaatagacctaaaatagttcttgccaaatatttatctattcttggaacaaccttactcatgcattataatttgcttagcaatcctttgttcataggcagtgcaaagattagttacagccctcctactgtctgaattactgtactttctgaattagtagagttggcattgataatcttaaaaatataaacagtaaataaagcatttaaaaccccccatgctgctgacttcatataaagagatagttgtttttgaatattttgatgtccgtacacatttttctacagaggcagtatttaaatgggtttgtataaataagttctctttcttgaagcttgtgcaaagcatctttacacaagaagcttataagcacagtcaataaattcaagaaaatggcccttttgaaaggaagccactgatgcatctgtgggctgacttctgcatgaatgacagcgcagtaataagaaagcagacaacggcttcctccgccaccactgccctgccgtgctcacgctgcatgggggtgccctcgcagcgggagtgtgtgtttgtcctggtggccggggactgcggcttggcctttttgtttacaagagagaggacagcagcctctgccctccagctgctgtgaaaacagtgttggaaaaccagagcgaagtttccactgaagaactcacactggaaaaaaaaaaaaaaaaaaaaaaaaaaaaaaaaaccaccaacacccgaacaaacaaaccttccctcataaaagaccatctgggttaaagtacagaccactgggtcagaacccagatggtaatgagaatagttgttcttctgcaaactttccgagtgggatttccatatattaagttggaagagagcccaacgttgaaaaacaggaaactaactgaagggctgttagtgtagtttgtaaggaagattttagcagtgggattaattgtgtatgttggataaaggatccccatcactggaggtctccttccaagtgaaatgggtgctcctgctgatttgaattgggaggtgacagtggcgatggcagatgggtatggattagagcaatattttggaggaagtctcagctggggttggggatagattgcatcctgaggggtgcaaaaggggaaaagagagggggaaggacgaggatgactctcaggtcatttctttcctctcttatcctttgttcttttctcatattatcactcaggcaaaatgggaatgggcatgtgagatgctttgattagtcagtgccagcatccagcaatgtggaattctctgtggggcatcttgaagcctctgggtgttgatgtggagtgctgaccctctctgaattagtaacacacttctagctatcttagacaggaaaccacagtcattacaccatggagatctcttcattatagctttgctaccttgtccatggtcacattaatgactcctgtcccagttcatcattgataacacctacagtaacccatggtgctctgggagaaatattgggggagcagacatatgaacaaaacaatttgtttaagtggtaatttattttctagcttttctctgtcactcactaaaggtacaatggtccaaataaatgctgtcttgtatggatatttcccctggcattctgttctattgcagtgctttggaaagacgaagagtcattctacccattcaagggtagagattaggggccaaaatgtagaacattttgttgtggagattacgcatctaggataaatggtgttttgcccggtctagttactaaaatgtggaggggaactgactttttcatgttcgtgttacccttttcttttgtaactgtctaccatgatactcctggttgctccactgtctagattttttttttttcatttttgatgtttcgttttgagttaggtatctgagttccagaacttttgctacttgatcaccctctgccaaacaatcattaaaatatgctcctgtaatcagtaatgaagacagacataagtaatggataaggatctttttttgttttgtttttttgtttgtttgtttgtttgtttgtttttgagacagagtcttgctctgtcgccgaggctggagtgcaatggtgcaatctcggctcagtgcaacctctgcctcctgggttcaagcaattcttctgcctcagcctcccgagtagctgggactacaggtgcacccccccagtgcccggccaatttttgtgtttttagtagagatgggatttcaccatattggccaggctggtctcaaactcctgacctcatgatctgtctgcctcggcctcttgaagtgctaggattacaggcatgagccaccgtgcctggccgagcatttgctttttaactcaacatagtaacatcttcttcttggggccatggcctggaaactgatggtgggacaggcatgtcacttggagtcatttctaggggtccactctgaggtctgctggtttccagctctggccttctgtttcttcatgtttaacataataacaatacccatcctacctccattacaaggtcagagggaaaatttaacatgagttggcattatcagtgtggtacagcacactgtcgccacaggtagttgttaactttatttctggactattctgagagtgaacggggataccccaaaccaaagctagcctttgtggagtctatgttctggtgataatcactgctttcaaacaagtaccattaggtcaaaactaaaagcgtgagtcacgcagctgtgatacatttgtaaagaaacctttctgggctttcctgggaatttttagtttattattcctatataggtcatccagagaaggacatctcttccctactccacctcataatcctcaaacagaaatatgacccagtcttttttttttcattaatttagataagttatgaattttagggagaaaagttcagataagaagtacttttacatagttgaatgtgacctctggattccaaagagatgatgtgcttactggctgaagaaagcctgcagatggaggatggggagaaagtcatgaacttattactcagtttctattttgtaaccacttggaataaatatttgtgtaaaatatgagcgtaacaatgtggttttagttaaagccagaatgtggttgttcagaaataactgagcaaaagtttgccagacattcacatttcactgggcaccctttattgctgtatactaattctggccaccttacccaggaagcagggtatatgacatttccatttattgcatgccacctacacctttcatcagcaaagggacacctgtacatcctggggacagagcagatagaagacatgcattccattgccttctttcaaatagatacttttcaaaagattttagaccctgagttaagacaacctcactcttaattattgtggtcaggaattcttttctttgaaatgaaacctgcattagcactgtgtgtttccttatttacatttttgttaaatttctggacaatacgtagctccccttagggactttctaagtttggtggagaaagaaaccctagtggctaacttcactgtttagtccttaaatttaaattctttattatgtacccaccaggccactggtcatgggtagtgggtatggagacatttatgtggatctcactctgtctcatctgaccctccatggattagatagccaggccaggcaatgattaggaggaccccacaacccaactgagggacaccccagcattttctttcatgcaaggattaatttgccctgtctagtgtctatattattctccccttttatgtatgttctttgtatccagctgacatatttaaaattgcttgtggtctactgtgagccccacatcatctttacctctaaaatcattaactcattctaacttcatttcacatctgacaacttcttttcctactaacactttattttcctactttgtgatatacctgatgtctctgctgagtgggcccttggatatatggtcttttttttttttttttattttgagacagagtcttgctctattgcccaggctggtatgcagtggcacaatcacggctcgctgtagcctccgcgtcctgggttcaagcgattctcctgcctcagcctcccaagtagctgggattacaggcatccgccaccacgctcagctaatttttctatttttagtagagacagggtttcaccatgttagccaggctggtctcaaactcctgacctcaggtgatccacccacctcggcctcccaaagtgctgggattataggtgcaagctatcatgcccggccagatatatggtcatctttttaaaaaaaatcaggattaagtgtcctcatataagccttaacatattatgtagtaactgattccctgaatgatcagttccaaagattttgctactgtgccccaggaagcaaacattaaaacctcagtattcagggcccctctcctttcaggggtcaaacttgggataccaacgccctgacatcatcttttttgcatagctactcagcttatccaaaagggtctctacccctctctccctaaccccaccaggattgctcattaactacttcttcacctccaagcccctctgctactattttaggattaaatcttctatgagactgagatatctaaacatatttatttaaaatttcattaaagtataagcttacataaaatgccaactcttaaatgtgcaaccgtatgaatttttgtgtatgtctatacccatgtaattaccaccaggttcattcaaaatatagaatatttctagcacccaataatacccctcatgcattctctcagtcagtaatttcttttgcatgttttttgatttcatacacatggaaccctactgtatacagtcttttgtctgtaacttctgtaacttgccattatgtctgtgaggatccatgaggttgtggttatctgtggcttattctttgctcttgctagcagtattcgttttatgaatatgccagagtgtgtttacacgttctactgtgggtgaacattatgcgtgtctccagtttgggactatttatgaataaagtttctatgaacattctcatatgtatgtattttgatggaaacaaacacttatttctgttggctatatagcctcaaaggaattgctgggcggtaggctatttgtgtggtatttttaatgcaagataatagatttacatactgagaattgtgcttcatagtaagcttttctgggtgtatttttcattgatagagaaatagctctaatatgggcctaaatagctcatgtgtacatttgcttaagttctttattctgagataaatgatttctttaagttaccaatgtcattttgaagactaattcagttatgttttcttgttaaagtcctggctcacttccgtagctcatgttactgttttgtgtattagccttctttctctaccagcatttagattattgttgaaaaactaatataagcgtcgagggtcaacactatcacaatctttcttgtaaaattactcctgggttgacattgaactgcagatgacaagtatgtcagatcatgtgaggtaaaactacagagcaaggaggttaatttttcaaatggatttatttgagcaacaagcatttctgaagcactgtatgaagccattgctctgtcaagtaaagtaaaatatagccattattttcaagtagctgacagtttggtggtgggggcagaaaatgaaaaccattgtttgcaatgtcctttaagcaagcattgccccgcatgttagaggggaggaagggagtggggggtggtgatgagagagcatgaatgagggcatcagaatcagattggagattcagagaaggcttcctagaaacatatattttgatggaagaaaacaaattagatatttggggagatagagtgagggtgagggctttgcactgtaggggaagggaccaaatagcatatttaaaggaatggaggcatgaaatagcattatccatctagtagtcaatttaggggataaaacattttttattccattgatggtgttattgccatatacatttctggaatgcctcttttggaatgacttttagagctaattttcaaaccacaccagaaaatcactcttgatactttatagctttgacccaaatggtatttcccagctggacgctcaccagatttgtctcctaaacacttttggctcattccaaagaaatacaatctgtcttcagaaggtttaaggcttaccactattgagaacattcaaaagcctgtgtgtgtcccagaactcagaaatcaattccaaaaggccacttgtgtgcaaaaagcacttatcgttggaataagtctgtaacctcctaacgtgaaagtacaggttcccaaagacttggctttcaaccaaggttttattttagaaattttatgtcaaaattggatcattttatatggtgggagccaggggaaagagatggtggggagtgagtgggtgtgctttatactaagcccagtgcttttcattagttgtcttaggatatgataattaactctgggtttggttaaactggctcatagatcatggaaacaagggttatctgagaggtggcaacaaaagccaaatccaggtagtgagggctgggtgtggtggctcatgcctgtaatcccaatactttgggaggccaagacaggtgaatcacttgaggccaggggttccagaccagcctgggcaacacaatgaaaccctgtctctataaaaaatacaaaaattagctgggcatggtgacatgggctgtggtcccagctacttaggaggctgagatgggaggattgattgagctggagaggtcaaggctgcagtgagctgtgatctcaccactgcaccctagcctgggcaacagagcaagatcctgtctcagacaaacaaaaattccaggtggtgagaatctgtggtgtcagcctgttttgacctcactgtaaagcagctttgtgaagccatggagcagatgaggaagcatggaggagatactacagcagggaagagggcttgggaaggcaggagggggatcccagagagtcgggaaacctgggacagctcagacaacaatcagttaattcttttgccttcagttgtatattttgaattgatctcttcttagttcatccactactatgacttttaaacgataataacctgaaagctcttctataatctgctaagatcagtatagagcttatctgttatgtttcatatatttaattaatcaaacctagttatttttgaagatgagaatagttttgtgacccacctgggtgggaggggatgagaagaattataacctttttaccttaaaactttcctgataaggcactaaaccactgggctggtctacactggtccaaaagacatttatttccttccttccttccttccttccttccttccttccttccttccttccttccttccttgctttctgcctttcttccctcctttccttttctttcctttccttcctttcctttcctttcctttcctttcctttcctttcctttcctttcctttcctttcctttcctttcctttcctttcctttcctttctcttttcttttctttcatctcttcttttcttttgagatagggtcttgctctgtcactcaggctggagtgcagtggcgtgattacggcttagtgcagtcttgacctactgggctcaagcaatcttccatgctcagtctcctgagtagctaggactacaggcagacaccaccatgcccaggaaatgtttaaattattttggagtcagggactcattatgttgcccagactgatcttgaactcctaggctcatgcagtcctcccacttcagcctcccaaagtgactttttaaaaaagatgtagaggccctgtgttaaactagtgtgcttttaatttgcactagtatagctgttaatttgcacatagccatcaatacctttggggatggagatcctgaagtttgccagagttttcatctgtttgttcacacagattatatattcccatacaacactggttagaaccacactgaggatcaaccaatgccctcaaaccaagagggtttccactagcagttacagtggaaaaggagggacttactgcaattcccactctcctgtcattttgtcttgtatcacgtgctaccatcagtttattgtttcatgaggatgcccacattgaatcaaggaggggtatccagagagatttcacttccacacagaaacaccagcacttaatttctcacagaatcaaatattttacaatggttctaaaatactacatggtttgtgtttgaaaattatcattcaggcttaaggtaaggtcaacatgtgtctgttcttggttttctgagcctttctttggtttctagtgaaacatattgatacggtttggcagtgtccccaccgaaatctcatctgaattttagttcccataatccccatgtgtcatgggagggatctggtgggaggtaattgaatcataggggtagttaccttcatgctgttatcatgatagtgagtgagttctcatgagatctgatggttttataaggggcttttgcccctcttcactctgcacttcttaccaccaccatgtgagaaggacctgtttgcttccctttccgccatgattttaagtttcctgaggcctccccagctacgccgaactgtgagtcaattaaaccctttcccttcgtaaattacccatctttattagcagtgtgagaacagactaatacacgtatcaaaactatcaaaagaaagcaattggtattcgattttgcatttgccaccatagtatgtgtgcgtgagtgtttgcatttttttcccactgggatggaaaaaggcacttagaggataatgaagttgctctcctgacacctcttcacctcttttaccatttgagcaagagtggtttcatatactgttgtctagcaattgacctttcctgtgtctatctatcacttaactaattttatttgtgcccagcacccttgccacaaatttgcttttcaagtagaaaacagtaaatatacctccacgatatttattgccctgaaaaatgcataggcaaaagtcataaaattttgcatgctacacagtggatcctttgactgcactctggaaatcctgaagcctattctggtcccaattccatttcatttttctgtttttcatttttcttttttttctttctttcttttttttttttttgttggagttttgctcttgttgcccgggctggactgcaatggcacaatctcggctcaccgcaacctcagcctcccaggttcaagcgattctcttgccttagcctcctgagtagctgggattagaggcatgcgccaccacgctcggctaattttgtatttttagaagaaacagggtttctccatgttggtcaggctggtctcgaactccagacctcaggtgacccacccaccttggcctcccaaagtgctgggattacaggcgtgagccaccgcacccggtcttctgtgttattaacagcacttttggtgatcttgaatgcattggcatataactaaaaaatttccttttggaaaaatgtcaagaaaggggataccatttgcaaagagttcaacccagatgatgattaagcatctataatttacgtgaccacaattaattcatggagtgggttttttggtggagagcaggggtgctgagcattctttagcccttcatcgccaatattaatttgaatggcttctgtacctccttgtaattgaattattaataatcacaaagagcttataaacttcgaatttaatcttcattaatatataaagctcaaagagtaatgtcttttgaccatgagtagactgcttctctaatttatcttcaaagttgcttttttttcttcctgtaagtttctgtagtccccttgactcctaaaagtgagtgtcatggagtggctttgatcagggaacatacatcagtaactgttttgtgaccttagtcccggctgtgttttatggcttggccaaagtttatcatataatttccactttaggaatttgcccacttactaaggctttgagggcaggggaggtgaagtagtattgtgggagaggagtaataaatgtgttttcttttcagtttctacagtgagtggtctgttttgaaatgagtgcaggtggttgcagtccactccctccccaaacaggacaaattaagatcattttgctctttcgggaagctgagggcaagcctgcacaggtgaggtcacgagaggcaagctatgtgcacacctggtgtcctcgtgcttcttgggcaggccagctccatgcagtgcagtgcccctgaagggaatggggccaggagaagacataacagggcatgaggatcttctctgtgccaagaatcatgctaggtaacccccctgagatttctcatcctcttgagaatcctgtgagatgatcctgctgcccttatttttccagatggaaaaacggattacccaggattcaccgcttgtgagtggcagaaagtggcagcattagaactgctgcactccatggatacatccagcacatgtgctctcctctagtgtgtgattccggttcatttaagtcagattttggattccactcaatgaagtttgtaactgctaagttgtgatgtgagcacttagatcaccaagaatttcaactaacccactatgctcaaagtgtggtccatggaccaagtaccttggaatcccttgaaagcccctgttgaaaattcagattcctggccgggcatggtggctcacgcctgtaatcccagcattttgggaggctgaggcaggcagatcacaaggtcaggagtttgagaccagcctgaccaatatgatgaaaccccatctctactaaaaataccaaaaaaaattagccaggcatggtggtacacacctgtaatcccaactaatcaagaggctgaggcaggagaatcacttaaacctgggaggcggagttgcagtgagctgagatcacgccactgcactccagcctgtgtgacagagtgagactccgtgtcaaaaaaaaaaaaaaaaatgtagattcctgagccctgcctcaaaccaattaggtcagaagttctgggggtacagcccaggtgtaggttctctgggagagtctgtcatgcactaaaatttgagagtcatgccataaaacctctttatagtgctccagtataaaaaagatcttggggttaagcttagctaaacaaatacgtctgcaggctggcagttcatgaattccacctaaagactatctggtttatccctcattttacacaaaaggaaactgtggtttagagggttgaagtaacatgttaaaattctcatggcttttttgtggtagagcagacactagaatcagttctccttcctccggtccatagctggctgcttctaatcttttaaaaatcagctaatcaaggtaacttggatccatttcaatcctgtcagtgaccctacgttcaatataaaagatgagtcctgggagaactgccgttctgattcacattcatctgaatgttgaaaaagtgcatttcttcagagtgctctgtaggaggtggaaatattcaataagcttgcgagaaaggtttccatctcaaccacaccatgtgtgcatgtgcatgcacatacacgcgtgcgcgcgcacacacacacaccactgccaccaccacatagctcagatctgtcacaacatgagggaggggactcgcaaacatgcataatttatgcaggattttcacggatttttcagtatttggaagtgatttcttaaattatacattgaaacagctccataaagatgaagctggagttagtttcacaatagccttaaaagtgagagaatttgcgtctctgggatcaatgtgcatatttcaaagtgagacgtttcactttatagaatttagagggtctcaaggctgtggttgacatttttagtttgttgggctaaacaaccatttgctatacaatactatggaaacgaatggtggaagagattgccctggaaaactctgttcaattccgttaagaaatattaaattcctgaggacaatctacttgtttattattttcaatttctcttaaaatagtataaaaggatcttcttgggtggcagtacagggatgacaaggaagggaccaaatctcagttgttcacatttttacttagtttggattccaaataatggggcttctcataaaagatttggaccctgccccgaggcttttggtaataaatgtggccgctttgtttttttccctaattatttcattcgtaaaagtcttatcttcccaataaagatggtaactcctctggactgggtctgcttttcgcattttccttcttttatataccaccatggtatagaacttatttttgcttaataaacagtttggacatcaggaagagacagagctgtatacaataggtagtttacagtcaaatatttactgctttaaataaggcagaattggctgggcacagtggctcacgcctgtaatcccagcactttgggaggccgaggcgggcggatcacaaggtcaggagatcgagaccatcctggctaacctggtgaaaccccgtctctactaaaaatacaaaaaattagccgggcgtcgtggtgggcgcctatagtcccagctactcgggaggctgaggcaggagaatggcgtgaacccgggaggtggagcttgcagtgagccgagatcaagccactgcactccagcctgggtgacagagtgagactccgtctcaaaaaaaaaaaaaaaaaaaaaaaaaaaaaaaaaataaataaataaataaataaataaataaggcagaataagtagtatttaattagagcacagactttgtggtaaggcaggcctgagtttgaacctcagctgtgatacttattgcctcatttgaaaaaagtaaattttggccaggcatggtgactcacacctataatcccagaactttaggaggccaaggaaggaggattgcttgagcccaggagttcaagaccaccctgtgcaacacaacgagacctttaaaatttcaaaaaactactaaaaatttcaaaataattagctgggcacggtgttgtgtgcctgtagtcacagctactggggaggttggggtgggaggatcgcttgggcccccgagatggaggccacagtcagctatgatcatgcccctgcattccagtctgagtgacagaccctgtctcaaataaaaaaattttaaaaagtaaattttattgtttatatttaaggcatacaacatgatgttaagagatacatgtatatgtagatagtaaaatggttgatagtgaagcaagttaacatgtctatcatcttgcatggctacccatttttttgtatgtgtggcaagagcagctaaaatctattcatttagcagaaatatggaatacaatactattaactatagtcctcatgtacatcagatctttagactcgtttgttttacgtatctgccactttgttcttacacacttgtgtgatcttgggcaagtggcttcattacctctccacctttagatttctgttctgtgagttaaaagtaactctcagcactgttgtagcagaatccatgagtaagcactcaataagtggcaagtgcaatcattattagcaacaaccgtaataatagccatagttccattattaaaggggatgattgcccttgttatccaagtgctcatctcatttgactttgggcctttggaattaataaagcaggcttagttcctgggtttggttttcctttttcccccaaagtttgttttgtttagttcaaaccatattttatgtttccatttataaacacattctctcaagtgctgaacttttaagcatggaagtctgaagatacctcctcttgtgaagggaaatttaaaaaatatttaatgactgctttttaagtttttggtctgaggaaagagcagcattaccttggtcattgactaaaataaagacataataaaggtactggaaactgaacagaagtatggagtttgtgagtgaagagttggtcacacagacagctctccttcctcagacattcaggtgcattctgggtaagttgactgatttcaaaatgctcaccttcaagtgccaggcacaaaattataatgagcttcctttctcataattcttcttttcatgattttctcagctggattcttcaaaggattatttgtaaagacctttatggtgtgttatgatttaatcagatgtagcccgaatttcccaagatgtgttaattatcattgccacacaagtgcaacagaggaagcaaaatgtttttcatttgggcaggttgagggtttgtttaaaacgtacttagggccattaggatcacatcaaaatatagtgcatggtaattatgcatgaaatagaaggttacctgctgtttaagtagctagtttcttgataatgttgcaataaagtattgagagaaaattggtttctcaatagcagtggaacaccttgtttaagggacaaagtgaactgcattaggctgaaaaacgaaaagggggaaaataaaaatagattttatcatcaaagttgtcagtggatattgttctcagtcttaaagaattatttttagtctttcccttcatcaaaatggagaattatttgtttgcatgtagattgtggtagagttggtatgtttcagatttaatgaaatgcagaacagaataaatccctcgggaaagaaaggaaagaggggatacgccagacttagtatatgagagtagtcaaaagcctggctttaaaagtcaaagaaaccccaaagttgacacctggtccctatgctaactagctgtgtgacctcctccatgttacttaacctttccgacctcccagtttctttagtagcaaaatggagatgttattattaatataacagaccttgttgaaaagatgaaatgagacattgtatgtaaagcactttaggaggacatgtctgtcacatggctgtgctaaattagatgttattatcctgtcaacaggctgaatagcaagggggaaaagttctaaactttggaatcctgtcgtaatacacacagagatctcattccttgtgaaagaatcctcgttttggaatgggatgctgccttggggaactgccatgacaaggatatgaagttacaactgtgatggtggtcctttgaagaatatgtggagacttttctctatattggattattatatttttacttttgggaaataattacactttgaatcgtttcatgattatttggctaacaaaacaggtgatttctgtgagtatatatatgtatatgtgcgtgtgtatatatgtgtgtgtgtgtgtgtgtatatgcatgtatgtgtttatttatttattttaccatggacatgcccttgatgaaaaagaaatactttgcttggttattcctccaagtggaaatttggacattaccctttgttcatggtggggaagatttttagttattccacatatcagaattatctacgtgaatagttagcacataattaggattaaaaagtaactagttgcagaaaactcattattttttctaattctaagaaagtagcttcattttgggtattagagaaaagctcaagagattcactgattaatatgtattgagcctgttacatagctgacaatgtgctagtgttttcacagtttctatctaacttacaaaataactgaaagaggaagaaaaatattctattccatatgtattagaaaactatcctttaagttctaaagttggcttatgatctcctgaattgcacaatatttatctgcaaaccttgaaactatttaatcagagacttctgaccccaaaatgccaacattactcttggtggtctttcaaggtaattcccccttgtttttagtgtatccattgaaacactaaatggaaatatttagtgccctgatgctaagggaatattccaactagcggcactgattccactccaggttattaattaaacagtagcaatcagcccatctgatctttaatattctattgctgctgactgatgcccagacatcagacattttgtaatctaatacaaaattgctctgtgcttaggactaaagaaaaacaacacataatttatactatgttttatctttattttcaagttccagaggatacgctggttgtgtctttcaatgattaacttaaaaaaacaaacaaaaaaacaagacactacgtatctcaagcccaacatgaagggtattgagagtaaattatagttaaatcatttatttctgactttttcatttttatgtattcattttttcaacaaatatttattgaatgcctactgtgtgtcaggagacatccttctaggcacctgaacttataacagtgagtaaaacaaagatttctggctgagcgtggtggctcatgcctgtaatcatagcactttgggaggccaaggcgggcagatcacccgaggtcaggagttcaacaccagcctggccactatagggaaaccctgtctctactaaaaatacaaaaattagccaggcatggtggcacacgcctgtaatcctagctactcgggaggctgagacaggagaatcacttgaacccaggaggcagaggttgcagtgagctgagatcatgccactacactccagccgcctgggcctgtctcaaaaaacaaaaaacaaacaaacaaacaaacaaacaaacaaacacacacacacacagacataaaacccacaaaaatttctctttctgtgaaattcacattcctcccaaatggaggttgttggaaaattttaaggtgctcttttgactcctgtggttgtacttggaaagaagaattaaaccagaagaggagatattctacaaatcatatttgggtgatttaattaacctctgtccactatcctcactccccactccttcactgctaccaccaacaaatatcatgcttacacacataccttgaggggaggaggaagggaagacaaatcagaatttgctgtacatgcagtactctagaagccaatgtggagttgacctaaggggatccttataaaaacttagcagacaagaattatatgcacttcattggaattccactaattccagatttcagatcagctgggagggttgtctagactgaagctttacattgttatctttaaagataatgtaaattaaaaggatggaggggaaataggtaaagtgtataagtaaacaaatgatacaaagcactgtaattccccaaagcagtttctttggcaatgcacagtggtttctacttaatactgcatattttatagttttcactaactttaatcaacataaccatttagccaaaattatggtgactttcatcaaatgaacctcatgatgaaagggttgggaggggatgtgggttgcatgtaataaaatctccatatattttgcataaacaaacacacacatcatcctcttgggaataaaatagttagcaggagcatttttagagatagggtgttactcttttgctgttgtgccaaaccccaattaacctcaataggggccgggtgcagtggctcatgcctgtaattcaagcactttgggagtcagaggtgggcagattacctgaggtcagaagtttgagaccagccttgccaacatggtgaaaccccatctccactaaaaatacaaaaattagccaggcgtgtggtgtcttcctgtaatcccagctatttaggaggcggaggcaagagaatcgcttgaacccgggaggtggaggttgcagtgagttgagatcctggcactgcagtccagcctgggtgattgagtgagaccctgtctcaaaaataaaataaaaaaatgaaaaaccaccaccaccaccacaacaaaactcgaatagagaaggcgccgtgttcaaaaggccaaagaagagactcagagccagcaaataagacatggagttttattaagggcttaatacaggagagagagtccagtggtggctggctggacaggagaaccaccttatgtacagaaatggtccagtggcagctagttggacaaggtaaccacaggctcagtggcagcaagctggtcgggaaaaccacagctgcctgcagacatcatgtactttatatggcatttaacttaacacctgccctaacgacctccactggtaaccttcatttaacctgaaactcaacacctcaatcccctatacagcctgtgttccagggaacaggaagggaaggaacaagactattggatgggatgggatgggatggtgggagagcagctcagatgttcctcatagataaggaaagactctccagatttgtcatgtccagtttcctaccttggaacacacattcaggtgcatctgccctagagggtcattctaagggtatgcttaaattaatgctatcaggggtgtgtaccctacagtcacctaggctggagtgcagcagtgcaattacagcccactgcagccttgaactcctgggctcaagggatcctcctgcctcagcctctagattagatgggactacaggtgtgtgccaccattttttctcttttttttgggggtggggggtgtggggggatggagtctttccccattccctaggctggagtgcagtggcatgatctgggctcactgtaacctctgtctcgcagccccaagcaatcctcctgcctcagcctcccaaggagctgggattacaggcatgcaccacaaagcccagctaatttttgcatttttagtagagatgggcgtttcaccatgttggccaggctggtctcgaactcctgacctcaagtgactgctggctttggcctccaaaagtgctgggattacaggtatgagccactgtgcccagccattcttggctaatttttttttttttggagatgaggtcttgctgtgttgcccaggctggtctcaaacccctggcctcaaaatgctaggattcttccaccttagcttcccagagtgctaggattacaggtgtgaggcacagcaccaggcccccttggctaaatttggtttgccacactttacagaagcaacgtaagcagtttctgcttttcatagcatagattcatagaaagaagagtattccaaatagataatggtttgtttactatagccactgggtagtctgaagcatattcttctaccaggaagtggtagttttgcctagtacctggtgactgaggaagaaatcagtgacctaaactgacaaatgagcctactgaggtggcattgtttaaatgcacaaatctgaggcagtggaaagaaggaattgattgccttgctggtattttttcccctgcactgacccttcttaattaatacatgaggtaccatttacccaaacagatttttcagcactcacttatggaggacactaagtggcgagttcatagttcaggcagagagctggcagatcaagactcctttcaactatgagatctgtggttctatgcaaggcgaccatgaaaggagttgtttagaccccgtttttcaggccagcagcaggagctcagcccgccattaagagtttgttctgtgtgcatgttgtaagcacctgaagtttctcttgaatgttctctttagaaagatccatcgttagggtgcaagagcaattcttatttgctgcaagaatatttatccttaacagcatatagctgaatctcactttatatatgaattcttgaaataagtgcacgtatgtttcatgcttgcaaattgcatccaattagaatagcttattttaaaagctgttttagagaattcagaagtatagactcataaaatgtcaacttatcccctaatattccttttggtacatttagatttctaggtgctggttttgcttacattcactataaatcttaattgcaaagcatattcaagccaatgatcaatatcaaagaaaactattttttttatcctaaggcccatatgccagaatccccctgtcccccaatctttatgcttcttcctcatatctgcttccaaatcaagaaatgattggaatctgggtgcagtcacctgcaccctgtagtcccagctgttctggaggctgaggcaggaggatcactccttgagcccaggagttcaagttcagactgggcaacatagcaagactttgcctgttaaaaaaaaagaaagagagagaaagacagaagggagggaaggaaggaaggagggaaggagggaaggagggaaagaaatgctttggctaagaaaatgccctgaaatttggtcaaagttggagtttcctcaatgccaaagtaaacgaccatttgcccatttaccctctacttcccacaaaagagtttatgactcttgcgcagagtattgcaccttgttcttctttttttgatactagaatcaccaggataagtgtgtagtgtagaccatctcaggcatatttcattgctgtcgtgtttttccccgctattatttgaaaaacaaaggatttcttgtagctcttcagtgcactaacactcacacaaattgccccaggcttctcataagtaggaagttccaaaattaaatgtctaattttgctgcttaaacatcctttgttggctccgtgtccaggatgctcttatcacttcctcaagatggccaccttaggcagtcgattctgttagaaccaaattgtaattaaactattttaattttatgcactgattacaacatttttctctttattatgcatggtgaaagttcctcactacacagatccaggtacttataattatgtacaaaagtagtgaaactgttttctaagctgtattcacttacctgatttgtttctctatccaatctcagttgagttcctctaagacagggtgatggtggtggtgaattatttgtgtttggcttagataaataaaaactggaagagtccattaaggttggagctttttataagctttcaaagaaagcaaagttgaggtggagttaaaatgttggggaggattgcatttagattacatgtacaaaatagtttcaagttttaccatgaaaagtgcaaattgcactaaatttgaagacaaattcacaactttgtatattttattgggtatctattttatttaatttatttatttatgtatttatttttgagatggagtctcgctctgtcacccaggctggagtgcagtggcacaatcttggctcactgcaacctctgcttcccaggttcaagcgattctcctgcctcagcctcgtgagtagctgggattacaggtgcctgccaccacacccggctaatttttgtatttttacaaaagatgggttttcaccatgttggtcaggctggtctcaattcctgaccttatgatctgcctgccttggcctcccaaagtgctgggattacaggcgtgagcaaccatgaccggcctgggtatttattatgtgccaatctgttgttctatataacgttcatgacaactctgtgaagtcacaatgaagctttgaaatgataagtaactttactatcttttagagaaagtagaggcagaagtggattatgaacttaggcagccaccctccttaacttgggttcctagatgctgacaccgggctcaagtgcctgattcactgtggtttgagcagctgtattatgaagaaatattacaatgcatttaatatgagcttgggctgtgtaatcacacaaacgtgtgtccaatataattatctcccttactgtctgtgatctccagtgtcctcatctgtgaactgaggaggttaaataagataatgcgaagtgcttatccagcatctgcctcaagcaggtgatcatgatgacagtggtaaggactgtgccgagaactgcctcagttacattgtcctcttccttagtggtatgcttcccatggttataatttgaagacgcttctggccttcaaatatagtgctagctagcaagggcacagaagaatgaaacagagttgtttgtgggaaacatgaagcagaagcgagtgatggacagaggtgaggccaggggaacaggctagagcttgatcagggccggccttgtgtgctaggctagagcttgatcagggccggccttgggtgctaggcaggagagttctgtctcctgcgggaaaagctgcctgtcccttggccagctttccctaaggcatgcagctttcacaggcactagccattcttaagccattttctctttccttcactttgtgcacaacctgttggaatttctcaggtccaatgtgatgctaattggaggaagtgtggagttggacctcctaggagttcaaacaagggccccttagtgattgcagttagaacctggactgtttggtcaagggaagtaactaggatcagtgcagaaaaacccaacctattgcttgttctcagtagcctcagaaaggagattttgcatgtggagtaaaatgggaatgtttagtaggggagccagagatggtaagtgcaagaattgtgagagaaatggcatatttaggaaagaaaaaaaggccttgaatctgttttcaatggaataatttaactttagtaaattacatacttttgcttaggctagttgaaaagaatgctctagttctatgtgcaggtagtaaaattagtgcctttcggtacatagtaaatgctcaataaatatttaatagacttgattattgtgtttctctgatattaaatttttagactctagttcactattatcattgctttaatttggaaagcaattaagcaaccaaattatagtagaatgatttaaatagaaagattatttttagtttagatgtgattcagataaatattttgatgacctagtcttgttttcatttctatgtggattcagtgtcaatgtttcttcattatccaattgtttttggtgttggaggggagaagtgacacatttaattcaaatgtgagacaagacacatgtttggctctttcgggaagtcaaggtcattttagaaggtttagggtcatatatgggaagtgtgatgatgtagctctatagatttcattttctaggctctatccatacattctgtttctatttctcctgtgaaccttcaacatctggatgctttcctatgagatgaatgttgttcacaaagaaatttatgcttgagaaaagtcctgaggcattcttccctactttatgttagtctccatttaaataagtttctaaacctttgaagagaaagtgcacttattaaaaaaaaaaagacttggtaacaggaactcttgaggtgggtattcagtttgttaaaggcattaaatactgttctcttccctccttttccaaaataaccattaggttccacctttaccagtctcattaactctgttttaagaatgagctgattgtttgagttggttaagataagatcacctcaacatctgttggtgataactttatctcaagtgtatctttaaggaagtccatttcaactgaaacatagttaagtatcttgaactgcacagatatgctttcaactttgagctggaattagcatttttatcttctttgggaactggacacagagaaggaaaagaataaactttgtttactccttccagcccaaaccctccattaaaaatttttcttaaagtacaaaacgtttgaatgccccatgaaaacatctcaaatgattgtgctgggtgtgtaagcaaggcagggttttactgttttaaaaacgcacttgggggaaccttgaggagtttgcctttttataaacccctctgatcttctatgtgaggaaacggaggtccagtgagtgaaagtgattacttctgggcagagccaggcccgtgccaagggcttcctgtttcagtgtctgtctcccgttggggctccctccgtaagacctgcagcctgtttattccgggccgagaggccagggggaagggccattatgaactcactgccattcagggagttattggatgcttattagaggccccagcatctctttagaggcattaatttagtagcactgtttcgctggttgcatagtttgcaacttagtcaaaagtaatgaatttaaccaatcctcagctttcatcttgttttagcagtcttccaaaaatatcagcaataagggggtgatgtaaaaaactcttaaaacacacacatgagatcttctgcttttaatatttgctgtggtttctctgcacttttgaggctcttcccctcgttgtgtgtgtaactcttggtgactcttaacacagtgctgtcgccaagacacaaagcaaagagaacgtgccatgaactgcttccccggaactatcagatggttccagttaagaaggaaattatgactctgttgttacagcctgggaaaagtgaaacaacatgtttcaaacttgccacttcatggtcacgggattgaattgggcagaacattttccaggccccagctggtagtgcctccttcacggaggcgggtatcttgtgcccactctggtgtatttgcactcccagaacctccttctttctctctcctcttcccccatcaggaatatatgctcatggttaaggaaacctagcttggatttccttggaatatatgtccatttaatttataattttaaggctggatgcagtggctcatgcctgtaatctcagcagtttgggaagtcaaggcagccggatcacctgaggtcaggagtttgagaggagcctggctcatgtggtgaaaccttgtctctactaaaaatacaaaaaaaaattagccaggtatggtgatgcgtgcctgtagtcccagctatttgggaggctgaggcaggagaattgcttgaacaccagaggtggaggttccaatgagtcgagatcataccactccagcctgggcgacagagtgagactgtctcaaaaatttttttttttagagtttaagatgagaaagcaaagggaaccttttcctctatgttgaaatacttccttggaatcatttggtagattctcatagaatggtagtcagagtcttccaccagtagtcaggaaattcaagtttcacatcctttttataaacccctctgatcttctaggtgaggaaactgaggtccagtgagtggaagtgattacttctgggcagagccaggcccgtgccaagggcctcctgtttcagcgtctgggatccccgacttgtttttttttttttgctgttaaaaaaaaatccgtagttatcactttcactccttttcctgtgtgtgttgttgtcattcattaataatgcttaaaatagatggcagaggctcagattatctgtaaacagcaaatactctaaaatcattttgatttttaaatctgctgctgcttttctcattatgttaatgttccatctttttgagtattgtttattgtaatgtaagaaccagtcatgcctggggtacactcaagctggatccttgccataagggcaggctggggtgaatggtggtacactcttggtaaatgtgacatgataagaaatatatatttgggccaggcacattgtcctgcacctgtaatcacagaacttggggaggctaaggcaggcaaattgcttcaggccaggagttagagaccagcctggccaacatggtgaaaacctcctctcaactaaaaatacgaagattagctgggcgtggtggctcctgcccgtagtcccagctactcgggaggttgaggcatgagaatcgcttgaacccgggaggtggaggttgcagtgagctgagatcacaccactgctttccagcctgggcaacagagtgagactctgtctcaaaaatttggtctctgccccttgacacccaactgctaaaacccttgtaatttcctgagtgatagaggtgataagaatgtcttccacagaattcccaaatcccttggaatttcctgggtgataaaccttttgttctaatgaggtgattcttagtgggttcctggatagcttcaaagtggtgatgtcatcagaaagactaaactgtcattagaagcttggaacttctaacccaccctacccctattctccagggaggagagaggggctggaaattgtttaattatctatcatgcctatgtgatgaaaccccctcaaaatttctaaactatgaggtttggagagcctccaggttgataaccatatccacatgccgggaggatggtgcaccccgactccatggggatagaagcctctgtgtttgggacttttctggacatcacacagtgtacctcttcatctggctgttcatgtgtatccattatgtcctttttaataaatcagtaatagtaagctgttttcttgagttctgtgaccccttctagcaaacgattgaacttgaggagggagtcatgagatcccctgacttgtaggcagttggtgagaagtataggagacccagacttgtgattggcatttgaagtgagggataatcttgtggctctgagcccctaacctgtggtgtctgcattaactctgggtaattactgtcagaattgaattcaatcattagatatcaagtaggtttccaggaagttggagaacttgttgttggtgtgaggggaagaaacccataagtttggtgtcagagcattgccagtagagaaacaggtcccccccacatatgagttggatggtgttatgctcttggtagggcatttgttttgaataattcacagatgcagagtgtttgcagaaccgtaatggggttttgaattatatccttgtataggtgggattacaaataagactccaaatataggctggtttgaacctcagttgtattcattgtttgtatcatttagcaaggacatatataatctaaataacaacgaatagagtgggaggggagcttcagagttggctcagtccatggctcagtcatatccctagagttttagacactttacctttcttcactttgccatctcagcatgccagtttgggtcacaaatggacatcttatgggggcaagacagctgtagacatcacatcagagtatgacaacttctagtctcctccttgggtctcctcttaggagcaagagactttcctggaacccgttagtggacttcctctctgcttctctgtttaaatcattcactggcagaatagcagtaccctggatagctagggcagtcaggagccatcccctgaggggcagtcagagctgggcttccattagtcgcgggtcaagcaaacagcccctgggaagagaggagatacacaggagagattcttctagaaaggaagaacaagaccagaaatggattactgcagcctgtttccttagttgtaaggtggagataataatagcacttaataagattattgtgagaaccggatgagttaatacatataaagcatgcaagacagtgccaggcacataataatctttcggtaaataacagtttttttatttttatttttattttttctgttgttgttgaggtggagtcttgctctgtcccccaggctggagtgcagtggtgcgatcttggctcactgcaacctccgccacccgggttcatgtgattctcctgcctcagcctcccgagtagctgggactacaggagagtttatttgttaatacattgtatgtattattattatgacaatattgaaggcatcataatatattggttttataagaaatgttaaagaatgggagaggtgataaaacagttgcagggatgacccaactacatggctgcataacacactctaatctgaaatgggagcagaggcatcattcactctcagtaatttggcgctggttgtttggcacattgagtcataagcatttgagtcttccacggtggcactgtcaccatacatgtgacccacagattagatacgagataggtggagtggagaaagcagagtagctgagagagtacttgatgaggctgtttgcttcattggggctcacagtgctaagaaaaaccatttgcagaatcatgggagcagaatgatcatttctcctataatctggggtcccagcctttaggatgtatccctattcaatgtaaaacactaggttttattcagtgaatggcagtctagcatggttatgctagctgaatggtcttatagggaaagattatagcagatatatgtatatatatgtatatctatctatctaactatatatctctatataattggtatagttggctaagtgacagctgaggagccagctggatcagagttcaaaataaggtgacagtctacaaatccctggaagactggagcaacaaaagagggaatcgttatttggacacagtggggaaagtgaatgaaaagaagaaaggcaaattaattaagataattaaaacacagacattcttggcaatattgaaagctatttaatatttggctttctaactctactattcagtcatttacaaaatatggcttataatatgtcaattgatgaataacctttattttactataaaattcatgaacttctttggtctacacaaatccatcttccattttccatggcttacctcatttaagccaatgcaaaactgaaagtggggaaaagaatattgaggctttattatgaaatgccttctcatccacttttttttttttcagtctccctgtgttgctcaggctggagtgcattggcatgatcttggctcactgtaacctccgcctcctggttcaagcgattcttgtgcctcagcctcccaagtgactgggattacaggcatgaactactacacccagctaatttttgtgtttttagtagagacgggatttcatcatgttggccaagctgtactcttgacctcaagtgatctgcccaccttggcctcccaaagtgctgggattacaggtgtgagacactgcgcctggtgtctcaccatattttttgagggttgattatattttccttctaaacatagattccttaaatgactgtcattctcatcttcctttttctgctgtttagcaggctacctggaaggcagtactactctgtaaatgtttgccgaatagtttttgaacaagtatgaaccaactatattttaaaagtaatttgacactaactttgtattcagataacattgtagtatttcataatttattacctataccagtaatgtgtatgctatttaataaagacagaatgtggtgatgtgtatttaaaaacaggatttttatgactgatgtgtgctgggtgattttcctagggtaattaccgaattagttcttttggaagccactaggagctgtgtttttatgtgttctgatactaataatttctgacattggtttaatttactcttatgttagataaggtccaaaccatctaaaccagggtcagcaaaatagttaatatttttggtcttgtgagccatatggtctctgtcacaactcttcaattctgccatggtagcttgaaaataactatagatcttacataaatgagtgagtgtggctgtgttccaatacaactatttaagaacctgaaatttgaatttcacatattattcttctgttgatttttttttcctaatgctttaaaagtgtaaaaatcattcttagcttgcaggctgtaccaaaacaggtggcaggccagatttggccatgggttgtagcttatagacctgacatagtccacgtcatctattaagtgtgctaccagcagaggaagtggtctacataaagaggataatttctaaatcaagagtagccagaagagtggcttgtatatagtcatttgtctatgtctctatcacagtcataattcctttggttcttgttatttgtctttttccataggcagcaggtatcttccatgaaggcagagccatgactcattcttcccttgtgttcccagggtctagtttgtatgaatgtatgaatgaatacatgaatcaagtttacatctcagaaattggtgctgtggttactgaattacaaaatatgaaatgtcttttgagaaaatcacaaaaacaggagtctgcttatgccattatcccatttgctgtgagaccctgaacctatattctcactttcataaacaggctttgtataacatgtgaaagatagatgagtaaaagaggccaatttaggtagggaaatatacaaatcatttcagaaagacttccattcctattgactcctggttgccaagttatttctgttcttcccttaaaataaccagtcacgataacactctaaaacattacctcttctctcactttctccttttacagagggattgattagctctcagaaaaggtttccataaggaaatgatctcaaatacaattaggttttttaactaatgtgtattcatattattatttctgacattgatttaatccttatcttatttggggtccaaaaatcaataaggctccccccaaaatataatttgcctctttggttataagtatagaaacttacaacttttaaaaaaaaaatttttgtttcttcatggagtacaatgtagaaagccagtacagtccacctgttaaacatatgatagggtgatatgcccagtctagttacagaaagctcctggttaggacccagtaaaacaatcaaggtgaacttgaataacatctttgtgtacatttcatagtccatctattctaatggtccaatatacctatttttaaaaatctctttctgtgcctgtttttaaactcatttcttctcccaatgtgtttatccctggttctatcagggtaagccctaaagggacaatttggacttgaccctgatattggcagaagatagcttttctcctattgtggcctctttcctttagccctcgtgttatcctatcttgaccaagtaaaggttcattgtggcaggagtttacataaacaggaattgtactcataccccatttctaggaaaaatgggaacagcaggcattatctgatgtaaaatgtgttgaaccctgaacaaagtactcagtgtaaatccgcatttggctgttacaaccagccagctgagaatcagttacttgaaatagctgctggtcgaaaggtctgtggcctttccaaagatgtgttgttgactttatggcaagactactagaactttccttgttagtgattttattttattttatttattttgtttgtgatgggatcttgctctgtcacccaagctatagtcgaggggtgccatctcagctcaccgcaacctccacttcccaagttcaagcgattctcatgcctcagcctccccagcagctgggactacaggctcacgccaccatgcccagctaatttgtttttgtttttttgtttgtttatttagtagagtcagggttttaccatgtcggccaggctggtctcagactcctgacctcaagcgatctgcccgcctcagcctcccaaagtgctgggattacaggcgtgagtcaccacatctggcctccttgttagtaattttagaagaatgtttggatgccatctaatcctccctaagtcccagttatcttgtcttaaaaatgggcataatgtcatttgtcaaataagactgatattgggcttaaaagaagtcttttaaataaagtacttaggatagtttctcagattagcagatcctcaagaatgattctttttctctctttcgttttctaaatatccctttgaaatcttaattagtaagatgtctctttattaccaggttttatattgttgagtattttccatcatattattacttatgtatgaaatagttgagctctaattacaatctattttgtaattgtgcaaatgattcacaatgaagcttaaatgaataacttccaaatgtttgcacaaatatgatatataatacgtatatatattatatttatatatcatatatacatgtatatatatgtatatgtgtgtatgtgtgtgtatatatacacacacaaactaggtactgatattagacttacctgtggattataaatatgtcaactttctctctggtccattattattttttaatgctctcaaatatttctaaagccataagtatgtaggcttatgatggatgcatcgattttacatgaatatttggtattcaaactaaaggctatttaactggtttcaactgccttttattttatccagcttaattttatcttccttctgaggataattttataaacaaattcctaatatacttaataaggattacaaaattgggaacttgcagaatcatctggttctgagggttagcatgagatttttggaatatttgtctcccaaggatacattaacctatctcttaaatactctcaacaaagaatattagagtcgttagacaacatttaaaattcaggcctatctgcccttccagtttcaagttggaatagagttgtcttccactggggaataatttgtctctattaattgagaacaaatgtgcatgggtgttttaattacacagtaaattaggagaatttaagatgcagaatatgtgaaagccaagaattaaaaaccaacaacccaaaacataagtagataaacaggaaaaatatctcagcataagaatgcaagcacatcccaagataaagagtgggaaaaaatgaagaccaagacaaattactagggttttggtcaagttccttcaagtggaatgatcccatttttggctacaagccattgttggctatacatggcaggaggaagaaaccacactcaaaggattactttgagatgtctggcttcaactagtgaccttttatgcattcagtgaaaatgagtattgaggatttcctatacaaatttcaactttacagagaactcccacagcaagtattcagtctaggttcatggaaccctggtactatgtgtaaagttgtatggttatgagtttatgggggaaataggtccagaacgttcttagattctgaatggagtccgtgatcctaaaatataagaatacaacctgctgcttgagcagggtgaacatttgttgaccttgttctctgtcacttaagataagtaaagttagcatctcataaattgttactactcctttttttttttttttttttttggcaagggcagtcagaatgacttctttctgcctctcacctcgctgtgcatgccagatacttccaaccaaacttggtgcttccttgcaagaccaacctgctactacttcagagcaccctcctctatctcttcttactataatgtatttagatatttcttatttttttttacattgccctaggcatatgagcctttactgtaagctaccttaaatcttttttggaaagaggtaggatataaattaaacatacacctccccaagatctcagagtgttgatggactgattacagagacggggagcaggtatttcctcattcatcactggaggcagaaaaatcacctccaaatatttgttctctgatagcagttgggaaaagtcctccttaaatgagaggcccacgaagggatgaatagggattttggctgacctccaaagtgaagctaagataatgcctgccttcccagtattacttgaggctaattactcagatataattacttgcactctgtgtttttgcttccaatagggttgtgtccttgcttttgtttatcttgtatcccccattagactttgagctctttaagaattaaggctatcacttcctttctattcatcatttgttcttgaggcaatgcttttcacagaatagtcaggaatgccatttaagttaatgattaagatgttaatctcacattgttgcaagttaggcaacttttgaccatcctttctaggaaccccaagttatccgcattgtgaaggaccctaaagtgagcctcaggagattgtggtgaaagtgtcatcaacttttggaaagtttctgaacttagtgatgatttgtgctttttcaggacaatttgtggtgccagcacttaagcgataaacatccccctttaaatagagctgatcaagtttaattcacagtagtcgatgcctaaaaattataggatgcagatgtatatttttcatgtaaacattacctcaaaagaaattaaaggaaagaaagaaaaaagtgactttggataaatgtcaagtatatataatttatgtgtttgagctctgaacaaactgctaaatcgtttggccatagttggagagacagaacattttacctgtctgtagctgggaatcaagtgtatttacccacaagagtggcttatttcctagtttatgtggattacacacatctgtgtgtaatcatgtctgccctttcctctgcctcaaatcctaaatggaattaataacttattgtggtcccttttaacaagacagaacagatctctctgcctcaggcttaggaggctcctttataataattcttggctcgggtaacccatatactcctcaaaaatccgccccataaatatcataaaactggcctcaaagccatccacgttttcctctgtaaaatgaagatgaagcaattgtggaagaaggaagccttctcaaagagaagccagaagtcaattctgtttcattcctccatataagtttcactttccccagaggaaggtggaaaatccctccgaacggtgccaggtggtggtgtaagcactgatggtgaagttcacgtgggaacaggagaagttaataattcagaggccgtgggccctcccaccctgccctggatcaatgcctgctgtttgctgaaacaagctaggagcccacgactggtcctcgtgtataggattggctccatttgtggatgacgcttttgtctgttttccatgctcgcccaagctacgtgcctgcccgctcctgtaggttgctcagcgccctggttgtgtcttggcaggccctggtctgtctgtaccttccttctctgtgaccagcttcaggagcaggccccggagagtgctgggattaggcgccacaaatgcttatgtaggactttactgtgcactaagtgctttgcagtcccttttattcgtcctccctcagagcgttgacataaagtaaaaaacaaaaaaccattactcaagtctttatgccaaggggaaaactgagttagacacagtcaaatatgcctcattagcaaatgcagattaaaatgaagaccctctagaccccagtcatacttttgatattagattacagtttcctcatccataatacagtaatctaggccaggcgcggtagctcacacctgtaatcccagcactttggaatgccgaggcgggcagattacctgaggtcagaagttcgagaccagcctggccaacatggcaaaatcccgtctctactaaaaatataaaattagccgggcatggtggcacgcgcctataatcccagctcaggagactgaggcaggagaatcacttgaatccaggaggtgaaggttgcagtgagctgagattgcgccattgcactccagcctgggcaaaaggagcaaaactcgcatctcaaacaaaacaaaacaaaaacaaaacataatacagtaatcttgtacattgatatttttcaaatattctgtagatgtagaatttcatgggcaagtctaacatctgaaataaataaccacagaccaggcgtggtggctcacacctaatcctagcactttgggaggctgagacggacagatcatttgaggtcaggagtttgagaccagcctcaccaacatggtgaaaccccatctctactaaaaaatacaaaaattagctgggtatggtggtgggcgcctataatctcagctactccggaggctgaggatggagaattgcttgaacctgggaggcggaggttacagtgagccgagatcacaccactgccctccagcctgggcaacagaatgagactccatctcaaaaataaaataaaataaaaaccacagagcacttcaactggaagaggaaagtggagtcccctgatccttaaacttgcccccctttgcccaaatggcatcaagagctccgtggagtccagcttgaaaagaactagactaaaaaatcaccagggtctctaagtgctaaaatggaacctcagagaggggtcctgatgatttgattgaggaagggtgatgtacaggggttacaagcatgggcatcaacacccagctttaccaacttgctgtgtgatgttcttaacttctctaggcctcagtttcctcatcaataaaatggggactgtaagtgagatgatcttttttattttatttttttcttgagacggagtctcgctctattgcccaggctggagtgcagtggcgcgatcttggctcactgcaaactccacttcccgggttcacgccgttctcctgcctcagcctcctgagtagctgggactacaggcgcccaccaccgcgcccggctaattttttgtatttttagtagagacggggtttcaccgtgttagccaggatggtctcgatctcctgacctcgtgatccgcccgcctccgcctcccaaagtgctgggattacaggcgtgagccaccgcgcctggccgagatgatctatttttttagcactgagcatagacctggtccatagaggttctcagaaatggtgatattattttcattgttggtataacaatgtcaataataattgctgtactttgaatttgggggataggcttagaaatagcatcagtaatgaaaattgcctgttcttttaatatgtgtattcttctttaataagcatttcaaccatatttgagtttttccaattttaatggaattgttctgtcttaaaacctattgtgtatgtgtcatgcctacatagtcttctgtgcagagtacggtcatagccgggcaaacctgttatctaataagaatgttcgctttttcacattcatcagtcagaaacaaatactaaataaacagctctaaagagtagtaccagaacaattaagttaaaattaatggagcactgagacaatatatgctgcctttggggcattaactccgatttcacttttttatttgtttttttggagacgctctgttgctcaggctggagtacagtggcacaatcttgctcactgcaacctccgcctcccggattccagggattctcctgcctcagcttcctgagtagctggaattacatgtgcccgccaccacacccagctagttttttttgtatttttttgtagagacggagttttgccctgttggccaggctggtctcctgacttcaagtgatctgcctgtctgggcctcccaaagtgctgggattacaggcatgagctaccatgccctgccagattccacttcttttacagtagttaaaagtagaattaggagagagacaacagataaaaccagccacacacttttgatctcccttctgtctttcatacggaaatgagagtttctgagaaaggtagttgaaactagacagcagataacagcctatggcgcatacagagggggtgggagggtgaaaccatacagcttggtgaggtttgccaggagtacctgctggggccctggcataggtgaccctgcaaccaaaacaggaatgacactagaagaatgaggcctaagtaaccagcacactgttaaaggaggtgggaatatcacatcccagctacgcacttcctgccccaatatctaaaggttatttcatatggcaagctagaaacaaaatacacacgtacattattacacatgtaatatcaatggcaaaatttaaaatcactgataattttacctctcagatattcctggtgattgtgatctgtgtgctcatatgctgatatgtacaccacaggcatgtacgtgcaaacactcacatgtactttcttttgcaggaatatcatcactgcctcctaaagtgcttctttcacccagcagtctactctaggcagtttccattctactgaatatacttgtataaacacattttttttgtatgtgactatatagtattcctttgcataaatatactataatttatcaaataattgtatgtcatttggttgcaatatgcattgttacaatcggtgctgtgactattataatcatagcatttctttacaagcctcctcaggtatttccataggataaattgtcaaattgccttccacaaaagacctcccaatttattttcttactagcagtttgtagtagtgtctgtttacccctactcttgccattatcaggcaatgtttacattaaagacttaaaaccattttttaaaattgcctaaataaatgcttccttagcaaatactctttaaagaagaaagtagttaggttttctggctaaacttcttagggcttctacatgaatgttttcacaaacatccatttcaaagagctactggaaaattggatatggactattttgctttattataaatgtgagtagcaacaagattctttgtattcaaaaagacgtttgagagtttctagcccaatggcttcatgtgccaataatctatgggtccaagaagctctgtatttccccaggatcactttgactgctacgtgtcagggctgggagtagaccctgggccatccaatttattcaacttgtagaattaggatcatagcgttagtatatatcaagtgtaattttcattacatatgaatgtttaaaaaaacattcaacagaacttgttggatatttgagtataatcttctttttctttttctttcgttttttggagaccgaatttcgctcttgttgctcagactggagtgcaatggcatgatctcagctcaccgcaacctccacctcccaggttcaagcgattctcctgcctcagcctcccgagtagctgggattacaggcgtgcaccaccatgcctggctaattttgtatttttagtagagatgggctttctccatgttggtcagtctggtctggaactcccgacctcaggtgatctgcccacctcggcctcccaaagtcctaggtttataggcatgagccaccgcacccgtccttgagtataattttcttatcatttactcctaccagcctctgtgctaggttctgggggtataaagacaggggccaggtctgcctttcccctacattattacagtctcataaggaagaaacccagaggagtgatgataaatgtatgcctcaagtatgtagtatataggtggtgcagttgtggtctgtgcacacaggtacaatgaggatgcagcaaaaggtctgattcatttgggttacagacttaatagaaggaatgaagcttgagctgagtttaaagagtagaagaattggattttaatatatggatgggtcctccatgttaaaattaatgaggttggacattactgaggctaagacggtagcagcaggtgatgggaaggtcatcagtgttggggcccattagacctataactccttgaacaacttactttgatcctcagttgtcccatctgaaaataggatgatactgtgcattccacttgtagaactaggattgtagcattagcacaggcagtgacagtcatggcattcacagtgtggagtgacacagcaagaggggtgaggctgcccagccatttgtacgttttgcctgtaggtcttaaactggatggcaggaggcttgaagttgtgatttctacctcatgttttcattataaaatgagtggtcacttgaagaaaagtgacagtgagttttgtgtttgaaacttttagaaggatccattctggaataaccaaagatttaacatgagggtgtgccatgtatatgaacagagctcttctgtgccaggtctcttaagaaggctggatgtggtttgggctgaaaaaatgatcactcaccatcaaccctttctgcgctgtgtgtggcgaatgcctgggtttgccttcctgactactttgcaaagtgtgttgctttttctgcctctgttgaatttaccctttttccaggttccactctcactaccctagatccagccttactggaggctgcacagaccaccagctttctgaactatgggcctagcctattcccccctccatatgttatagtagcaaagtccctgctttaaaattttgcagcttaggaactctgattttcttatcttcctctaactgtccagtggctgtgtatttcctgcataataaagatctgaacatcttaccatgatacgtggtagagctgccggcattcatcagatattcatgcctggattgcctgcacatgacaatctccctactttggttgctgctcccccacttgcctctgacttaggtagggttccctagaggagtcccgagacggggtttctcatgcaagtgacttattgagagaattatttctttgtagaagccagtaaaggaatgtgagaagcaggatggggcagggcaggaagctggggaaggatgtgggtctagttgaagtccaacctccgccttaacccctggggaatctgtagcatgaatggcatgtatggccccatggagacccccatatcagtcagtaactaactggctgtaggctgcctttgggtgggggtaggtaattacccaggcatttcccctgcaagatcccagcagcctaggggtgactgcactgaccaataaaaggaatacacgcaggatgccagcagcttccattgtacccacaggtcaaactcctactgatccttcaagacccagacagatttcaattttgtaaagtttttcccagaccagaaattctcattctgaactaatgatgttaccatctcccgagtcttcttatgcctcattctaggccttatcaagatcaccttgtatcactgtggattggcttaatgtctggcttcctgctagactaatgagtttcttgagggtgcagcgtgttttaattcacctttaaatagctactccccagaccccagggctgtccctgtgtagctatttagtaaaggtcgtttgaattgaaatgagctgtaacatccttccttgatgcctagtgcttttagccctgtgggaatgtttcttcaagccttccagatacggggggctcttccaggaatgctagctcagcttgccactctttccaccccaggattccatagccattgagattataccacaggttccctgtgccagcattttcttccacctgctcccctggatgtcagtctacatcatctcaccagtcggcctatgtcatctcactagtcagcctgggcaggtagcctgctgtcatctgctgtccacatgggctgggccctagggtagatggcttgaaacaagtattacttcttggatgacattctggctgccactcagaatctgacagttggtaaatcttggcctgtgctattgaatgccatgacttattggtgtaatggtgaaaattgttcagaggaagactgggacatccatggtggacccaagaatcatgtcaggggatggaaaagggccaccatgtcctagtttggtctagaactagattctgcaagttacagtcacaatccaatagccaaatagaagcactcattcattcattcattttctcaacaatcttctgtttcttcttttctatttattgtgtgctgggtgagggcaaaagtgaataagatgtggtttttgcgttcaaggaattgacaagggaaggagatgagattgagacagatgtatgcacaactcagaataatgaaaggaataaaggatatgcaccacaagaaagaaagtgcacaggacattggttaagaatgtggtatctgaagttagagggccttgaagtcaaattccagctccattagttatcagttgtgggactttaggcaagtaatttaattttctcaccttcactattattcttttttctttttctttttttttttttttcagagatggagtttcactcttgttgcccaggctggagtgcagtggtgcaatcttggcttactgcaacctctgcttcccgggttcaagtgattctcttgcttcagcccctcgagtggctgggattacaggcgcgcaccaccataccctgctaattttgtatttttggtagagacagggtttcgccatgttggtcaggctggtctcaaactccttacctcaggtgacccacctgccttgtccgcccaaagtgctggcatgagccactgtgcctggtcactatttttcatcttcaaatggaaacaacagtggtacctgcttcatagggttgtctgtgaggattaaataagatactgtctgtgtaaagtacaaattgacacacattcacagatgttggctgttgttatgaatgctattattgatgggctagttcttgcagggctgggggacagtccatggaataggtggcatttgagtggggctttgaatttttacaggcaagggaggcttccattggggggaaaaaaaaacagcttgaaaaataaaaggagggggcatgagattgtataacttacttgggaatggcaaatggccgtgactgcctgggatgtactgatggatgctcgaagggtttccgtgggagctgaggcagtgaatgtgtgctaggatggagtgctttgcaaatagtgattattcaataaatatttcttgaatttctttgattattttatgcttatgtgttaacacttatttatgataaaaatgccagtgggcattgggtccaaatttatcttattgaaaaataaaaataattatgagtatgcctcctttaacagttatagagattggcacactcctttttaccattgtaaagaaaaataactgctcatcctcagctattttttgaccctttcatttgaagatgtgttatgctatagattatggagctgtccaggagaactttctgtgatgccagaaatattctctatctttattgtccagtgttccagccataagccacatgggactgtggagcactcaaagtgtggctagtttgactaagaaactgaattttaaattttgtttattattattattattgttattatttttgagttggagtctcgctttgtcacttaggctggagtgcaatggtgtgatctctgctcaccgcaacctttacctcctggcctcaagcaattctcccacctcagcctcctgagtagctgggattacaggtccccgccaccatgcccagctaatttttgtatttttagtggagacagagttttaccatgttggccaggctggtttcaaactcctgacctcaaataatcctcctgcttcagccgcccaaagtgcttgggttacaggcatgagccaccgtgcctggtctgtttaattaaatggaagtcaccccatggggctagacaagggctatcatagtggatagcactgcagtctagaaactgttctggatctctgtagaggaaatgtgcgaatgtgaagcattgggtttggaatagtgtggggcaaatgagatatttcctattgaggtgtctggtactgcagtttcagaagtgaataccctcaaaacgagctgtttatttttatcagttttgttttggagaatattcaggcaatctgtgactagagtgagcagtgctccaatagagtgctttgagaaataccaggctgattacagacccacaggaagcaattgtcataattaggccctgttaataaaccatgggctgcaatgtgtgtacacacacacattcacacactctttttctccttctctctcactgaatccagtgctctctctctggcatgtagtgcataagagttatttttcttcctgatctcagttttccaacaaatgggaaaatgctctgaacgcgttgcatacaggggaaaaaccttacagtctttattgtatgtgaacagctaataaggaaaccgtttgacaagagcttgctttgtgtcatggcttctggcttccagccagtttattttcttgctgggacaactatattcaggcagcagagttaagcaacagggagggggcaggatgaagaaacacagacttcataaatcagggcgattcagcaaaattccatttgaattgaatctgggccaggggcaggagtgccatggagcgtctgtgtagaagctgacattttaatgatttgattagtttaggaagaatatttttatggattgtgtcctcgattatattaagtactgagtgaacttgttacattatgatgaacttccattacctacactggttgtgtacaagtgcaatgatttcagcccaagaccctaagggtaatctcgtgcaatcctcttaaagaaatgctgtttaatgactaaagctgttaatcatattaaatacatacagccactctgggaaaatatgccaaacaagcataaatctaaaaaaggtatttgaaggagctaaatggtgtgttttgaggggatattgggcaggggaagtaataatggagggagcgaagggatgtagagatggaagaagtcataataggtacagtgatggtgttttccatctcctgtgtggcaggtgctgtgttgaatgggttaatcagaatgctctgggccacatctagaagacattccaactcaacatagttatttatttatttatttgtttgtttgtttatttatttattttttgagatggagtctcactctgttgcccaggctggagtgcagtggcatgatctcaactcactgcaacctccacctcccggtttcaagtgattctcctgcctcagcctcccaagtagctgggattacaggtgcgtgccaccacgcctggctaatttttgtatttttagtagagacagcgtttcactatgttggccaggctggtctcaaaatcctgccctcaggtgatctgcccaccttggcatccgaaagtgctgggattacaagcgtgagcctccgggcctggcccctcaacacagtttaaacaaggaaaacttatcttcctaaaaatagagaagatagacagttcccaagtggtgatggtggtgtattttgtttgtaagttaatcagcaatttggtgatatcagggttctaggttgacttctctctgattctcttggttttctctaatttggtcatttattgtgatatttaagttaacaagtaaaaatggcagctgcactcacacttcttaaccaatggaaatttatttgactcacaaagtgcataggatgggagaaatctccagtggactagtggagtctgtgacagtggggtatgtggagtatagatccacaggctgttggaataggctcaggtcctcatctgctcagaagacaggcagggaaattccagtcttcaagggttttgttggtgaggagaacatggatatggatgtaatgtccttcccttttgttttctttgcacaaatttcagtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaatatagcagtatattatagaatttggtttcattaaatattatacctgcccttagtgtttatattccagtatattgacaacccaggtcctctctgtacctgtgattgtctgtgttgagactattacagagctccaaaaattaaaataaaaataataattttacagaaatacatatttgcattggaatatttaagaaagttgagtttggatgccacaagattataggagtaataggaagctgggcacagtggctcacacctgtaatcctagcactttgggaggttgaggcagtgaggcaataggattgttggagcctaggagtttgagaccagcctgggcaacatagggagatcctgtctctacataaagtaaatttaaaatgaattagctgttggtgctgttggcatgttggtgcatacctgtgtaccaggcgtgttggtgcacacctcccaaccacttgggaggctgaggcaggaggatcccgtgaacctgggaggtcgaggctgcagtgaatcatgatgatgtcactgcagtccagcttgggcaacagcaagaccctgtctcaaaaaaaaaaaaaaaaaaagtgatagataactaaccaggattttctggatttgggtttgggaagtggaggaatgcctgtgtctgtgtttagaaatgacaaaccaaaccatggacatgacactattagctcctgtccctacagctgctgtgttgtttcttgagagcccaggatgggtagtaggcctctttaacctccgttatcacttaattctcaccataatcctaggagatgtatatgtcctcattttagagataaggaggacattgaggccaagagagtttagtaagtaacagaatggattttcaagccaggtctgtcttgataagaaagctcacatgctttctttcttatgacactgtttaagctgtgttctgctaagttcctaagattctctaggatagatgcatgtgtaggatcaattcagggcgaaagggctggagtggctttgagattcccaacctctgctcctaactggttttctatcctgagtttctgcataccattttcttggaagaagagattctgtgcttaaaaaaaatacgtacataaaagaagcgtgcacattgctgtcctgtaccgcagtgcctgagtcaggtatccatttgcattgtgaaaggagcctgaggtgtgaaacagttctgggttctttgcgcacccagctggctggcttcctgtgaactggctgcatttcagatttcattctctagccagaagctgaaaggcaggagccctttgaagagatacagggaagcaaagagggttatccagatgagaaggaagggaaagggggcgtgacaactccttggagggaatttccccagtgggaactgcctctggaggagcttacacagggcacatcaatgggaaaccacgtcctggtctgctcggaagccctggggggcctcttgcaacatgcaggcaggctccccagactcaaccctctctctctaccagaggcgcatggactgcgcctgcttcccccttctcttataaagccagctatgggccattctatccctctgcctccctggatccttcgtccatgctgttcctgaaagcaagaaacagtccatttttttttttcatttaatacttttttttgctaagtgctgctgggaaacacatggaggagaacaaaacccgacaagcctggtgctgctcttactgtatctgtggggtggggaatggggaagttctgaaaatttacaggtgtgtctcagactaaagggtttcaaaacactgtgctgaagcagtgcgtgttgaggtagaaggcacaggagtgttcctgtggttgggagagatatcctgtgtccagaatttgaggcaggagatagaggttttgctggtgggattgtggtgagactcctagagctggaaccaggagagggggatccattgctctgtgaagagggcatcttcacgtggagcaaggctggacagcaggagcccactagggacccctgtgagcaggcgtctggacttgtttgtttgaaaacaattaagacgagcaatgtgatgtgaagcattcagagtaagggtagtggactggattaaatagaggggcagttgtatcatctttctgtgccccgtgcctcctgtttcttccttcatttgttcattaaacaaatgtttattgatggtttataatgtgccagacttgcctaggtgcatgggacgcagcagtaagtgagaccaagaaggtcccagtactcacggtgcttatattctagtagacagtgaataaataaacttgccaatcaaatctctgccatagctctcatcactttcagacatagattaaaacatctgagagtgcctgtaatcccaacattttgggaggccaaggccggtggatcccttgaggtcacgatttggagaacagcctgcctaacatggtgaaaccccgtttctactaaaaatacaaaaattagctgggcgtgatggtgtgcgcctgtaatccagctactcaggaggctgagacaggagaattgcttgaacccgagaggtggaggttgcagtgagctgaaatggcgccactgcactccagcctgggcgacagagcaagactccatctcaaataaaccaaaaaaaaaaaaaaaaaaatacccagcagaacatctgagagtgataagagctatggcagagatttaagatagttccatgaatgctagaaactgactggttctaaaagaccagaagacctcttcaagagagactttggaggcgaaaagtgagtgtagcatagagccagtcttgggaggtttggggaagaacataccactgagagagagcagccagtatcaaggccctgagacaggtgagagctttgttcaaggaacagaagggggccagtatggctaggatggagtgagcacggggaagatgttaggagcacgttaagtttgcattccctctgggtgtccttggataggttactcagccactctgagtgctgccctggcagccagctctaggcttcactgactggagtttggctatccttggatggaaatccaagctcttttttactttacatttttcattttgattataatcaaattaagaacagtcataaaagtattttctgggtcatctcgatgaaactagcactaagcaaagccatggatttcttaactctgtgcaggtatgttcctataattgtcatgtgctaaaacgaaggctcaggaaatccaaaagatttttgcagtatttgaatagaaaaaagaggggtggagggaagtgagtgtgggacagtgaggtgtgggcagacccaagaaccctggtgagcgggcagtactatgtttatgttttgagtgggattcccatttttacgtaacagcctcctacatttgttagaagtagtcttagcagttgtatggtatagcatttcccttcctgcccccagactcagtaattggtttagatgccatttaatgcagtttttaattcctcaaaactagtcttctgtgaacaaaatatcttttcagatttaccaggtaaatctgtaaaatcagtatgaagggattgctccccagccagcatttggttaagttgaattctgattatccttaacctgcaagcaaagctttgaagttcctaataacttttctgttcaatagttttcatgcttatgtaaatagacactctaacatttagaagttaaagcacccccccaaaaacctcaaatatataacttggcctgagactctatttttctactgcaaaattcaatatggacaattgagttttagtaaaactacgtaatttcgaattgaaataatttaaattgcttttgttttaaaaaatttgtatttgtgcataataagttacatttcaataaaaataaagtaaatgcattcacttgacttattttccgcgtgggcattttcttcttcatatatggtccataattacttaagcttgagactcactgcttcgacttgcaaacagaacatttcaagtgatcaaaaatctaggacccagagggagtgaatgcacaactttaggattctgaccttagctgcaatagaaaccttgagtgacttttaaggctatgatgtcctggtaaagaaatatacctaaaacatagatggatatgataaagtaatggaattttgcatcatgcagctattctctgccagcatgtccggcaacagacatctttggaagcatatttttgaaaataggtatcctcgttctcttcatatcattttattattgatctctgaaagactgataaccttggtaaaacagccagctcaatgtgtagccaataaccacgcctaggtgtctggcttccccctctcttattcccacctcccccttttccatctccttctcttcctccttccctccctctctcatagacctcccacacccccgccccacacaaaatatatatatcattgtagtttataatttataaagatttatcaattgctaatatatcagttatttatttatttatttttatttctaagcatgcctcctttgaagggcatatgtatgtctgtgtgagtatatacaggaaatgtatccatgtctggaaaggggcctccatctagacgccaagtgagagttcttggatcttgtgagagaaagaattcagggcgactccatagaataaagtcaaagcaagtttattaggaaagtaaaggaataaagaatggctttccaaaggcagggcagccccgaggactgttgattgcctatttttatggttatttcttgattatgtgttaaacaaagggtggattattcatgagttttccaggaaatgggtgggcaattcctggaactgaggattcttcccctttttaggccatataagataacgtcttggcattgccatggcatctgtaaactgtcatggcattggtggaagtgtcttttagcatgctaatgcaatacaattagcatataattgagcagtgaggatgactagaggtcacctttgttgccatcttggttttggtgggatttggctggcatctttaccgcatgctgttttatcagcaaggtctttgtgacatgtatcctgctgatctcctatctcgccctatgactaaacacaactaaccttccgggaatgcagcctcctagtaggtctctgccttattttacccagcccctactcaagatggagtcactgtggttcaaacacctctgacaaatctgtctgcctgttggaaaggactttgtcaacttgtcatgttacttatataaatatagaaatatgtatttaaaacttgatggacacttcaccatcacactctcttctcctctcccacatcactctagcactgatccatttttagaaaaggtttttttggggatgggggttgaccagatgtggatatttagagataagtctataatcttccaactgtagaagtctttatgtctttgagtcttgcttgtgtgtgtaaatgtcctatttttttttttgatatatgaataaagtaattaatttgcatttagttgcttaagcctgtcttcatagcctggggagaaatgatggctgacacttgtcattctccacccttccgctccccacatttcatttggtacttcatttcttcctcttgaggtgtgaatatctcaagaaagatgttgactggtcccactggttgggatgacaatgagtgataggtagtcttgcacttcttgatcaatgacaagatcacccatttggcaaactcttcctcttctcttctgtctttatttttttttttttgagatggagtctctctctgttgcccaggctgcagtgcaatgtgcgatcttggcttgctgcaacctccgcctcccaggttcaagcaagtctgcctcagcctcccaagtagctgggattacaggcatctgccaccatgcccagctaatttttgtgtttttagtagagatggggtttcactgtgttggccagggtggtctcaaactccttacctcaggtgatacgcctgccttggcctcccaaagtgctgcgattacaggtgtgaggcaccacgcctggctgctcttacacttttctatgagacacattacagatagatgcccatattgagatacatacccatatacggatagatatccatgctgagagaagcatgttaatccggctgtgaaagctttatagttaggaatttctgggaagatcttcacctttggcatactccttcagtctcatcccctatgtccctaatagaagcagtaatggggaatctgtcatgatgacttactagaaaaatctattgagcctgcttatgattctttggttttggaggaggagggcactaattttcattggttcattcattcaaaaatattaagttcctactccatgtctaataactgcctttctggctagtctgtgagcatggcaacggacggatgatgtcttttgttttctgttgtgtctctgatgtctttcacattgaagagcagggaggaagtgctcgtatcatatttgtgccagagtgaggaggaagagggaagcactcagagctgacacttcctgtgatttagccttctgcctgtggatcatcttttcatcttttttgagctcatgttagtttctctactacctgtgcgtttctttaccttccttggagtatttcttccttgagctcagtgttgcaggcactgcttggtcaggcttagcccatagacagaaaatacttattgagtacttactgtatatatagcactcttccatgcactgtacatgtatgaactcacttgctctttccagcaacttaggagatgtgtgtcttcattatcaccccaattgaagaaactaaggatgagaaaggattcagacttaatgcaaatgatccactatctgggaagctatttaatcaacctgggctcaattatttctgttttctatttggccgtgggcttttgggttgtttgttttagtgggcacagaactcaaggtccttggctttttcatgccctttttcatcggtgtcgtaagtacttgctccgtaaggaaatgattttaattttacttttctctaaaagtaaaaaaatcctactctgtagtgtagtggtttcatcttttttttttttaatattgactgacatgtcaagagaacccacaggctttgcacatacacttttccagtcattgcttcagatatcacatccagtggaaattattagatgtgatatctgaaccagttgcaagcaagatctctcagcctccttcaattgctatgttccaggtaaatgttattgctgtgattatcatcatcgtaattattttgcattctctgtttagtatttttatcagaacagcattctttccttgaaagataaaaactattgaagattttaagaaagtttgaagcttgttaaggaaactagtaactaaaaagtttaagattctgtgcctagtgggacataatttgttgttttattaccttttgtatttgctcgtgcatatgtacatgcctgcattcaaccaaatatttgttacatgccaggcactgtggacaggtgcctacttaaggtaataggctgggcagacagactcccaccctagttcatcacactcattcaaatagaatttctagtggttgaaagagcaatggccttggttttaccctctttgtcaggaactaactgttcattctctggtgagtcacccaaatgtcctggctcttcacctgcaaaatgagtccattggcctagatgttctctatcaactccaaaggtctaagatatgtatgataaagggtatgccatccagtgaagatcaacagtatcattcacagcaggcctgttcaataaggaggaagttgccatctcaactggaggctgtactggacaaataacattcactattctgcctccaaggtttctcatttaaccatgggagctaatatgaaaagaaggtgttcctaagccagtgagattaaggtttgcaggttttagcctgcaagcaggaccaactaccaatttacaggatctagcacaaaattaaaatgtggaccttttgttcaaaaattgttcaggatttcaagacacagcagagcattaaacgaagcatggcacccttctgagaagacagggctctagtgtcaccgtatgggtcacaggcaaacaaagtcagccctacctgtaaatggatctgattaaaggcagaagtatctttctattttgtaagcagattgagtggtatgttactgtctcacaatgtgttattatttttgctgttatgactaagattattattttaagtgacagtacccctgtgcccatcttctcttttgagagtctgaatcccttcagataaggactacagcttacctaatttgtgattttcccctcagctagactactgacatgatgtgtttgttaaatgcagtgaatgtaatagtcatttatcacaaggagaaattgtgattttttttttttcccccagaggaatctagcttaaagaagccaaaatagtacttaataaggtgtttgtgggaacagagatggaccattggatgaaatgctctgaaataaaactaggcctatgcagtgtaaaaagactaagacagtgagtttctgccttttttctttttttttccaaaaaacctttttgatgtaacacaagtcagtatttttgttgctagttggcacttcatgaaagatgatagccggctggggagagccaagaaaaatcagtgagtggaattgacagacttgcagtgtttgtaactctgcctttatcctgtgtgatattttaaataaatggttttcttatgtaggggacagttattactgtgcctatcccacacagcagagaacccaaaagaggacgacacactgaaggagtcataaattgcacatgtaaacagctggacatttgggtgttggtgaaacctctgagatgagacggatgaaatatgttgagacattcaaggcttttgttgctagtttttttgtagaatttttagcagacctttaaaccaagagacactggcagtgcagttattttcaataacctggactctccaggaaaatttagaaatccatccaaatagaaggtaaataaacatgtttataggcaaagccttttatataagcgtttttgttgggtctgaatctttgatgctgacagagttgaactgtctgccttcttgcttttccttatcctgtttgtcatccgctatgtggcttcggcttcagtgacccctctctccttccagtttcctagaagcaaattgcccttacgagcgaatgcatttgggtcatttgaatttgctcagtcattttggcaattaatgactttttgtggattcagttcttgggcacctccgctgcatcccacttctagccatgactccctgcattagtgattcagcctgaaagaaaaaatggcttttttaaaaagtgggagaaatttatctgaagagcaatcagttagatggacatggaagaggccctctctggggttttacctggtctgtcttaaaaggaactcactcgagttttaatccctaggattataggctgtaaagcaatggtcagcttagatccatttcagggccaatacatctgtctaaaatattttgaatacaagaggagaggaaggatagagaagcaaagaagtttatgactcaaatgatctagagaataatatcaaagttccccatgacacttgcattgggattttactttgattatagactttatgttctttatgaagatcacagttcttctcagggcatacacatcaccatgctagcggctagcagatcttaggccaagtgcggtctcttctatggacttgattttagactagaggcaaattgcttaaccctttgggtcttggtttccttaactttaaaattgagaagccaaaagagataacatgcgaaacggctattgcaggatatgagggatgaaaacaatttcttgtttttttgtttgttcatttgtttttgagacaaggtctctctctgttgcccagactggagtgcagtggcacaatcttggttcaccgcagcctcaacctcctgggctcaagtgatcctcccacctcagcctccagagtagctgggactacaggtgtgtgccaccacacatggctaattttctttttttttttctttctttcttttttttttttttttttgtagagacagggtatccctgtgttacttaggctagtcttgaattcctgggctcaagtgatccccctacctttgcttcccaaggtgctaggattacaggtgtgagccaccacacctggccaatttcttgtttttatgtcaaaactacttcagatctgttctcataaacctggggtcatatggcttccataactgcaaaaggcttagaagtgctgtgaggtgatagcactctttctctgtaggctttttgagagcaagatacttttctccatgtacttctgctttatctttgaaatatgctgccaaatttcctcctgtaataaccgtaaaggtttgttttttttttttgaggtggttgcattgattcactcattcttcaacaattatgtgtgtgccagagaccatactaaatgctgtgaaaagagagatgaataagagagacacagctcctgttgtcacagatcttagagccttttcctgtcatatgaggaaagccatagaatataatccaggtgagggacagtgacaccatatttatgaaagcacttcaaatgcattcccatttccagcctaaagatacccactttagaatctgcgggattgggattgggatagcattatcgtggtttctttttacctaaaaaattacagttctatgttttggaattttttttctccatggaaacatgtcactaaatttataataaaagtcattttagaaccaaacttaacagaacacatacctgtgaattttaggttgttagagaaataggttgcagggtttggggcattctacagggagcccattacatatcaaaattgtatcattcatgtatacatttcaagaggcatttgcctatatacactactaataactcatctagaatataagattccttttgaactggcagactccaatatggggaataaagtgatgctcgtttgcctaatctttataaaacttggttaggttttatgcctttccaaactatactggaccagatgtctccttcctcttgcttttctgccctccaggtctgctgtagtgtagaaagcactgttcctctgaatttcctatttacctgttttggcctgtagtgataattatttttctctgaagtcgcacgatgatgtaaccaaggagaacaatgtgaggtcagtagtatccacatgacacagtaattacaggcaactgctgattgcttttgtactcagaaggtttggaaagatgtagcataaaggtgtaaacagatcattttcttttaggttttgttagcagtgcaatccaaagggattcccattcatttagcattgttcccgttggcttttatagcagccaaaaataaaaccccttgagtactactctggagggtagctgatgacatataaagtaaatctcttaattgtatgtgaactctagaccagattgatcaattccttgtatattctaatagtcctggcccagcaccatacatatggtgggcagtcagtaaatatttccctagtacagtggggacagagaagggaattttcccaaatcaggcagttttagagttggccatatgaatcacccagttattttcttaaaatgcagattgtgattcagtatatctaaggaaattctccagttctagcatgctcccacgtgatacgaattcctctaatccaagagtctactagccagacagagctaaggccagaacacacctattttaactcttagtctgggagttattctcagtatatcaacgatggtgaatacatgtctctgtgttttccttctcactcttactagacccataacactaattgattggtgaactcattcccactgagccaagatgcagctttggaattgttctcaatgtggtgctccatgcagcaagtgctgattcagagagtgttattccagtcacgctttggggatgagtggaaagttgggtcatctttatactccgtgttgcttctttttttttttttttgagacagagtctcgccctgtcaccccagctggagtgcagtggcacgatctcggcttactgccagctccacctcccgggttcacaccattctcctgcctcagcctcccgagtagctgggactacaggcaaccgccaccatgcctggctaattttttgtattttttttttttttagtagagatggggtttcaccgtgttagccaggatggtctcgatctcctgacctcgtgatctgcccgccttggcctcccaaattgctgggattacaggtgtgagccaccgtgcccagccgcttctttaagtcaagtaaacatgctgagaattcaaagcccttttcttcctccagtctcctcgagccacccacatccccctgctcactgtcctttttccttccttctttttgtgtttttgaaacagagtctctgttgcccaggctggagtgcagtggtacaatctcagctcactgcaacctccacctcccaggttcaagtgattccctgcctcagccagctacctggggattacagggacccaccaccacgcccagctaatttttgtatttttagtaaagacggggtttcaccatgttggcgaggctggtctcgaactcctgacctcaagtgatccacccacctcggcctcccaaagtgctgggattacaggcacaagccaccgtgcctggcagttttaaattttgggctaaatgacttttgctaaatcactttcctcttgcatcctcctgcttcttatatctataaaatgaactgcccatggacaattgctcaggatccaggcagtactagcattagaaagggttgcctctttagcccatgattagtccagtgtgggctctttgcagaaagcaatggaaactggttaactcaaccagaaaaagaagttattaaggaatattggacggtacgcagtatagacataatggttaggactgggctggagctgctgcctgagccctgtccagacagccgagatacactggatgttgggcagtgctttggctggacattgaaatgctgcatctgattggctaatttagtttccatttatatccctaacaaggcaagggaagagagaagccagcttctctcttgttctccttctataatgagagacaaaccatgcctctctcagacactcacaatggagaattcctcaatcctaagaaaggtggatcggttactgactgtgacagatgactgtcataactttcatgttcacggaaacttctttataaagtttctaaatgaaacgaaaacttggctaccaacctactctagtaacgcaacaacttgcccctctgttcttttgagttctggcttctgattgtttctcaccacattgtcaactccttgggaaagtactctgtatgttttaaagcaaattgccagggtttttgtttgtttgtttgtttgtttacttagacctcgggagataaaattaatcgacctctttaaatacatggaggtaccccctttctcgtttttgaagggagacacttgggaatttagaaattgggagtgtgagttctaagggctggtgtggtttagatagcccatgacagtttcaggaaggtcctggtttcctttcaagcaaaaggggccacctctgaaccaaagtggattatctcctgcagcagcaaatccagttggcagttgaattcctgcagttttatgggaatttcagtgaaacttttaaagctgtaatttttgtaactggagttaaaaaaaaaaaaagaaaacaaatctgaataaagcgacataatccattgcagagtctgtacagttctatttcttctatcatgaatgttttccaggcagatgaaaaaatgttttgaatgttgaatatatgcaaacattacaatcaaggataattgtgtctatgtgctttgactctcattttgcttttctcttccttcatcttctcctataccctataggaatgtgatcatagacatagaaatagaatttgcatttgtataaataatgcccaagctgtttggaaaaaagactccctgtattaggcacaagatttagagatggcattttctgcctcaaatctcagtttgatttagatcatggaaataatgccttttatctgtatggacatcagagtttactcagcccctttccctctgcccccttcatttgatctgcactctctaacctcatgaagttgtctgaactagtgttattattctcattttgccaatgagtgaatgagactcagaagaaagcatctaggttagagatttctaggcaatgtttctaatgtttccttcagtaaaattgttgttgctctatcaagtatatgagctggttgctgttttctgtctttgatgagtgacaggattcccttttatgtgtctcactgggtctgtctcctagaggcctcatgagacttaatgagtagtatctgtaaggtgcttgaggatccccagataaaaggagcacctgttagcatttatgatggaagtagcggggcctcttgaaaagctgtgcccttgttgttaataatgctggctagaggagttgcaggcgaggctttgcccaaagcctttattagtcattactctcaggaaatgcagcctcaccaggatgttactttgtaagctgtaatgcatttttgaaacagagaaaggaatataaaaaccaccctttcgatgcaaaacattaaaggatgacctgtgatggtgtattttacaaatttgaagatacaaacttgttccaaatgtacatcctgtatgtttagggagggacgaggggagtcttgtaaatccatgctggtggtggagtcctgcttgatgatgtgttggaggagcaaactggtggcacccaaggctctgttctgaagcagccactcctgttatcccagcacgattgtggctaagttatcttcacaggggtggtcaacttccacccagcacaattgtggctaagttatcttcacagggatggtcagcttcctcctccctaaagtaatcccgaagatgataatgctgacccacttctccaggaatttggaaagagtaactaatgagcgactgtaaggcgtattggtcgtgtaaaggcatgctgtaaacactgattgcaataactagtaagaaagcagcagtccctcttccttcccaggagagtttgcatgatgattattttctgtggtgtttgctttgttaaatgaaaatgttgcccgtgcttaggagataatgcagggaaagaacacaggagggatttaggaatgttttacttattggtaagtgattttactgttgaagtcacactacagatactgttaaaaaatttaaaaattgggccaggtgcggtggctcatgcccgtaatcccagcacttggaggccgaggcgggtggatcacctgagttcaggagttcgagaccagcctggccaatatggtgaaaccccgtctctactaaaaatacaaaaatcagctggtgtggtgccatatacctgtaatcccagctactcgggaggctgaggcaagagaatcgcctgaacctgggaggtggaggttgcagtgagccgagatcgcgtcactgcattccagcctgggtgacagattgagactctgtctcaaaaaaataaaataaaataaaaattgaattttcccatttctgttgcctctctctttgttctctctttaacctcaaacccctgttccttctcatcagctccaccatatcaactatcaacatgatgtggcgtgctcttgcttccagttaaacccgagaaaaagaaatcaggatttaaaattcttcttaacacatagtaaatacataaaatctacattcactgtttgtaatgtattatctgaccttctaaataaaatatagttgattcatttcatataatttggaatttaaaccaggaatatttatttaatggttagctcttggtcaggtgtggtagctcatggctttaattgcagcactttgggaggctgaagtggaaggatcacttgaacccaggagttaagaccagcttggacaacatggcaagatcccatctctacagaaattttaaaaattagccaaatatagtagcacgtgcctgtggtcctagctacttgggagggtgaggcgggatgattgcttgagcccaggagtttgaagctgcagttagccgtgtttgcaccactgcactccatcctcagcaactgagcaaaaccttgtctcaaaaaaaaaaaaaaaagttttaactcagatgttggccaagcgtggtggctcatggctgtaattcctgcattttgggaggtcaaggtgggaggactgcttgagcctgggagtttgagaccagcctgggcaacacagggagaccccatctctaccaaaaacaacaacaaaaatagcctggtgtggtggtgtaatgcctgtagtgccagctgttctggaggctgaggtgggaggatcacttgagcccaggagttcgaggctacagtgggatgtgatcacaccaccactccagcctgggtgacaaaatgacaccttgtctccaaaaaaaaaaacacctcagatgtcttcttaattaattttcactttaatgagcatgaaagttaagaagagttctcctattttgctatttttctgtaaagttgaattctttttttctccaaggatgtgtgaggctaaaacaaaggtctccacaggagaggtaagctgtattgaattctgctaacagtagatttttggagaggtaagctgtattgaattctgctaacagtagattttttttttgcctcaggaatattagagggttcacttaggggaactgatccatggatatttctcatattctcctccaacagtgtgactaacacatcatgtcagtggatattctcatatgtaataagacatctgcaaaatagtgccttaaaacaacttttatagttcctcgagatccagtgccttgactgggttggttgtttttccattccatgtggcatctgctggggtcactcctgtggctgcattcggctggtagctcagtgggacgctcagttcgcctccatgcagcctctcacgcccgctctggacttccttacagtgtggcagctgggtcccaagaggcagattcctaaagagcaaaagcagaagtttcaggccacttatgggccacacttaaaacagacacagtgtcacctctgcagcattctgctggtcagagcaaaacacaaagccagcctagattcaagaggaggggaaatagacttacttctggaaggaagaagcagcaaatgcaatcagggaagggaggaattgatgaggccatcttgggagactagcacattcatgatatctgtgcagcatggttgttactgtctacattgagccttatttccaactaaaggtgatctgtggagctcctttggggcagaatctataatattcctaatgatactcacaggacctggcactgtgttgggtgcagcgcagaagctcactattgttgagtgaaagaacatgcagtgaaattctagaaagttgaatgtaatagaaatcctatgaagtaacattgctgggaaataggaaataccaacttcacattcagtgtagtgacgtctcttttgttacagcatctcgtgctgtttaaagctgcattacgggaggctttgaagctcagcaaggaagtcatttggcagatagctgtgctaaatggaggcttatccctggaaaaggcacaggactccccacattagtgttcattatgtcaggatccttgctgtcaggtgcctaacagtgtgctgaccaagttttggttgtctgtgtatttctggaacgtaacacataccacccaaggcacatgttaggcattcagtgaatgccaggttagtgagtggtggtcagcagtgcctgaatgagtgacaagcagaaaaggaatataggtcctgtggactaacagcgccacccaccagctacctctgggatggaacctgtggttgcttgtccaggcacaccttcatctgctgttctgtcttctctacagtggagaccattctactgacagacagaaaaggcagtggtaccatacgcacatcagaaagtgtgagtgtgctgatcatactaggtccagccagaactttgcatctttgaggtgaaaccattcgcttagctaaatgaatattgcacctcaaaaatgctggtgagaattttacgaaagcatattatcaatgaaaatattaaaggagcagacgtgttaggatgtgttaggatgaaggttttttatttttattttttgagatggcgtctcactctgtcgtccaggctggagtgcagtggcacaatctcagctcactgcaacctccacctcctgggttcaagtgattctcttgcctcagcctcccaagtagctgggattacaggcacgcaccactacgcctggctatttttggtagagacgggattaagccatgtccgccaagctagtctctaacttctgacctcaaatgatccgcccgcctcggcctcccagagtgccaagattacaggtgtgagccacagcgcccagccaggatgaaggttttttaaaaagtctgtagttgtaagaagctatttatgaaaagatctttacattgtggtagcttatgaaaatcctttttctcatctcctttaattttctttctatcagtattattactgatattacaattttggtaagatctagagagaaaaattgattgtgataggctgtcttcaattacctatatgtttcttcttatctattaccttctgaagtagctttttcttaaacggtattgttaaactttattttttattttattattattactttttgagacagagtctcactctatcccccaggctggagtgcagtggtgctatcttggcttaaggcaacctctgccttctggattcaagtgattctcgtgcctcagtctcccgagtagctgggattacaggccaccacacccagctaatttttctatttttagtagagacggggtttcaccatgttggccagactagtctcaaactcctcacctcaagtgatcctcctgccttggtgtcccaaagtgctgggattacaggtgtgagtcactgcacccatccttaaacagtattgttaaactttaaactgaaatctgaactctctgttaaactgccttttccaactttaattcccagtcattttttaatgccttctattattctttctcattacgtatatgttgctattctcaaactcagttgcagaacaagtacaggcctatatcctgagaactataaatctcttgaagaaagaggaggtcttgctgggttttctggataatggatgtgactgtgtgggtgcgcacacctgtgtgtgtctgcgctggtgctctgggccctggagactggtatcagaattactctgacctaaaaatgcactctagattttaacacacctctggtagaagagaggaggaaacatttgcagcatggaattatcggtcccattaccacccaggtgtcaaggaaatgaaacttttctattacaagattgcagtaaatcacacaagaggatgacagcttcattaacatgggtaaagttactgtaatttatgtataaataacttttctgtgtcaagatatagtatcattcagtcccaacagaatagcattttttctataaaagaagtgaaatgccaaaaaaagcagtttctatcaaagaaatccacaaaagacaacggtttcctgtgataaaactgactttgacagagcccacagcacctctgctttatagttttaagtttttacattcagccaaaacagaatatttcagactttatcacaaagagtgacttttgttttgttttgttttgttttgttttgttttgttttgtttgagacagagtctcgctctgtcacccacgctggaatgcagtggcatgatcttggctcactgtaacctccgcctcttgggtttaagagagtctcgtgcctcagcctcctgagtagctgggaccacaggcatgcgccaccatgcccggctaactttctgtatttttagcagagacagggttttgccatgttggttaggctggtctcgaactcctcacctcaggtgatctgtctgccttggtctcccaaagtgctgggattacaggcataagccaccgtgcctgacctcaaatagtgatttgatatattgtttgttatttggttgttgaaataaatattttgatttttttataagaatgaaaaatttgaaataacttaaatttctatcagtaggagattgattaaaagcattgtggtacatccatttggtagaatattaggcaggattttagaagaatgagggagatctaaatgaatgcctattcaggtatatatatatatatatatggttatatctattaagcaaaaaacaaaaatttgaacattctatgcagaattattccactcaaacaatatcagcagaagaagactgatcaacttgtaataattagtcagcataataaaaccatattgaaatagtttcttagtggaatatcaggggaacccgcccccaatatttcaatgtagattctttctatcttccaaaagtgttggccggctgagaaataaagagaaagagtacaaagagaggaattttacagctgggctgctgggggtgacatcacatattggtaggaccgtgatgcccacctgagcctcaaaccagcaagtttttcattaagggtttcaaaaggggagagggtgtaagaacagggagtaggtacaaagatcacatgcttcaaagggcaaaaagcagaactactaataaggatctaataaagatcacatgcttctgagggaacaggacaaagggcaaaagcagaactactgagcacaaggcaaagggtaaaagcagaactactgataagggtctatgttcagcggtgcacgtattgtcttgataaacatcttaaacaacagaaaacagggttcgagagtagagaaccggtctgaccacaaatttatcagggcagagtttttccccaccctagtaagtctgagggtactgccagagaccagggcatatctcagttcttatctcaaccgcataagatagacattcccagagcggccgtttatagacctccccctaggaatgcattcctttcccagggcattaatattaatattccttgctaggaagagaattcagtgatatctttcctactcgcacgtccatttataggctctctgcaaagagaaaaatatggctctttttgcccaaccccgcaggcagtcagaccttatggttgtcttcccttgttccctaaaaatcactgttattctgttctttttcaaggtgtactaatttcatattgttcaaacacacgttttacaatcaatttataccgttaacacaattatcacagtggtcctgacgtacatcctcagcttacgaagataacaggattaagagattaaagtaagacaagtgtaagaaattataaaagtattatttgggaactgataaatgtccatattaaaatgaaatcttcacaatttatgttcctctgccgaggctccagccggtccctctgttcggggtccttgacttcccgcaacagtggaagatacctgtatgggccataaacttctaggagacaccatataaattatagttcaaaataaagaaatcataccccgccaccctacccttagaagttaagtaggatatgctgactcttctgggtcctcagattggaagtccagtcccagctttaatgttgacacagctttggtatagaagaactttagagctaaagcctgcccaccaaagttcaagtcctgaggtgggcaaattgcctaatctttcccatattcagctttatttaacctctgagtcttaaattcctcactggaatgagttgttcattcttccaatgttgttattaaaagcaagtgagataatgtttgtggaattattttgtgaattgtaatgtgttctacccttattacttattatagagtcattgatgaagtaaatccaaggaattatccttaccacttcctacttccctcccagagtaagaagctgagagtagcaggccaccagatcctctctttgctgaggatgacatttatggcatgaatcatggagatggaaaccagctcaggaccaaactgggttagcgtctccttggcattctctggaaaagaggctgtactggttaaagagagtctctgcttttgattttatacttaactaatgacaataggaaagaagattctccacatggtttaaaaaagggagattttgcccaggtctttggaacagttgaagtgtctgaaaaacagaaggagataccctgaactgccactatatactggggcccctagactggagatgagctgaagaagtagttactgaggcattttctgtggtttgatgttaatttctagcgaaggggacagggaagctaggggaaccagaaccctggcatgcattgtgttctcttggactgtctgacaccttttaaaaaaaatggagtctctttctgtcacccaggcttgggggtagtggtgcagtctttgctcactgcaacctccacctcccgggttcaagcgattctcctgcctcagccttccaagtagctgaaattacaggtacacgcgaccacccagctaatttttgtatttttattagagacagggttttaacatgttgtccaggctggtctcgaactcctgaccttcagtgatccacctgtctcagcctcccaaagtgctgggattataggcatgagccactgtgcgcggccacattttaagaaatgctcagttgtcccattgttagctctatcacataaatttatccttgtcttatttagttcttatgcaccaattacctggaacctagctcatggtttccagcatagcctccctactgttatgagaaataattcataaattgtgggaagaaatttttcttcagattgctcttgactttgggacattatatgtatatgctttctggtggtcatgttgtaaaattgtagatgattcactattaggggatcaggatccactctagccagaataaactcatcacactttgtcgctcctccttggcctctgccacccagtgctctgagactgttgatgtgatccaggaagctgaatgaacactggcccccaagttaggaagcctgcatcccagactcagcttgatctcttgtaagcccatggttttctctccaacaaagaagaccactgaaattaattattttcaagatctcttctagttctgaagggagataattagtttttaaatactaaattggtacctacccattgtaataaataaataaaggaataagaaaagggataaagtaaaaagtgaaagttctcctacctgccccttaggtcctaaaatagaaaattgtaaagggtaaatctcagggcttgaaaattgttgaggcaatctctaatgatggcaagatctagctctgttaggacttctaagcagtattctttagtatactctgctataggacagaaccatttgcaaggaaaggatgttaatttgggtctctctctccctcttgcaatatggtgccatttttgatctcagagccatcgtgcctcatttctaacaccttgtcttcaatagtctttttttcttcttcttcttcaggtgcctaaaaattagctctcttatcctctctctctcttctactcttcttccttttcctctttttcttcttttctccctctttttgtgcatttctgcagggatatcctaaaaataactaaacatagctcccgtgagaaagaagattcatattgcagattgtgtcagtgttttttaaaaataaaataattctgttggtgtaatcaacaaatatttactgagtgcttgctctgcagaaggcatcaagctaagtactagaataaagtgtcatgatgtgatattgaaacaatatttgcagcaggccagctcagttcaaagtgaaagatgagggagaattctgggtatcctcgaacctggcactttttgctgagctcagaagacccaggtgttgaagagactgctttttacaagctcgcagaataagtgtttgagaaatgtgaaatttaggtccaccgttggccttctttctgaggccagtctcaaagggttccccatttgcccttagctcttgacttgccttctcttggtgagcagggcagctctctgagcttgagtgggctgtgatgttggttgctgacttttgtcccttttgtaggcttcattgatgggatttagactcagttgctcattggatagggaatcggaactggccattcagaatgagggagtttcatctcttgggttattgcggttggagtaatcacttatcagagcctctgcttttttgtgatggttagagtaacatgcttcctgccaccctacagcataccaggagacaggaggccttttcttgtgccaaggtttatttggagcttatctgtatttatgatcttttcctgccattggcttaattacacaactggggaaatttaattatcaaagaacttaataacactaaagaacttgccgtgtgccaggcactgggctaaacacccactggcacctgaggcaagtgctgttagtccatttacagctgaggatgctgaaggttggagagcacgtgttattgtcagggtcactttgccagtgagtcttgcagtcagaaatcagccttggacagctcgactctagagttcacgcccttcaccttgatccttctggcatcatccatctctgcagcctgacatctaacagatttaggcctcattggcctgtctgtggttacattgcatgtaccagtggcacccagcagcaaagctatttctgagacacatacagagcattagttgactatattgtttctccagttcaggatcatgcggatcctgccatgattatgtggaaagagtttgcaaagtagagtcaaagcatttggtcctgttgctaggcttttctaagcttccgtcaactcatatgtgaaatgaggacaatgacacttggtgcttaaattgtataacatatgaagcagagacaggctcacatataattgattctctgttcatttaatttcctttcccttttcccagttgactcttcttcctccctcctcctatttcatgattttctctctggctgtcgcagtaattcagtgtatctgttcccaggctgtagttccaagtagcaagaataaagcaaaactagatgtgttttcggcagtctcaagctctcacaggaagtttttgttgtgtctgtaagctgtggttggatcccacaccgggtggaccatctttcctggagtggtggagaggaaggagtgcctagccaggagacagatatgtcagtatctgtaaggtgacctactagtggaaaacactcttgctcttatttgccttcctcctggcagcccggtttcttcatcatcagcagccccctttgacctcctatgcccttactcgtgtggtttaactggagcttgtgaaaatgatgactagtctattgtgcatctggctgaggcatttaatccactgtggagacacccttattagaggaaatggaatgcaagttatgcttatcatggggatagtgtattagggcccatcctggacagcttgtaaaagaattaatgctggtgcggtggcttatgcctgtaatcccaacgctttgggaggccggcacgggtggaccacttgaagtcaggagttcaaggccagtttggccaacacggtgaaaccccgtctctactaaaaatacaaaaattagctgggcatggcagtgcacaacagtaatcccagctacttgggaggctgaggcaggagaatcgcttgaacctgggaggcggaggttgcagtgagctgagattgcaccattgtactcccatctgggtgacagagcgagactccatctaaaaaataaaaataaaaaaaaattaatttacaaccttttctgcagcaggatttccaggaaatgaactgggaaatggtggcaatgaatgatgacaataaatgatggcaaatgcatgtaccatccaactatgattttgtttcttttcaaactattaatagcaccagctttcagatccatgtcgggccctccttctcaaggaacccttgctcagcttaaatctgcttgtattgtaaacttgaaataaatataaaaaacatgggaacaaaaaaatacatattttttgaatttattcattattcacacagttcactaaatcaaactagcataatctctgctggtccacaaacaggatcacatacatttacagtttttaaaagatgttggttctccttttattacatactatttgatctctttaaactccagtgttctcatctacaatatggcctaatatgatgataaagataacatgctagaagtgaattttctttcttgtaaatgaaaaacatagttttaaatttccaattgcaactgaagggcctgatttggcatttctcaatgtcttactcttagtttagaataggttgcaattattgttcttttttagccatgacaccaagttattcatctatagcagcttttctcttttttttttgagacagagtctcgctctgtcgaccaggctggagtccaacggcccgatctcggttcacttcaacctctgcctcctgggttcaagcaattctcctgcctcagccttccgagtagctgggattacaggcgcgtacaaccacgcccagctaatttttgtatttttagtagagatgaggtttcgaggtttcaccatgttgcccaggctggttttgaactcctgggctcaagcgatctgccctcctcagcctcccaaaacggtcggattataggcgtgaaccaccgcacccagccgcctggaatttttaagcctcaagtttgttccactttgaatgcaagaagccacctgctcctctttctgtcatcaatttaattgtttataaattggggctaataacgatttccttaggccactatattctttacccagctagttccaagttgttttgtgtgtgtgtgttttgtttttgttttttgttggttttttttgtttttgtttttgttttgagatggtgtctcgctctgttgcccgggctggagtgcagtgacacgatcttggctcactgcaacctctgcctcccgagttcaagtgattctcctgcctcagcctcctgagtagctgggactacaggcatacaccaccatgcctagctaatttttgtatttttagtagaggtggggtttcaccatgttgcccaggctggtcttgaactcctgacctcaggtgatcttcctgcctcagcctcccaaagtgctgtgattacaggcatgagacaccatgaccagcagttctaagtttttatcattgtctgaccctattgtaaaatgagtttttaagagactgatttgtaagagatacagaatagttttaagtttcatttattctttgtaaatgcagttttgggaaataattcttttgagggaacatatatcatcccccttaatcctgtattactgatagcatttgtttgcttaaagagtttttttccagcacacagtatttatgctcatttttggataccaaatgaatgttacctaaattagtgaaactttaatgtttggctaaaatgagccagaaagctgtttctttaaactttagatcctatttaagaaatagaaatgtatccgatgtttacgattgccctttaattttacaagtgatgaagaggtaggtatttggctttttcaaaaatattgcagagccaatgccatcttactgttcaagtgtaaaaacccacatgtggcaggtgtattttataggcttataaatacctgaacttgctcacaggctgattactagactttatagatcgcttcaaaaagtgagagtttcctaatagtggataaatacttacccattaattttttttttaaatgtgaatttaatcaggaagacctagaatagattcttaccaagttcaatgtggtatgagagtaaatctcacagcataatttatgaattcatatataatatggcagaactgatagctataataaacagcaaagtgagagcatattcctaattcagagtatctcattttccattattaacaattaatggaactttccatttttaagtgtcactactgaaagtgttagcgtgctcaacagtaagcaggtgaattcagaatgttattttaaggcaatagggttcccactgacagcaaaagtcaaaggatggacaggaagcacacttcctattagtaaggggaaccatcatgatgaaacagatagaggctttgtcgattgttctctccaaccctttgtgcaaggctctgatgctaggtacctagagcaaatgtttcacagtgtttgaaagctcagaaaagtaagggtgagggtggagagaagtatgttgttagggaaaattgctaaactcttagatggactgattgcattcgttattaaaagactaacaattcattttcacctttttatgtttggagaataatcaggatattagtagactttgcagaggcagctttgttgtttgatctgagaattgtttgggggatggagaaaaggaagaagggataccttgaggaaagctacatcctttatagagaagtcagggctgtatgtaagtgaatgtgcatggtcagccatggtttgggccatcttaatttcgtggggtgagggagatatgctacagcaaactgttccttttttcttgtttgctttctctgcttggaattctgattctccaaatgttgagtaatagccattccaaattagtcaagcaatattggatggggtttgtggggtggagtaagacctgtatgacaagacctctgccttctgctctgagatctgacacctgctcatgccaccatcattctccttaaaataggtgtaaaccatacaccattctttcccaaggagacaactgctttccctgtaagacatttttaattcgtgaatttttcaagtgttcatgatgtacatcatctttcggttttgagtatactagttgtgtgttagaagtttaagatacagggtatgaattctgtgctttaaggaatttcgtaggaaacattgcatgtgttaagacagatttgggatacattttctgaggtcataaggtgttggagagctgtcatactggaggatatttattcctgggaatgactaatagatttcaactgatggcaacttagattgattggtagtggcttcctggactgctgtgttagaagaattctaagggttcctaaattgaatgggaaataaatctattactttagtctgtcacaggcatcagtcttattatcattattgctattcctggtttgtatattctccttacatgaaactagttgggtagagacttaacataagctagtatttagatgggttccgaacttgtgttccaagaattaaatcaatcaaaattaaatttgagcatttgccttgtgagagatgctgtgaaagtaacacatgttcaaagttaaagtgttaagtgaaataagaccttgaatggtgaggaatggtcaaacaactgctgtaagaaatacgagggatagaataccaagccaagagtcatgcaaatcagggatactaaagaatgaggaagcagagttggttttatgtaagcaaaagcaaatagcaggaagtgtagcctttttaaagaaatctcagtaccacagcctgttgggagagattatttgtgattgggagaaatgggagccatcagcaagcggaggggcttggaagtgatggatttttttcatggtctttttcttctgactccgttcgagattataggtccctagaaggtaaaaatctggtctttcattccacaaagtgttttttgttttgtttttttgagacggagtctcgctcttctcccaggttggactgcagtggcgcgatctcggctcactgcaagctccgcctcccgggttcacgccattgtcctgcctcagcctcccgagtagctgggactgcaggcgcccgccaccacgcccggctaattttttgtgtttttagtacagacgggctttcaccgtgttagccaggatgatctcgatctcctgacctcgtgatccacccgcctcggcctcccaaagtgctgggattacaggcgtgagccaccacgcctggcctgttttggtttttttgagacagtctcgctctgtcaccaggctggagtgcagtggtacgatttcaggtcactgcaacctccgcctcccccttctacaaagttttatcaagctgccccccatgtgccaggcaccatattaaaacaacaggacttggtgtggactctgaccttgatgatttttcagagcagagtaggaatggggaagggaataatacttgttggtacctacgtgcctcttgaaggaagttactctttactccattatacagaagagaaaaaccaaggctcaggaatgtcagcttgcccacggtcagccaacagagctagatttgaatctaggtctctcccacttggaattctggcttcttttcaccagagttcctataagtacactttgatcaagtggtatatttataggtctttttgatttaatttttttctttgctcagagctagaaatggaatgttcttttagttcttttttgaaagacacatttaaagtcagcttttttaattgaggcataatatatatccaaaaaaagttcacacatcttaaatgtccagcttgaccagttttcacaaagtgagcacaccctttgttaccacttcctagagtaaatccttcactttcttaaagtgagtagaaactaaccacagggtaattttttttttcttcacacttttttttttccaatttctctgtccttctttctctctctctcctacttccctctccccaaccttctccccaccaccccactttttccagctaaagcattctcttggacttcttgataatataatttagtcccaagaattttcatgaagccacctggtgttggggggcaggtagtaccctgaggtgtacccctcttctgggaatcacttgagttataagagggtaaatgtaagagtgacatgaatcatgagtgtcaatttaattctatattaagtcacatcctagcatttatcatatataactacaaagtaccggctcctatgatattttaaagaacatacccatttcaatcttcacaaatattctcattttacacataaagcaataggtatgtttatgccttaaagtgacttacctaaagtaatatacaatctagtaaatggtagacttccttatactcatccatttttccttaaaatacaccatagctgcctgcgtttaccttcattctttgttaaacataagtttgcatgcttaaaaataaaactaaactaagaaggacataggcacatcaggtttgttataggaactgctttttatttccctttcttttttagaaaaagaaattggattccagataattgtagtcctggaaataggacaaagtttcatatttgagaagttattctcacgtttccagttatccttaagagctggtctttgcagccatgtttagtatcactgttagcttgaagctgttgcaactgattttcttagcagaaccagaagttcctgaagataagacacattctttatgttctagttaattaaagaacaaattttaagaacttcaggtcagttactgtctcttgagtaacgcgtgttcctaagaaatactttacaaattctctgagaattggcacaaatgaagttcaagagaagtgcatctaagaatttgactgttcccagcttctgccattagaacatcctttatagttcggattttttggctgaaggcctgattcattatttttagttatttctcatgttttttcaaacccagtaacactaacatgttggtattgagcctgtccgtacattcctgattagaggcgccatttaatttgatattttgataaagactgtctgtggcaagttgttgtaggactaatttctctgggcaagcaagactgaagaaaaaggaggaaaatgggagtttaatcattggagactgaaaataatttttaatactgtctgactcctttctggaatgccatattaattcatgtttagttgaatccatgataaatctttaaatgtacgtgtgttttattttaagagttgattctaactcaggggtgatctgccactttgggaaacttatacaatgttctaatacattaacaataaacatagagtttttaagtggaaaatgagagtattttcttttctcccttcatttacctgggtgttttggctcaccaaagagttgtgttctgcaaatgtctgggcaatccatggagctaaactggcattagagtcaagtaacactcctcctctctccctgttcttttccttaaaatcttcaaaggcattgggggttttaccttagcaacttgctatttcgtcttcttagtttgaaccttcaaatatagctggatataataaaatgctcctcaaatgaggaagtaccagaaagaccagatgcatggtctcatgcttcccttgtgctgggcacagatctaaacaaaaacaatgttgtgtccatattaagagcttcataaatacagatggagtgaatgaatgatttatgacagtgtaggttgtggagcttggtagtaacacgcagaattctcagaatcatgcctgtccgtggaataaaaagaaaacaacttttctttgtaaggttagagatttgatgggaaaatcaagaacatctaaggagctaaagaaagaaattccttatacccagattgttggatgtatttgcaacattcctctcattgtctgacaacgataaggattctatttgaagataatgtgtgttaaatcaagaatctgagtttttccttggcaggcatagaggagaaagtgaaaaaaatgaatggaagaagatgcctaatatgttagtttttcacccttggatcctctttcctctttgcacagggttactggaggttgtagcaggtcattatattgttttcctaatatgttttgccatttattttgtttgcctgggaagccataaaagtgctggtgtgagctaattataacaatgcatggccaagtcaacaatgacgtcatagaagatgctgggcttataagatcttaatggaactgagaaattcctattagctagtggcatcatacctgttatactgtcttggcacaatgcattactcacgcatttgtggtgatgctggtataaacaaatctactgtattgccagttttatgaaagtatagcacatacaattatgtacagtacatagtacttgctaatgacaataaatgaccatgttactggtttacgtatttactatactatagtttttttattgttatttttagagtgcactcattctacttatttttttttaagttacctgtaaaacagcctcagacaggtccttcaggagatatttcagaagaaggcattgttgtcataggagatgacagctccatgcgtgttattgtccctagagaccttccagtgagacaagatgtggagatggaagacagagatactgatgattctgaccctgtgtaggctctaggctaatgtgtgtgtttgtgttttggcttttaacaaaaaagttgaacaagtaaaaaaaaaaaaaatagaaaaaagtttataggctgggcgcagtggctcacacctataatcccagcactttgagaggccaaagcaggtggattgcttgagcccaggagtttgagaccagcctgaataacatggcgaaacctaatctgtatcaaaaatgcaaaaaattagccaggtgtggtggtgcatacctgtagtccaagctccctgggaggctgaggtaggaggatcacctgagcctgggaggtcgaggctgcagtgagttgttactgtgctactgcactccagcctaggagacagagtgacatcctgtctcaaaacaaaaaaaggaaaaaggaaagaaaatatttttgtaaagctatatacaatatgtttgtgttttaagctaagtgttattacaaaagagtcaaaaagttaaaaagtttctaaggtaaaaaacttacagtaagctaagttattattgaaaaaagaaaaaaatttaaaataaatgtagtgtagcctgagtgtacagtgtttataaagtctataacagtgtacagtcatgccctaggcctttgcgtttactcagcactcactcacccagagcagtgcccagtcttgcaagctctattcattttaagtggcccacagaggtgtaccattttttatgttttatatcctatttttactgtacctattgtatgtttagatatgtgttgatacacaaatacttaccatggtgttacaactgcccatagtaatgtgatatacagatttgtagtctaggagatacaggctacaccatatattctaggtgtgtagaaggttataccatccaggtctgcgtgagtacactctatgatattcactcaacagcaaaatctcctaataccgcacttcttagaacgtaaccccattgttaagtgactcatgactgtattctaaagagtgctctggtccctggaaaacgatggatttgatactctagatctcatttcttgcagaccagaaagctggctttactggaactttttactgagtcctctctgcttcatgtaagactgagactttgtacagggtttacccaagtatctgccttggtaggaattggagaatgctcttagtgcttgaaccctagatgtgccaagattacttgaggaaaagaatgtaaaacacttagcatcaagaagtaccaataaatggtagctactagtttgctaaaattaattttcccttttcttcagcctttttttacccttagtcccaggagccatcaaatttcctattgctgaatgtgtggcacccaggcttgtgagagcagagggcttaggaacagcagcctgtgctatggaagctgggtctctggctggccccatgcctctgctgactccaagcccaaggattgaatttacttactttggtagctgcaacttggcaaatatagcagcttagcccgtttgtcagtgaggggagtgattgcagggtagaatggagacctaccccagaattagacttggggtggtcagcagcctccaacaatgaatttatttcatggcatcagccctaaggctctgtgctgtatcccaccgttcttagtcatgaattggaatgaactcaggaagcattcatgcccaggtgttctctggcagacaataatcatataataagattgttttgaacttgctgttaaaaacaatgtgaggagcttcctcatgagttttctatatgaaaagcaggtggtgtgtataaaatcccatgcctttggggagaaacagtaccgacgttgccttagcaaacatcattgctcttcttcgctgggtgcttccagaccatcagtcagctcaggcgtcatttctggtcatctttcctgacctctaggcaggacttttctgctctgggctcccacagaacacttctctttaagtacccaccacattgtgtggaagcgaactgttttctcattggatttcccaccatgacacatgcccctggaaggcagggacctccgtgtagtcacctcggcaaatccgtctcttagaccaacacctggcatgtgatgggagctcagtccattttgctgtagttgaacggagaacttcaccagctcatcagggggctcttttgctcatgtaactacagtttgagtttagatccactcttatgagcacacggtaagatattttgatgcccagtggcaaacagtgctcaagttgccacatatggtcatttttctcagacatgtactttcctgactccccagccctgaaaggtagcatcatctaaaacaccaacaactgataagctttattttatattggttgcatttatcttgctactccttgaaacacaggccttgagggcctttgagatgtaatcttcagtttcccccacccctctagttggattaatagatttatgtagctgttgaacacaagctgcctccgaatgcttgtgttttaactcagtaggaacccagctgatcgttccgaaagcagcttttaagagaagctgatgtcctgtgaacacgttagcaagctgtcattgtgactttgtcagcaggcttatctcagagcatctgcagactcattttgagattgcctaattatttatacacgagatttctctcctttctggtgatgggctgagatgaagctggttcttaagtacggggaagatatattatgaatgctttgtcattaaaataggtcacttttctgttttcctcctatagctagtattaggaaattatatttctcccaacttctagagttgtaaaactgtatttttaaaaactcacctttccagtgtttgcaaaatgtgagcacaacatatactactgccagtctaaaatgtgtgtgcatttagacagataatgtaaatttaatcctagtaagtgcttattctgaagaccatcttctctctagcgtaaatgtgtgcttatcagtatagaataaatgtattcaaagaataggagagtaaatggccctttattcaaattgctttcatttatttttttcttttggaagtagtgaaagctttattatcaatcacttcatttttcaccagcttcagatttagagggtaaaaaaaggaagcatttgggggtcagtgttttgaatcaaaacaaatcaggaattgataaaaccgtagtttcctgactatttactgacctgattggagtcatattcttagcttggaagagctgtgttcattcatttttttttttttcctgccgtctgggtttagtaggtaatgtggaaaccatctaccataaatacattgctgcaagataacaaatagaattggaatctatgcttgcatttccctgagtttctgtttttttttccttacatcctgctctgcctggcaaggccagtcacgtgctttttaggacgttttgtgctctaacttaaaaaccttcatgggatccacagccattcacacattttaccaaacctagaaaagtaacagtgggaaaataagttcgaattcaacttgtacaggtctaactaaacaatggctgaatcaaaaagagccttctcaatatgaaaataccatgattctgttacacagactgcatttgtagttttctttctaatccaatgctttcatgctttcaagtccctagctccttctgtccactgagtttgcaggattgaaactagaaaaaagagtgaacatctagaacatccccaggctggccttgcctgggacagtgtgccagccagcccacaggaaggtacttcctccaaagaacaggttcatcacacattacttctgagagcaaggaaataagggtggagaccccagtatgggatcttggaagcccccagaatgtatatggctaatttgaaactttggttgttaaaccaccactgtgacacctctgattttgaggtgggtccatgggagacaacaggaagttatggaaagagtatacactttggggtcaagaaaaattaagtagccactcctggctttgccttctggacaaatgactttatcttttatctataaagtgggtataacaaggacaataatcacttagaaagtattttgtgccatgccttatgttcaataatattcttacctatgaggtggcttcttgcattcaaagtggaacaaacttgaggcttaaaaattccaggcggctgggtgcggtggttcacgcctataatccgaccgttttgggaggctgaggagggcagatcgcttgagcccaggagttcaaaaccagcctgggcaacatggtgaaacctcgaaacctcatctctactaaaaatacaaaaattagctgggcgtggttgtacgcgcctgtaatcccagctactcggaaggctgaggcgggagaattgcttgaacccaggaggcagaggttgaagtgaaccgagatcgggccgttggactccagcctggtcgacagagcgagactctgtctcaaaaaaaaaaaaaaaaaaaaagagaaaagaagcccggcaatgggctacaaagacactcttggaaagtgctgaatctgagattgaaaacaaggcctgctttagatccagagctcaagtccttagccaatatgacctttcagattgctacaagtgttcattgaaataaagcaggaacagtgcctagcacagattccagcacacaggagacctgcagtaaagataaacccactttggcacttccactcgtgggggagagcagtcagcccttagcttgtcccttaacagtaagactgccacaccatctgatgcatgactaccagctccttttgaatctactcggaaggacaatgtgcacgctctgtgccctgctggatatggtttaattttctcatttctacaagctctaggttacaggggataaagccacatgcagctagtatggacagaacaactagttctggttgaattattcagttcttaactggctgcagctttgggatcttagaaacacagtccttaaccttgcattctttccacttgaaaaataaaatgtaggtgcccagcagggaaattccatggacagaatagctgtcaagtaggggcacttcttagagcagggaggaagctgagcaagtgggggtgaagggaaacatggaggcagaggctggggggctgggaccctgggtggcaagaagctgagcacagatcatcattctcccttagggctagaacctgtgaacctgaacccttcattgaggggcactgaatttagaaggcagctcttctgtttgtcgcttgttctttctctcaatgtaattaagaagactttgaagaaggaatattgtgctaaagcctagataagaacctgttctccatccacctccccaaatccctaaagccttgtttgattttaatatttttcttttggatttcactttgctgctgtgtgaaggggcagcaggtggggagggtagagaggagggttcctggggaagcagaaacccttatggaaacccatttttaatctggatgatggctcggtaatgtaagccgtgagagttggcagaggagtgaaaactgtaggattaatggccttgggcctaattccctgataccttttaaaaggccagctaaccagctggcttcctccttttgctccatatacactccctcctcccttatcttcattgttttttgctttcttttttggctgatttttaactccttctctgaatctgaaagagagagttgtatgtatatgatgatttgtgttaaagatgcttagaaattaatatactaaaggaagctcgtaataaaatacaaaagatgatgatttgcattgtaaagtaatctggatttttttggtgcaagttgtctttaaatagaaactcttcttgatttgtgcatgcatgtgcacacatgcacacacatccatagacaggcataagcatgtgtgcctgaatgtgagttttcaagtttaaacccttagaatatgtgttttctgtgtaggtagaaatgaaatcccacaaatgttatcaattcttgtgaggttccaggtaaaatatacatgcatgaccttctctacgttttacaacattactgctttccccaagtgcccgtttatctgtatttcagaaacccatgtgatctgtaaatcaggtaggccaatgtggaatgatatatctgtgtgctgggatctgcatgtgggctgctggaagtttgagtttgcaggtaatgagcgttactttggatgcgaacggaggcactaggcagggagcaaaaaggagggtaacttactccagcaaaggaggacatgattagtgtttccagcatgaaacctttgaagtgggtcagcaggaaaggaagaaaaagcaaaaacatccagacatgggagaatcagaacatttcttgttgcctaggttattctggtagactttgaaatgccagtccctattagtttggtgggtaaacattctcattattttctgtaattggcattattattggaaggtaattaacgacagtaacattttcgtataacactcagacctggatgggtcttaatgacttcccttcagtcttgcgtgaagttgttttctgtttgatttttgagtgcttgaaactacttagggttctggctgtgagtggactctgctggccctgctatgttttataatataattgcattgaccatgcctgtcaaattgtcttcattctttctgtcctagcctaatgcctggccagaacaggtgcccaataaagtgtagcagttattgcagcatttgtcaactaaaacattgaaacccgtttataactcctatggtcatgactggtttatgtccgtagacaacgcttgatatttttggattgtagaatgcttttaccaaatcagaggtaaaccccacagagaccctattagagccgagcccaagcaagccagatgttatcaaatcactcactgtaacttcacagccttccctggttcacgaccattttgatcatgtcatctaagatgacatcatgatcgaattgacagtggattattagttcacccatcagaggttgtgacaatttgatacagcaaacccagaagcttatagacattgtatttgccagttgatgcttaatctaatcagcctatttatattcagtgaaactctcatatctacacatttccacatctatttttagctcctttatcacttcctgtcatttcctcttgctgtccctcacctcctcaaatgaggtgccaggactaaactggacattgcgagaagggaggcggccttatttagagtgtgttgcctataacacatttaatttgccgcagtccagatcagtcgcagcctctctaactacaagtggcagaggtggctgtcttgggaagaggcacttacactgtccattctctgcttttaaacagggcctggttgtggttggaaggatgtggcataactaattcatagtcactttaaattcagtccccaaagggacgtatctctcccgggttacttaaagaggaattaaaggcagggagctgatgggggtggtgttgggggatcaagtgatactaggaatataggtacaagtaagactgtcgttttcattgttttctctttggactgattctgttcattataacagcgttgtgaagtagaggtgggattaggaaccttctgctgtaatcaactcccttgctgcccaaacaccagcctcatacacaacaccaacaggaccagcatggagggaaatattccaaggggtatttactctgctggtgtcaaagaaaaacacacctgtaatctcagccactcaggaggctgcggcagaaggattgcttgaactcagttgttcaagaccagcctggacaatatagcgagacctcatctcaacaacaacaaaaaaagtaaaagaaaagagaaaagaaaagaaaagaaagaaaaaccaaaaccagagagtgattagagtagtaaaaacagattttagtcaggaactattgcagtaggggcccaattctgaacatacttgaacaagtggggatatgtagccaaaaggcagggttaggggtcagtgggtagatagcccctaaaagggagcatcagaagtaaggaagattcttgctaaacagacctaacaggagtcgtgctgaaggcaggccagggtgatcagatctcacctggggaatggtgagagatgatgaatttggtgagataaccagcgtggggattctttctcaagtgatgtaacaagatttttgctaaaactaggtgataacgggtctggcaaggatggacttgtaagatcgagaccttgaggacttagaggaacctgatttcatttaatcaaggagggagtcttgttactggtcactgtctcatctcagtgactcagaagtacagcaacagtggcaagcgtttcacttgctcaaagcgtggttagtccaggctgcagcgaaaggcggaaggcaccagggattgggacaagctcaagtgttcagcatcacgggggtttagcagcctgcttgagtgcaaatatcttgaattgatgttactgtgccctatggaggtcagcctggatccttcttgcctcactgcccaaattccattttcacccagcaatcctcagaggtttccaaaggccttttgtttcttcgtgccattctccctgtaagctttccatatggccttggcatggaacaggtttatccaaccctgtggtattaacagtgtggcttttgttgttcttggagacctttgcttctgtccaaatggcttttctgtgcctcatctgttgatagattggaaaatgctcatgtttttcttttacttgattgtacttagaatattttcgttatttatttagcagagagttcacttggaaaaggaagatgatggcatatcgtggatatttctgttctgaaagaaataagttcaaggaaagaaaaagaagagtatgaatggaagattattcatccatcaatccattcttgccttctgtgcacacgcacatatacctatacattcatatataatgtgtactgtaatgtttcagctactctctcaggaatgtttagaaatgaaacagtaaacacaattttaaatgtagaagatcatgctgatattttggaataacattcaaaaccaagttcttgatttctgtctcttcaccctccccaatatgttgcttctgcagttttcccccttagtaaaaagcgagccttttctctgagttcctcaggccaaaaccttgccgttgtccttgactcttttctttctctcatatacagccaactcatctgcacatcctgttcattgtagctctaagatatatccagcattcaaccagttcttaccacctccactgctgcttctatggtgcaagccacagttacctctcaccggaccatggcaatagcctctctcttcttccctgcttccatttcccaccttggcccaactacaaactcttctccacacagcagccaccaggggaatccttttaaaggataagtcagctcatatctctcctctgctcaaaatcctctgtggctttccatctcactcacagtaatgtccatattcctcactgtgacatacagggttctgtagtttgatgcgacctcccaaccctcttcttcctcagcagtctcccagttgacaagtattctccaaacagcagcagcagcagcagcagcaatagtagaagtagaagtagtagcagcagttttcttaccagattcaagctggcttttgctggcaagaatcctcatgtcatatgtatccttgtgagatcattgactttgggcattgtcctaggtgaatgcattggagcctttgctgacaagtccttaagcatcacttagcagtggcctgtgtagttctggggtgtttggaatctttctctgcatgttcaatgctcaggaggtaaactggaaacagaaaccactgtcagaagaaggatggagccaacctctaccatcagtggactggtgctaagaaaacctttcttgaatgggcacggtggctcacgcctgtaatcccagcactttgggaggccgaggcgggtggatcacgaggtcaggagtttgagaccagcctgaccaacatggtgaaaccccgcctctactaaaaatacaaaaattagccgggtgtggtagcctgtgcctgtaatcccagctactcaggaggctgaagcaggagaatcgcttgaacccgggaggcagaggtagcagtgagccgagatcgtgccactgcactccagcctgggcgacagagcaagcctccgtctcaaaaaaaaaaaaaaaaaaagcaagaaaaaagaaaacctttcttgccctcactcctgcttaggatgctgcctttaaccttggtccttagagtgggtaaagctcttctgaatattttttatgtgaggagggataaaaaggttcaataaacgcaatgacaagtggtgctgcccctgcatacaactgtgttcagtgacttcttttgagttcataggaaaagcatatttacatatattgaatccagggccatgattttgatcacacccactctgtcttcctgacttagagcatttttttttcactcaagggcattctcaacaaaggagtatagctttcagatttgtaaactgccaccttattatcctattagtcaattacagctgctcaagagcagggtaagtgacagtatggcagattacagcaatttatttgccattctcatagtcttgtttggcatatcatcaggctgtttaaatttaatgataggagttttacatgtgttttagagcagttaaagttgtaatcaaaatgtttaggaaaacccctactgacctgcataaatgctcccttcttcaacgttgcttgtaaagcctcattgtaatcttgattagtaaaactgactccaattaggaaaaggaacttattttccaaagaaagaaaggccttttggtgttcttgtgtacaaagctcaggaaagatggggctgatggaaattattttccttgagttggcccttgtgggcaaatcagttgcatttaaataagtcaccataaatcccctgagaaacttggtagagtctgtgggaacagaagggcctgcaggcctggtcacaggatgggggtgtatagcatggcactgggagtagtttggaggaaggaggaaggagagctgtgggtaaaagaggagaaaataattgccctccattatgtctggttctctttcaagctaacggtgatagttattgtagtagcggctgcactgaaacgaaaaacatctctaaaaagaaaagttgagtgcttttatagaatctttagatcttacaagatgggatgagatcttggaggacctgctaccttgaacttgctcacaccttcaccttcactggtggaaatgaaggactattgttattaatggaatgatcaagagacccgaacctgggaatacccagtttattctttgcttccctatgctaagaagctaagaatactgtcattgtcaacaactatagactctcttcatctttattgaactctcaaggtgctatgtcatttggaaagtcaacattgccctgcctactatgagtttaatatgcattgcttcaagccaatgtaagaccagagtttctcagccttgacattgttgacatattgggccagaaaattctttgttgtgggggctcttctgcgcattgtaggatgttaaacagcatccctggcctctacccactagataccagaagcacccacccattccccagttgtgacaactgaaaatatctctagaagttgccaaaggtttcttgggaagcaaaattgctcctggttgaggaccactactattgactgatccaaactttatattatcacttgcaaataacttttgatattattcaaataacttttgaatcatacaaacttttggtatatgttaaaaaatatttagtgaatctctactgtatgtaagtcagcacagaaaccactgaaataagttactattcttactctgttgtccagcatagacagtatgtattgcatgttgatgtaaaagatacaatgccaattttatagtaaatttggggggacaaatttttcatgcattttgatcatatgttttctgaaagctattctaagtggttttgtcagggaaattatcatttttttcatataaaaactgtacattgtgtgccagaacccagctataggtttttcagagttggcagagtaattaaatcgcatggttattctatgctgtaaagtgaaataatggagatgttgttcgaattttcctatgtagttagatctcacgatgattttataactttggcacattgctttccttccataatatagtgccattgtatgcaaagtaatttttggatactgttttctgaggatagaaagggaggatgaacacatctaatctgccagcaatatcaaaacaggtatatgaggcactttttctgtgtatagccatgctgatgactaaaattgctgacctttaggtacttgcatatcattgtggaggtaaaacacatatctttctatagtcatcaaagatttattgggctcccctgatccaggctctgtacaagtcccctaggatatgaaatcacatgagaaataactctagctttttaaggaaaatatggtctagtgcttatagattaaaaaaatgctaacaccgttacaggctatagagcagagagtccctgagctaaatttgttgaatgtgttttaactcacggtgtatattttaaaaacttgaattagttacggtgtggattagggtgataaatagctaggagtgacagaaaactcaaggaaatagtggctcaaacaaaatagaagtgtatttttcactcacctgaatttaggtagctcaggcctggtaacgaggctccgtgatcatcagggacccaggctccttctgctttgttgctccaccattttaaacacatatcttacatgctggagtccaagatagctgccccagctccagctatcacaactgcattccatctcatagcaaaggaatggagaagggcctctcccttggaaataacactttctataccctcttacgtggctgcaggagctcctggtgaaccaccatcagggcttggaatgtgcttggttgaccgtaggaatatcatcagattaggtttttgcatcagcgagaaagattgagtacattaatagcagaaagagcacaggcatgggcaggctgaggtttgaagataggcagcattacttactataatagttaagggagcagaaggtaagtgctaaatgacaacatgtattagcagaattcagacaaaggatgatagcaggggctggagatgatatggaaggcaaatggggaggaggtggaactcgaacagatcttgaataagcagagaaatagggaatcccaagagagtccaccgtaaagagaaacatcagcttctggcttccttagatgccatgttttaagggcatttagctaaaatctgagatcagaaaatggtgaggttcctgggtgtccagcaagcattcagctttctctaggccatttatagaacacttaactaacccatgttgtcctttctaggatatatatatatatagtggtgtgactctatgtggcaatggcctttggggttttgcagaatgagaactattatattactttattcagccgatttcccaagctgttaagcaaccaattttgaagatctgaaactcatgctgtctccatccacaaggaccatgaatctatatgaatgtaattgttttatttaatctattattatatcatctatcatttttattttcaccataatcttgacacagttcattatagcataaaatgataacctctgtgaaaatgacttcatgtgtatttctatgaactgcatgtttgtctgggttctgcaagtctgcagactttttgcttttactatgttcttaaaaattagtggtctgagaagaggcattatatttatttatttattattaattattattattattattatttttgagatggagtttcatcttgttgcccaggctggagtgcaatggcgtgatctcagcttaccgcaacctccaccacctgggttcaagcaattatcctgcctcagcctcccgagtagctgggattacaggcatgcaccaccacacccggctaattttgtatttttagtagaggcagggtttctccatgttggtcaggcaggtctcaaactcccgagctcaggtgatacgcccgcctcagactcccaaagtgctgggattacaggcgtgagtcaccgtgccaggcccgagaagaggcattatatttaaatataatagtcttattgtattttatcagtttcttgataataatcctttaaattatggatatttgatcaaaaagagaggtcagataagcaatgagaaagagagaaactaatgaatagaaagagtaagaaagggggctgggcatgttggctcacacctgtaatcccagcactttgggagaccaagctgggcagatcacgaggtcaagagatcgagaccatcctggccaacatggtgaaaccctgtctctactaaaaatacaaaaattatctgggcgtggtggcacgcacctgtagtcccagctactcaggaggccgaggcaggaggatcgcttgaacctgggaggcggaggttgcagtgaaatgagatcgtgccactgcactccagcctggcgacaaagtgagactgtgtctcaaggcaaaagaaaaaagggttgaagatgttcctggaaacatgttttgcttgatgcaaactccttacaaaatatttttggaaaatttctcctgccttagtcaaggagaaggaaatatctcagagtcacgtaaatactattctgaaagacctacctaaaaaaataattggccaatagatatcttagaaaattaaggtatggtctagaacataaacataacaatatttgttatatattacaaataaaagacaaaggtgatcccattttatgacaagaaagctttcttggttgaactgttaaacagaggctatatcgtcaatggcatgcctactatgatttatttcattcctgttatatagatgcatattaaggtacagaaagatcagttatcctgccaaaagtcacctagctgggaactcataaaactgggattcaaactctggccatctgacttcagattctaagctttttttctttttttaaatcttaagcttttaacctctgtcctatattatttgggttttccagctaggaagattgaagcccttgaataattttgcccatttaagcaccacttcatagcaggtagaaaccaccccttctgaaattgacaaatgggaatggacataattgccttgaacatggaatgagacgaacaggcagatggcagagatctaggagtttctgcaggattttgcccagtggtggctgatgactgggtaaatatctagtttttatctctaaagtgtagcttttctttggaatttgacattttggtgcttagccaacttgcaggagaatcatccgtcacataagttgagtagtgtggcaatttgttttagtagctatttactaagtcaacaacctaactgctttgtctttgaaagtaggagtattcatgctcatttatatttgggggacatagcaggtagcaccaagtatttgtgtcatcaaattgactggcatgccacttgtgtagtagtatttctagtagagctcccactggaatggaaagaaactaacagaacactggaaccctagtgaatagcattcaccatgagaatgaattcagtgcagtataaggtggtttccattttgtactacatcaaagaggatttaattcctgaaataccaaaaaacaaaacaaacaaacaaaaactttattctgaagccagctcatttacaaggtacaattttatatatactgctatttttgctattttttgctattttttgatctttatatgtcaggtatttagtaaatatattcatctcattcgtgaagtgtttattatttgttccatcgtatacattttaaaactgagattcagggagaggtcacacaattggcttgcacacagtcatgcaacttttaactggtatttgaaaccaggttcaataggctcaaaattctaagctcattccaccatactctaggatctcctgccagcccttgattaaaggtcaaagggccaatgtccactggagcagtccacagaaatgctggcttttacagagataatggagttgggaagcccccaggtgtacatgtggattatagtgacatatgagagaaggaaaaagattaatgaattctttcataggatatctactagggagaagctctaaatttcctcagaatatgtgaatggctatcaaaaatacagagacaggacaggaagaaaagtcttggtggaacaagttggtaggagtctcttgaagaacttcagtatcacattttaagccaagaaatagtttcccctcctctaatggtatgttaccattttgtacctgtaggaggcactgacatgtgtcttcatcactgtgtctcaaagatgacattctagatttctttctttcttttttttttttttttttgtctgttactttccattttcagggaaaaaaaaatctattttagggtttccttctcctcccctgccagtacggttaatattgccagaacaactttagactttagatattaagaaacattggcttaatatgacaatttgattttgctgttaaatttacatgtaaatctctaggcaagttcccatcttttgatatttacttaaaatatttactttcacatgtatacatggcacttggaaggaatgcattaagatgagtgttgatttatttgctttattctttagtacctaatactttctgtcctgaaatgaattagagggaagttattatataagtaattatttatcttgaagagtatattgataggtaggctgtaccttgacaccattttctcaccttcaacagtgtatggtagctggatgttttggatgttttcaaaataaacacctatttgtagctatgtttttagattcatctctaatgctgcactcacgggaaaaaatcagcaggcctgtattaactagaaaaccacttttatgttgtatttcgatccattgaaactaaagctgattagcactttttgaaaagtgattctaaatctttgtgctaatcaagggaaattgagccaggttgctgctacagaaagctggagagaagacgggatgtgatggcaagttcctttttcattcatcctgcagcatgtagctgggtgctatacccacccctttcccaacaaaccactctcctaagtgcttgtttaataaagcagcacagcaggtgaatatttaagtgttagtgggattcacacagtttcatttcagtgcaatgaacagaatagaagagaatttgaggggcggggggcttttttctagcatgctgttaagaaaagtatagagactgttgcacactaatgatacaacggtaatttgaagcaggatgtgtttgatgtgcatttgctgtgcgtgtttactgtaatcagtggctgtttatccttgggtggtatgaagccgactgcccaccttctacatttggcagtaatgattgcatctaagaaaaagctcacttacctccagcacctccaagtggctgcagactttaacagctggacagcctgaaggtaggcttgacttgtcacagatttctactctttcccaagcaatgacaccaaagggatatttgccaatccctttcccccttcattcttctttgggggcttttgggaatggaagactctttcttgttttcctgctgtctgggatggagtagcagatgccaaggaatggcgtggagaaaggagaggaaggtatgataatatttagttttcttcttttcatgcttaaacagatagaaggaattttcagagcaaaatcttgtttcaagtgtatggccatttttcaattaaagtcacttattaacctctatgtacataagcagaatctcctgagtctctctgaagacacaaagagaaaagatttccttcctccctccgactctctccaaatccccaagtgacactcataagctggttgagagggtgaaaagctcacaaatgtgaaggcagaagtcactttgcacctttctggcacgaaaactttgaagtcttcttacagaggaactacactgtgtaattcaaatttttaaaatgtacattcaagtcggactgcagtttacctgctaatgctgttagacggctgcctggtctaagctccagctgatctgtggtctctgaaaagacagccacacaaagctgcttgcatagttccctaccactccaaagggctctccaggtgcacttcgttacaaggattgcttcgctagtggactttgctgacattagctctagtttgggtttgtctgtttgcctgctatgaaggtattgagggatcttagaaagccagaaagaaaagagttgtcaacagatgtgcctttaggagagagactgagtggactcaaggattagtcccagcctttcggaattgtctgtggctgtttcatagctgtgatgattttgatgagcttttatcattgcttttcctggcagcaccatccagggcaataaggataagccttgtcggatggttcctgaaattacttagaaataagttgtaatctcaagaattgcagtgtagcggccaaagaagttttacaagaagttgaccaggggatgatgtcaaacaaatggaaccttaaaagttgactttttcctcctcaaaggctgggtgcccaggactagttttaaatgttccgatactcaaaagaaaaattcaaatcacataagtgaaccctcttatttattggtgatgtcagacaagacttatacctctggggtgtgctagctgggttagaacccctcactgaatattgagtatgcattagtattcgaacataatttcttttcatttttttcaaccttgatattacatgggcttaggcctttctttctcccagacaacaaattctctttgaacaaaagtatgatgccgtatcattttttttctttcttttttttttttttttctttgagacagagtctcattttgtcgcccaggccggagtgcagtggcatgatcttggctcgctgcaatctctgtctccccagttcaagcgattctcctgcctcagcctcccgagtagctgggattacaggcccccaccatcatgcctggctaatttttgtatttttagtagagacagggtttcaccatgttggccagtatggtatcggactcttgtcctcaagtgatccacctgcctcagcctcccaaagtgctgggattacaggcatgagccactgtgcctggccgccatatcatatttttatacccagaataccaaaaaaaagtgataggcaccaaggactgatttagtgttcctgctttggagaaaatgagttgacttagggtacccctacagcttcatagtaatgatttgtgtccttgttctaccctggggaattttactgagatgaattaggaattagtatggggatggggaggaaaggagccttaatcatagtggcattaacaggcaagaggaaattaaagtaggactgctagacacctctcaaccaaccaatcaaccatcctgccacttgccattcaaagttaactaaacgagctggacgtgatggctcacgactgtaatcccagcactttgggaggccaaggcgggcggatcacttgaggtcaggagttcgagaccagcctggccaacatggtaaaacccattctctaccaaaaaagacaaaaaagtagctgggtatggtggtgcatgcctgtagtcccaactactcaggaggctgaggtgggagaattgcttgaacccaggaagcggagctgcagtgagctgagatcatgccactgcactccagtctgggcgacagagtgagaacctgtctaaataaataaattaaattaaacaacaataaaattctagctcacttggttttgtctggttacaggttccttaacaggtgttaaatggcagaaaattcccaatagattgatcagcacttgactttttcgtagtatttcccaccagaataacgtctgtagaagctactctatccaggatagtcctgggggatctctggcagaatataaatatttctgctgtgtgcagcagcagctgtagcttaggaggagcaatgggcgtgggttttgtggtttccttctgacttttcagggtagctcatcacttcgaccacaaaatcactgccaaccttcagaagagggaagaaggattggccaacctacattttcttttctttttagggacaaacagtgacttgagtttttgcagaccagccggcttagttgtgtttggagtttcccaatatagtctttgcagaaatgtgagttggtttttacgttgccgcaaaccaatcatctgcattacaattggccttagtcctggaaccacagaggtggtttgctttaccccttgactcaagttgcctaatttctgtgtcactaggaagaaccaacacctctcaccagcccatgagttgtgagacagtaagcactgaaatgagtgatgaatgcggggtagccatttgttaaaaaccaggagtcatttattcattcattcaactggtatttatgtagccctcctaaatgagtcaggcattgctccaggagctgtggatactgtaataaactagatccctagtcccaaatattcttttttttgaagttccagatagtaaatatgttaggctttgtaggcctcaccatttctattgcaaccattaaacggtgacattttttctttttctgtagtagcagccacagaaatacataaaacaagttcaagctgcgttttttaaaaaatcttgatttatgaaaacaggcaatgcatgaaccatagtttaccacctctgaactagaccataacttgcccttgttgagcatacattccagtcacctgcacttgatttctactagatggctttattgtataaggaagatatgttcttaaatactacacctaatccaaaacaagagtaatgcaaaagcgttaaaagatgcataaggtaaaaaaatcctaaaaaggttaataggtcgataaacccaacaaacaaaagagttcataaaagagtcaaaacaggccgggcacggtggctcacacctgtaatcccagcactttgggaggccgaggtgggtggattgcctgaggtcaggagttcaagaccagcctgaccaatatggtgaaaccccatctctactaaaaatacaaaaattagccaggcgtggtggcgggcgcctgtagtcccacctactcgggaggctgaggcaggagaattgcttgaacctgggaggcggaggttgcggtgagctgagattgtgccactgcactccaatctgggtgacagagcaacactctgtctcaaaaaaaaaaaaaagaaaaaagaggcaaaacatagcaatatatattttaaaactttctggtgactcattggttactaattatggaatacgtttttctagatcttaaacattcataagaaaacaaaatcatctttagcttttgatgaattgaccattcctttaatactatgaaggcagtaggaaaacctgtcatgaacttcagaaatctaacaattttaagaacactccatcccattatatacaaactactgcaaactccataaataatttaaaggaacaagttcataaacctggtgaatttagaaaattggtcattcagcacgctgtctttggtgaattgaccatttgttgatttggtagcttggcatgttgcttgaagcaaatgaatctagaactggtaagcagagttctacacacatgttgtaacttaaaatgctctttggatgaatggccgaatacatgcctgggaccaaacttgcttgtagaatggtatttattgtttaggttatagaggttgtcaaaaattcccacatggtaagggaatttcattcatgattatgcatagagaattattgctcctggggttcaaaggctaactcattattttcaggcttactgaaggtccaggcttactcattatttccccctaatgttttatttataaattaacataaatgtttaaacatgtagaaaagttgaaagactcatccaaagcacaccttatatggtgtatggattttgaatcataagtggtaggctgtttccaaagtggctgaaataataccaactcaaatctgttttaggaccacatctttttaggagtgaccagagactgatctgaactatttctagttctcttttgtgttttggggggaaaatgcataaaatactccttaactctagattgtgcatgttcttgtagttgcttggtcactcttttgaaacaaaggccagtgatgcccattgcaattgctaaggtatgtctttcctgtattctaatttcatctaattgatgcataacaaaaattcaagaggttagtgtcaccataacctgtctccttcctcctgcctgtataaagtaccatgtggatctcaggaagaatttactagctacaaaataaaatatagaatgtagtcttccacattatagagttcctttttttttttcatgtggaaaggaatgattgagggggaaaatgaattgtttgacatctaaccatagaaagaaaaattagttttctctaacttctccaggctctgtttttgtttcactttacgttctgtgtgctactggtctggggagaaattatgacatgaaagggagtagtttcccttcagaagattcactcacaatttaatagtaatcacatgtctgggaaaatggaagggttagaaatattttccacatcttttttggtagtcacctgcattctgataaatgctacaacctattcatcactgagtgttttgtttgctgttgctgcctgtaggatgatatattcttgagctgttgacatctagctgtattatctgctttggccaatgaaatgagagctcaagtcacctgtgccacctaggaggaaaagctttaagcgccattttatggcttcaccattctcatgtttccttctgccatgaaaacagtaacgtctcagaggccaggtgctctacagcgtgggtctcaccatgaagaagtggagcatagcccacagccaaccctcaatggatgtgttgttgaaagccattgaagtgatggggtcatttgttactgcaacacagcccactggcatgacatcctcatcatactgttgtgcctgtttatagttctcaggttctagaatggaatcactggaagattctaaacctggacttgtggtgatgatgagaataagaaagggcattgaggtagttgcatttacagcactggatattcttatctgcagagattggttgttctagaaatctttctccttctttaatgctcctcacttcagccctttgagagattttaagctgaatcacaaacaacttggccaaccttatgccaggtcatctaatttctacaacatggtttgtgtgtttaatgataaaataagggctccatgaaggcagaggtttgttcttgatggtgtatctcaagtgcctggcacacagtagatgaccaccaaatatttggtcgatgaaatgtgctatgtcatttattttcaatgagtttttcctttgattttattttactgaagtgtatactcaggataatcacattcctttttctgcctctaatagaaaatctgactctggatagtaggttgaatatgtatttgtttatttatttagagacggagtctcacactctgtcgcccaagctagagtgcaatggtgtgatctctattcactataacctccacctcccaggctcaagtgattctcttgcatcaaccatcctagtagctgagactacaggtgcctgccaccacgcctggctaagttttgtacttttagtagagatgggggtttcaccatgttggccaggctggtctggaactcctgacctcaagtgatccgcccacctcggcctcccaaagtgctgggattatacgtgtgagccaccgcacctagccgaatatttatttctctaaataaattgacaccacaagtgaaatcaccaaggggcatagcctcagtttattataaccaaggtgtctttaatcacttgaaatactagtagtctttgcgtaattttagggagaaaaaaacattaaaacttgttgtttaacagaaaaagttgactgtgaactagtactttcctaaaattcaggattctgcttgacttttgaattgtgtcagaaaggaagcatatataccaccatattgtactcacagcctctctgagccatgacattgatttaagcgggaggggctgctatatttccacagacttagcccattcactcatttcctctgctttgtcatcgttaggttggatttaagtagcattactgtaaaattccccactgagaaatttcaacatgaagtggctttctgatctctttaaaataaaatggttaaaaatagaccttgtgggaacagttttccacttcaagaacaaaaccctgcaaaaatgttttaatgcagatttgggacctaattatttttttctcacctcagcttggctgtagttgtgctacagtggagacaacaagtctcagtgttgcagaatctggccagaaaatgctctccactccctgtgaaggtttcctattgggttggccattgcttacttcccttcccctccctggagcttttcttggggtggcggctccaactatgaagagcctacatctggttcctcattaattcagcgacttctctcatgaggctagggaaggcctgaccatttcagttgcgccggcctccggtttttgcaaacattaaagtctgcactgggtaaagatgaactgactaaaaggaaagcagcgtgcaaaagatactctgtcattaacatccagagtcttcaaggtactcagtcattagggctggtttaatcacgcctctgtgacatgaccagagccttagttagctttgaggcacatccaggggttctctgttagaaaaacgggttcctggctggccatatcgttttcttatttcaatgtcatccttttttcccacagcctggtagctgaaatgtctatggcatttcagcttacttgtgacattcctttacaattttgttgtttactgttgtagttctaataccttagaaagatggcctccgacttaatacgcgcttccgtaaatatctgtggaagaatgaatggtaaacaaatgaatctccaatcactagtgactagtaattgtttaattttgtgtcagtcttcattactttcctgcctgataggaaagtaatgagagagaaaacacaaagtgttaagatcttttataaatagatgctatgccatgccccacatctcccatttattatcattattattgttatttattttatcctacgtccttacctctagcaggtagaaaattcttttttcaaaatagtaaataacccaaattctattttatcaacaaggaatggaatgcatttcttaaaattcccattggaccacatatgtggaacattttaaaaaagcagttttataagcatccatccttactctctgggtctggagtctagtatgttttaaaataaatttgggtgtttctgaaataaattgctctgtgtttctgccttttctgttgcaaagttctaaattatggcatactcttttgcattctctcttttgacacaagtactccttgtttctctgtctcttaagtcctgtcatttaaaattcatttcaagtgtcatttcctctggatatattccttgtgagttagatgcttctctgtcccagtataccccgatacactctgagtacacttccacatagagtatttatcaccctttattgttgctgtttgattaatggttagactattagactcttagtgcccctaggccaaggcctgaatattatttatctctacatattgggcatctcttatagtttctggcatggataggtgctcagaatatttgttgcatgaattcatttgtgttctttaggttctaaggaaagcttcagttcagctttcagtcttcagcatttctcttttcactagccagttgccctcttccctgcctggagggtttgaatttagaaactggttctacccactgcagtaagcacccacggtcactgcccactgcttgcatggggagaagggccagatgggcatttgctcatctggaaacctggaatcttggggcctgatctatgttttttcagcttttctttatattcttctctgtcctttttttcttcttccctcaactcctctccccaaagatggtacttggcaacggataatttttgcttacttagaaacttgaataccgtggaaatctaacaaataaaaatgaccctgaaaagtctctagaatgcattgggaggattgcctaaaacaattttgcatgtggaattagcagttggggctctgaaattacacctgttattttagaaacaagaggctagaaggggcaaatactaaggcttcttcctttgccatcccctacctttattattttatttatttatttatttatttatttatttatttatttatttatttagagaggtagtttcactctatcacccaggctggagtgcagtggcacgatctcagctcactgcaacctccacctcccgggttcaagcggttctcctgcctcggcctcccgagtatctgggattacaagtgcgcaccaccatgcctggctaatttttttttatatttttagcagagatggggtttcagcacgttggtcaggctggtctcgaactcctgacctcaagtggtctgcctgccttggccccccaaagtgctgggattacaggcgtgagccacggcgcctggccccatcccctacctttaaatgatcatcttaggcggctgatttccagccttcatatcaactcacagagaagagtaccaatatttctattgccactgttttttaacgtctaatccatagaaaacctgaccaacataacaatactttgttccttcaagctgcagtttaaaatcttttatttttgcaccttatatgtgtagaaaggagactatctggctaacactattgtcaaagccgctaatggacagttaggaagaaggaattcaggaaatgaaacagtgctgaaaactgggcagtgtttaagatgcagtcacctgtatctgtgctttgacactaaagaagatggaaaaggaatatatttactagtttcttctatcattggtattggaatccatttggatgaaagactttctgaagctcacattgtcagtagtatgctgcctagatttttgtgggcacatgagtagcagagtagatcaattgaggggattatatgatagctcatctatcaaattacccaggataattgaggaaaaggattgttcttttttttttttttttttgaggcagagtctcactttgttgcctaggctggagtgaagtggcacgatctcagctcactgcaacctccgcctgccaggttcaagcggttcttctgcctcagcctcccaagtagctgggattacaggcatgtgctaacacacccagctaatttttgtatttttagtagagactaggtttcgccatgttggccaggctggtcttgaactcctgacctcaggtgatctgcctgcctcagccttcccaaagtgctgggattgtagctaccacgtccggccaggattgttccctttaaaaagatataatggaaaaaacattaaagatctaaattgtcatacaaacttgacaatatatattcataattatgcattatgacatactctaccaaagcctttttgtacctctctgttcatttctatttaaaaaagaaatgaccatttaaaattaggaatttctcattgttagaatgaactagactggctcattatacccaaatttactcaccagctgctttgcacctacactaatgctgaggctaacaagagtgaaaaggattaaagtatgttagtcaaaggagatacctaagaaattctcctaggccactttgtagcatatttaccacattacttgtcttttcaaatggaggaagatagccatagtatgttatgttttgttggcattttaaacaaacaaactagaaataccaaataaatctattttgagtgttgataaactcattttttatatgaatgttgaaaatcaccccaatcctattgggatgcatatctttagatgtcactttaactctctcctttaaagtgagactgggcgcggtggctcatgcctgtaatcccagcactttgggagtccaaggcgggcagatcacatgaggccaggatttcaagaccagactggccaacatggcaaaaccctgtctctactaaacatacaaaaattagccaggcgtggtggcatgcacctgtaatcctagctattcgggaggctgaggcacaagaatcacttgaacccgggaggcagaggttatagtgagccgagatcacatcactgcactccagcctgggtgacagagcaataccctgtctcaaaaaaaaaaaaaaaaaaaaaaaaaagtcacaggacaacattggtcttaaccatacttgctaattttctccattttcttaacccctctcaacttcatgggaaattgtagtttcgttgtcagaaagaagtttgcatatatagattacccttttaggcaactattatgaattgaccaatccacgttttaactgtaagaactcagtctatttgggctgctaatgaacaatagaaatttatttttcacagttgtggagactcagagtccgagaccagggtgccaacatggtcagcttctggtgagggccctctttcaggttacagactgcgggcttgtcatcgtattctcatgtggctgagatggtgaagaatcattctgcagtctcttttataaaaaagatttccaccctcatgacctaatcacttcccaaaagctccacatcatcatcccatcggtatttgggttaggatttcaacatatgaaatttgtgggagacacacattcagaccatagcaaatactaacactctttctctttaacttctccctaacccttgaagaaaatttagaatctatttattatgtaaaaatcccatcttggcttcctcaaccctaaactggacatgcatttctttcttttttttttttttttctctgcttcagtattcgctttaatatgtgtttggagatctttgaaagtgattgaatagtagaaaaatttacattatagaaataagataccaaaacacattgtataatattgccatttctttcttttccattttgtgaataatcaaaataataatttgtcttgaataaaagataaataacaaaatcagctttgctttaatgctgcacaattagcagctatccaaacatattatcagaaacatattaaaatccacattccatatttttaggtaacaacacactgtgcattgagatactcttcattttgtaaattaggtaatccccctaacatttgatagtgttattctgagttcttatctgtagctatacagtcattgagctggataaattgttgcaatgtagcaattaagaacatcctttttttttttaatccacaagttcagtaaattacaacttgattgtctgagtaaacaatgttacctgctgtggctgctttcttgaagaacagagttctgcatgcaaattaatagcagttagtaattcccagtatgatagagcatactcttcccatagcttaaacttcccttcatccaccctaggaaaacagactaagtgaaatatgtatcatcatcttattttttctttccctccctccctccctcccttccttttccttttctttcttttgaaacagggtctcactctgttgcccaggctgcagtgtagtggtgtgatatagctcactgcagcctctatctactgagctactgagcccaagagatccttccacctcagcctcccaagtagctgggactacaggtacacgccaccccatgcagctaattattattttttttatttttagcagagacaaggtctcgctatgttgcctaggctggtctcaaactcctggactccagtgatcgtcttgcctcagcctcccacggtgctaggattacagccatgagccactgagctggcttattttttctccaattccttggccccaggcaaccgtgcccaccccagccctaccctaggggatactgtggaagcagttttagaagacaagcctcagagtgcctgatgacccctctgtctcaccagtgcatttagcagtaccttactgaagcacacacaacctaacctgaccatggtaactcattttctcattagggaatagaagtgcttgtggaccagagcccacctagccgttcttgcattggggtaacttgtggtatttcagtgaggtcccgctcttgtgtactgtatatggttcagtgtcagataatttaacacccaagaaaatctgccttgcatacattagaatatatttgcaaattaattggttaattagattttagatatctctaggggactgagctgaaacagatgtgtgcaaaagcccctcacggggatgaggataaagtcttcttacaggctttctgaacgaagagttctatcatttgatcctattgttggtgccagagtattccagtacatgcatttatgttgaaagaaacagtactgcatttttgtcttgaagttataggaacatgctcagaaggttccatgctctcaaaataattgtactgtaaaataatgaaaacactattagggttgattttttccttgattatatcagaaaaccatgggagaatacagctaaaactaaacaagggcagattagggaaggcttttaaatacttctgtaagatgcaggcaatgcataggaaaattctatacaacagccaaagattgtgctcaggacttggagttagagatcagccctttttacatttttttcccagttacatcggctagagatttgctcttttaaccttttttctctctattgctttacccttctgcagaatagaaactcagttggtattcccctgaatgctgtttataatactaaggtgatgttttaaattggatcattaaaaaatatgttttttattccttcaatcttttgtgtgtgtgtgtgtgtgtgtgtgtgacaaagcatttatggtatacccactgagtcctgatgtggatacgggacaccaagtagagtgatactgtccctgctttcaacaggctcccaatccctttatcctttgtggaatggtaaagttcatctgtattttctaacacttggagtaggaagaggcctcctactctggagcaagttgcatgacagtaaaataaatgtggatggagctaaggactgattatgaatgagccatgtgtccacaattcactctagggtaaatagtacagactgatggacaacttgctagaatttggaaacaaatggtgcacccaagatcaacatcagacccctccttgctccttctacttaatgcccgttgatacactgatttttagctcagaggatcacctttgtatcccctgtgcctaggaaagtccctagcaaataacagactagcatcaaatgttgaatgtgagcagatgctcagacataacaattctcagatgtttgaataagagagacctacaccttggcaatcacagaggaaagttattggtgggagatgtgttttaatgccactgagcatccaattttaccatgagatttgagagatatgtcattatcacatctaattccttcagttttagttttgtttatgtgttaagagaaatgagccatcacggaaataattgaatagtttggtcatctttagatgaagttttttcattttcctaattttttttttaaagtaaggagcaaagtcttaaaactacagaaacaacattttcatttgaaatcaatagtgcttcaaggttgggggacattgattctcgcaacaggggtagcaacatcacctcattgttttcttcctttgtctctcatagaaaaatgagtatttttctgaatcttacaaagtaattcatgatccaaaggactatttgatttgattttttggaactacatttattaaaagtactactcacctaacattaccttatttcaaggagatatatatgtgtgagtgtgtgtgtgtatgtaaatataaatatgagggaaaatgaatgtttatggctaaggaatttgaactccacccttccttttcaagtagaatccattaaaatgtagcttaatgaaataggattattttaaaatcaggaatagcatttatatgctagagattattgcgtttgacattaagatgtagatagtataaagtgataagttatattgagaatgaactttgttcctgctacatcatccttcaataaaagccagtattgccagaaaaagaaggaaatttactaagtgtgttttatttgaatttccagtcatagtttaggacaaggaggtagatactttggaggatttaaaaaacttctggtaattgacttcatcatgcacttgagaccagaacattcctgtgcatcctggactcagagagttgacctgtctgccagccccttagccagctctgagttgaagctgagcttacagtttgtccttccaatcctctgcgccaaacaaataaatcactatttatgggcaagattgagcttcaccacctattggaacttctgttccagtattagagattggcacattggttttctttcattaaattcttcctcatggtggatatggaggcaggcttgggcaggctcactggggttcacagagcaaactggaggacatgggtctggagagaagcctcatccgccaaagtggggcagacactgggtgggggcctgtgggcgctggcgggaagtccagcccgccaggcagaacacacacagcagggaacatagagttgtgcaaaaagtgagatttttggcaggcacttggctccggggaggtcctgggggccccaggccaggttagtggaggaagtccaggaggcagcctgttgagggctggctactccacatcagcattaatgtggcctggcagtgggtatcaggccctgctctatgggctggaattttggcaggacttcaacatttgttccgtgacatattttcatagtaacataccccttggtcgtgaggatgtgtggaagaatatatatagcctctacctacctctactgcagatactaccggcactgacttgtctcatgcctctaatcccagcactttgggaggccgaggtgagaggattgcttgagcccaggacctcaagaccatcctgggcaacatagtgggacctcgtctctacaaaaaataaaaaagtagccaggcatggtggcatgtactgaggtcccagctactcaggaggctgaggtgggaggatttcttgagcctggtaggttgaggctgtggtaagctatgattgtgccactccactctggcttgggtgacagaatgagaccctgtctcaaaaacaaacaaacaaaacatttttaaattaaaattaaagaagctgaccagccatattggcttcaatgattcccaacaccatccctgaaaaactgtggcctgggaaatatgatgatgtgcttgtggcttatacttagatcacatgctgcaccctaggagtggtgatcagtcccacctaagccaaagggactgagtggctccccataagggaataggtgagggaaaggaggatagcaattatctaaggtgggaagccacagggatgccacatacagagggttgcagctgaaatcgccttagcctctcttgatgaggttgttaaccctggtgtagggatcatttgcttggagaaaagaatgaatgaacatgctggtggctggtggtgatccctggagccaagttcctgagcctggaatataaagttaaggactttgtgtctggaacaagggaaattccagctgtaagaagctgagacagataattaaaagtgcttatggcattagtcgtgtgctgaagccctcaatattgagcccaagtttctcagggcttctctattagaagtaaactggtttctagaaccgggggttgaattaaacttatagatgaggcagtcatgcaagctcatatgatgaaacacataaatggtggtgttcatacacattgaccattaccaggctggttggttgataggtatgtttatgttcagaaaaacaaacagcctccgaactgcaaaagagctttttaaggaataaaagcaaagaatgaagagggcagggagaaaaaggtatttagaagtgggtagatctgaaggagtcacagtctctttgtagattggtaggaggttatcaaggctttcatctccaagtttccaatccagccaggttgttggtgactaaaaatcattttcctgtgaccatttgctgtttggtggagtgtttggaatgagctagttaatcccagtccaattcataatgggcaggtagccagttcacacaaaccaccttgaaaatccacactaattggtttgtctccatggaatagccaaaaatggaattgcccatggacggacattttcttctacccaccccattctttcatctctccccactcccaccactacctctagcaggagtgattttacatttaaatagcatctcttccccactcattttcctgggctataaatttcctcaagctttttttttttttctgaggtggagtctcactctgtcgcccaggctggagtacagtggtgcaatctcggcccactgcaccttctgcctcctgggttcaagcagttcttctgcctcagcctcccaagtagctagaactacaggcacgcaccatcatgtccagcgaatttttgtatttttagtagagacgaggtttcactactttggccaggctggtcttgaactcctgacctcgcgatccacccaccttggcctcccaaagtgctgggattacaggcgtgagccactgtacccagcctcctcaagctttcttttttaaaagaaggagtggcttagaggcaaggaaagtaaactgaatgtccttgagacattttcagggtcaccaatgtttttagagttggtcttatggccaagagtagcaagaaagaaagctatctgtgaacagaacaaaatgcacttcattttttttttttttttttttttgggtaggccagggaagcaaattcctagacaaagattcatacaacctgaaaatagtttcagacagatctacttagacacacaaaaacttctaacagctcacagaatcatcgtcaagaatggctaatcatgcactactgggagatacccaacaatggataaaattctaggtttccgtaactttgatagctagttcctgcataaatcatcacactttacacctgtacagtcagttctgtgccatccccactgtccttgagcttggttaattctctgggcatttctaagggcaagtgggattgatagtatttgctccattttataaacaacctgttcagtcggctggctgggcagccagtagctcattacagcacgtttgtgatgtggagctggttagagtcctggctgtgtccttcaccagctgtgtcaccttggtcagccacttaacttctctgtgcctcagtttttatcagttatctctgaggtgaagtctctgcttaattgaaaattatattttgaattaaaaatatttttagtatttttcagattttaatagtttaacttctttgtttgagactgagtctcactgtgtcgcccaggctggagtgcagtgccgcaatctcagctcactgcaacctctgcctcccgggttcaagcgattctcctgcctcagcttcctgagtagctgggattacaggcacgtgccaccatgcccagctaatttttgtagttttagtagagatggggtttcaccatgttggccaggctggtctcaaactcctgacctgaagtgatctactcaccttgacctcccaaagtactgagattacaggtgtgagccactgctcctggcttaacttcttgtatgttgagaatatacacaagaaagacaagcctccatgaaatgataagctctaataccctcttcctttattaatgtgatattgctcacccccttctcccttcaactgatggtaaattaaagcaatataactcggtgtaaatatttgtcaacctagatgcatttctagactttcagtctgtgaagacacctggttatttacacgatttatacgattagtgccatcatctccagacaggatgaatattgtaatacaagcaagttttgctatgagtcttgacagtcagaaataaataatcttatctataactacatttgtctgtagaatgaggaagatagggaacaatgagtgtgaaattctccaggccccccaggttacaagaaggatgaaggaaataaatctctcagtaagtataagacaaaaggaagtcatttctaagtaagtccactggatgtttttctcgctctataatcacaaagtctagataccactgaatggaagatgacctcataggctcctctttaccactggttaaaagtaagggagaccagcctgggcaacatagtgatacctcatctcttcaaaaaacctttaaaaaattaggcagatttggtggtgcagacctgtagtcccagctactcaggaggctgaggtgccaggattgcttgagaccgggaggtcaaggctgcagtgagccataattgcaccactgtacaccagcctgagcgacaaagcaagaccctgtctcaaaaaagtaaagaagattttatttgggtcttctggcctctgtgaaaatctaataagtgggaagtgaaatttacagaggattcaagcaaaatcaacaagtgtttgtatggagtcagtcagctcatctcaaacacacctggctctgagatgttcatttgggtttctgtcatggtaattaatttctgatgcaaataaatgaatactagtgttatgaactctatttttttaaaaaaaaacagcttctacttttttgaaaaatctgtgtatctttggagaagaggaaggaagtagggattatctagaccaagcttgtccatcccacagcccttgtgccacatgcagaccagaacaactttgaatgtggcccaacacaaattcataactttcctgaagcattatgagatttttttttttttttgcgattttttttttttttttgaggcagagtctcgctctgtcgcccaggctggagtgcagtggcgctatctgcgctcaccgcaagctccgcctcctgggttcacgccattctcctgcctcagcctcccaagtagctgggactgcaggcacaccccaccatgccccgctaattttttgtatttttagtagagacggggtttcaccgtgttagccaggatggtctcgatctcctgacctcgtgatccgcccgcctcggcctcccaaagtgctgggattacaggcgtgagccactgctcctgatcgcgatttttttttaaagctcatcagctatcattagtgttagtgtattttatgtgtggcccaagacaattcttcttccatcctggcccaggaaagccaaaagattggacaccctggtctagactgttcccaaaaaaggcaagcaaaacttagtgacagtgctgtgtgtgtaaatcactggataaggtcaaggatacttttaatttagggagaaagaaaagtgtgtaaacctgttccttagtctgggaaagaatgaagtctttttaaaaatttttctgatttttgtgtttttgttgttgatttgcaatatacgctttaagaattttttcttaacatctttttgctgggacctatttctcagcgttgttctctcccttttgagaggacggagtaggtatagaattgtcttgctaatatgtcagtgcaggaaaattccatacaacctgttgcctatggaagagattggaatgaattgtagcaggtgacaggttaactggtagcagaaaccttttctgcaacatgtaaacaacttcatccttttgaaaatcgggtccaggtagtaaaagctggcagtgatttatgctgaccgggcttagagctcctcatatgcatatataaaatacctctgggctctgcggggcttcttaaagaactacgttagttctgctccttccaccttcttcctcaccctgcgttgctgacatatctgaagtgcccgcgagaggaaggagcaggatgtggagccatctggagccgggcagggtaagcacaggacaagcatctgctggaaactttgcagagatatctagtgcgctgatttactgtcctttggggagtccatgtacagaacccagattcatgaggaagccggcatctggcaaaggttggggtacacaattgtgcttgattatcaggacatatgataaatctgtctaggcgtgtactctgtgccagattgtggatttcttatttggcccgcatcagccgtctgccagcaaagcaatacaaaagtgtcacaacaacaaacaaacaacaaacatgccaaaaaaaaaaaaaaacctagacttagcatagtgatatcaaaatatacagagtcaccttgaaataaaacagtgcttctgagaatatagaagtgaagagcatgcactttggaatcagaccactaccgttccagtctgggttctagtgcatagtagctgtgtgtctgggggcaagtcacttcacctctctgtacttgttttctgctctgtaaaaagaggatgatactaatagtacttgccttttagagttattgtgagaaataagtgaaggttatataagtaaaaagtttaaaatagcatctggaaaattaagcaccatataattttgtgtttgtgttttctgtggagtacatgagtatgcatcaaagctaacaacgcccactgccctgttagtcaaatacctttgaccatatcacttcccttccttcctctgccaacacctccaccactcccacccagactggcttagtttccattgttccttgagtgtgtccagaatgttgcaacctggggctctgcatacatgctttccacttcccgaattattcttcccacagctccctttagggagctggcttctcctctgtcctcagccctcagtttcaatgtcacttcttcagagagggcatttctgagcaccccatctttactgagatgccactgtccacccataagcattctcacgcccacctgtttagttccctgtcatgatttgtagccacaggtgactggcatttgcaggacttcagtgtcagtaagccacagtctccacggaccacatcccattcctgtctaattcccctttgtagatctaacatccaattccagcagtgcctggatggaatgagcactcagtaaacactggtccccagtaagaataagcgactcactgactactgaaggaggtgcttttatagagtggattcaatatatttctcccttctgaggtggtcaaccctgattcctcctaatcccaccagtctccacccgttttatttacattgtcataggaatgaaagagaagttaaggaaataatcaaatacttcttttagagatgaggtgcagcctcaccttctgcatttggctatctctgtaactctttggtagggggctatagagcaggaagcagggcctattctttcccacctggctggttcagtgaggacgcttgccatgtggatgtgccccatctactggttgaattgcgtggctgcattcttaatgattgtaatgccctgtccattcagactctttaacagcagctgagactgtgctagagtttgtatcacactttattatcctgctggcaacaaaattaaccatgaagtgtgatttgcttacagagcgcatgattgagcatctctagtgtctaaattttcatcagtgtcgtacaaattcttttgtgtgggttttgaaagtttgaagctgtaaagtttcacactaatgtccgtggcttaaaatttatagtttaacatcagttttcaccgtttggtttgtcccctgtgtgcattatgttcaccagatttgcatcatttagggattacctctctgcaagatgtctcagagatatgagcaccacaaccattttttggtcttctcttgaggatctgggtttttaagacaaaaacttcaaggccgggtgcagtggctcacatctctaatctcagcactctgggaggctgaggtgggtggatcacttaaggtcaggagttcaaggccagcctggccagcatggtaaaaccccatctctactaaaaaatacaaaaattagctgggtgtggtggcacgtatctgtaatcccagctactcaggaggctgaggtgcaagaaaaacttgaacctgggaggcagaggttgcagtgagccaagatcatgccactgccctccagcctgggtgacagagcaagactctatctcaaaaaaaaaaaaaaaaaaaaaaaagataaaaacttcagggagcaaatggcatttccatgctctcctttcatacataccccccaaaatcgggacttaaattgcctcataaagctcaataagtaaattggagaagatagactttattggcttacttaaacataattattttaaaataacaaactagtccctgtgttgataaatgttttatatcttagctgctatgtctgaatgccttgtgtaaattatgaattagctagtaaatggacttcgcaaaggatgctcagtggggcctgtcagccaagggctaagtggatagcctttctgacattctactgctttttagctgttgtgttggggacgtagatgtctgtagtctcattgttagggctgaaagatatgtttccatgaggacccagcagagtaatagttccagtgggtagatgaaggccagatgatttggaaataagctcaaaatgtcctgtgtcgagtttggataattttatagcccacataaaacatttcatattaaagtcaaatcgttcgtccctatttggactaatgacagctgcttatttcgactaagaaagctgcttccagcatctgagatgagttgtatctgacctttagcccctttacctgtagaccaggggttactaactcagatgcctacaggggccaggtaagtgatgtaataaatgaatcaagccagctcagcttctgctaatttgccgtgagggagtacagcaggtccagtgctgccaaatcttcccatttttcatgagatgcctgaaatccggattttggcatgaaatctcatgatttgaaaatgttggcaattaatttaagaaaaatgtttagattcaacagggactaaaccaaatatatctgccagaaggatactgcttgtgattctccaatttgcaaccgcagatagtccctggcaaagattatctatgtaatagatactctttcctttacaaaggacatactgaatcaccaattatttgaaatagatttagggggcacaagtgcagttgtctgacatggacatactgcatagtggcgaaggctgggctttcagtttgcccatcatctgaatagtggacattgtacccaataggtagatttcttcttctctcatcccccttccaccctcccaccttgaggagtctccagtatgtgttctttcactctgtatgtccatgtgtacccattgttgagctcccacttctgagtgagaacatgcagtttttggctttctctttctgagtcatttcacttagaataatggcctccagttccacccatgttgctacaaaaggcatgatttcattttctttcattttttttttttttttttttttttgagatagaatcttgctctgttacccaggctggagggcagtagcgtgatctcagctcactgcaacctccgcctcccaggtccaagcaattctcctgcctcagcctcccgggtagctgggattacaggtgcccaccaccatatccggctaatttttgtatttttagtagagtcagggttgcaccatgtgggccaggctgttcccgaactcctgacctcaggtgatctgcccacctcggcctcccaaagtgctgggattacaggcgtgagccactgtgcccagcctcattttcattctatgtgtgtgcatggctgagttagtatcccatggtatatacatacataccaccatttatttaatccaatcatccattgatggacacttttcatgttgaaaagatgttaaatactatgcatatgcatataatcaaaatatatgttcagtaaaaccaaaaagcttccaaagtaacaaaatagacagtaatatctcagaagaataaggttactggacacatttcattgttgagtatttttcttttggctcttgcttttgatagaaaaacccagaagcaatatatgtgtatacaccatgaatgtacattcagttgggtgtgttatacctttaacttgcactaccctacaaggattcacctaacatatccatctagaagaatccccctcatacccataccacactttccagatttccaaatcaggagtagtgagaagatcatgaaaccatctctcaattattgttttcttcttttaaaaatacatatatattgtgtagttgctgacttattcttcctcatttttattctacagtctccacttagcctcccaaggggaaggttttgaactagtggctgggttttgtgcctctgtttttgaacactaagttctaagacacacgtcagagatattgtgtgtttggttccagaccacgaaaataaaacaaagagcacaataaagcaaatcacatgattttttctggttttccagtacatataaaagttatatttacactatattgtagtctattaggtatgcaataacatgtctaaaaaaacctcaatatatataccttaatttaaaaatactttactgctaaaaaagtacttgtgatcatctgagcctttggtgagccataatcattttgctggtgaagggtcttgccttgttgatggctgctggctgatcaagtggtggttgctgaaagtgagggtagctgtggcaatttctttctttctttctttctttctttctttctttctttctttctttctttctttctttctttctttccttccttccttccttccttccttccttccttcctgccttgccttgccttgccttgcctgcctgcctgcctgcctgccttccttccttccttccttccttccttccttccttccttccttccttccttccttctttcttttctttctttctttcttctttttttttttgagatggagtcctgccctgtcacccaggctggagcgcaatggcacaatctcagctcactgcaacttccgcctcccaggttcaagccattctcctgcctcagcctccaaggtagctggaactacaggcataggccaccatgcccagataattttcttttttgtatttttagtagagatggggtttcaccatgctggccaggctgatcttgaactcctgacctcaaatgatctgcctgcctcagcctcccaaagtgctgggattacaggcgtgagccactgtgcctggctgacagtttcttaaaataacacaacagtggagtttgccgcaacgattgactcttcctttcatgagagacttctctgtagtcttcatgaaagaatcgttttctccatagagaatgctgtttgatagcattttacctacagtagatcttctttcaaagttggagtcaatcctctcaacccctgccactgctttgtcaactaagtttatgtaatattctaagtcctttgttatcattccaacaatgttcaaagcatcttcatcaggagtagattccatctcaagaaaccactttatttgctcatccataagaagcaattcctcatccattcaagttttataagattgctgcaattcagtcacatcttcaggctgcacttctaattatagatctcttgctagttctaccatatctgcagtgacttcttctgaagtcttgaactccacaaagtcatctatgaaggttggaatcagcttcttccaaactcctgttaatgttgatattttgaccttctcccatgaattatgaatgttctttatggcatctagaatggtgaatcctttctaaaagattttcaattgactttgcccagatccatcagaggaatcaccatctctgtcagctatagccttataaaatgtatttttaaaataacaatacttgaaagttaaaattactttgtttttttgagtcagttttgttctgttgctcaagctggcaagctggagtgcagtggtgctgtcatagctcactgtaaccacaaactcctggtctcaagtgaccctcctgcctcagcttcctgaatatctgggactacaggggcatgctgccatctgggacttttttttttttttggcggggggaagtcttgccgtgttgcccaagctggtctcgaactcctaggctcaagcaatcctcctgccatggcctttcaaagtgctaggatgatataggattataggtgtgagccaccatgcctagtctggctgaattttttgattatagagatgaggtcttgctatgttgcccaggttggtcttgaactcctggcctcaagcattcctcccactttggcctctcaaattgccaggattacaggcatgagccactgtgcctggccccaaaattacttcttgatctatgggctgcagagtgggtgttgtgttagcatgcatgaaaacaacattaatcttacacatctccattagagctcttgggtaactaggtgacttgccaacgaacgcaatattttaaaagaaatttttctttctaagccgtaggtctcaacggtaggcttaaaatattcagttaaccatgctgtaaacagatgtgctgtcatctaggctttattgttccatctatttatagagcacaggcagagtagatttagctttaaagctaaatatacagcttttaagttaattcttaagggtcctaggatttttggagtggtaaatgagcattggcttcaacttcaagtcaccagctgcattagcctcttaaaagagagtcagcctgtccttccaaacctttacaccagtcattgatttctgttccctagctatgaaagtcatagaaggcatcttcttccaatctaaggctatttcatttacgttgcatgtctgttgttttgtaaagccacctcatcaatgatcttatggataacttgctgcagcttctagatcagtacttgctgcttcaccttgcgctattatgatatggaaatggcttcttttttaaagcctcatgagccaacctctgctaggttcaaacttttcttctgtagcttccacatttctctctgtcatcataaaattgaaaaagccttggccaggcgcggtggctcacgcctgtaatcccaacactttgggcggccgaggtgggcggatcatgaggtcaggagatcgagaccatcctggctaacacgatgaaaacccgtctctactaaaaaaaaaaaaaaaaaaaaaaaaatttagccaggcgtggtggctggcgcctgtagtcccagctactcgggaggctgaggcaggagaatggcatgaacccgggaggcggaacttgcagtgagcagagatcacgccactgcactccagcctgggcaacagagcgagactccgtccccccacaaaaaaaaaaaaaaagaaaaagccttactctgctttggcttaaggggaatgttgtggatggtttgctcttctaggcagaccactaaaacttttccaaatcagcaataaagctgtttctccctcttatcattcatgtgttcactggagtaacacttttaacttccttcaagaacttttcctttgcattcatgacttggctgtttggcatgagaggcatagctttcaacctgtcatgcctttcaacattccttcttcactaagcttaatcatctctagccttggatttaaagagagatgcggccgggcatggtggcttacgcctgtaatcccagcactttgggaggccgaggcgggtggatcacctgaggtcgggtgtttgagaccagcctggccaacatagtgaaaccctgtctctactaaaaatacaaaaaattagccaggcatggtggtgagcacctgtaatcccaactactcaggaggctgaggcaggagaatcgcttgaacctgggaggcggaggttgcagtgagccgagatcgcaccattgccctccagccagggtgacagtgtgagactccgtctctaaataaataaataaagtgagagacgtgtgactcttcctttcacttgcacacttgtaggccattgtagggttattaattggcctaatttcaatatttttgtgtctcagggaacaaggaggcccaaagagagagggaggggaaatggctggttggtagcatagtcagaacacacacatttttcaagttcaccatcttaatatgggtgagttttgtgacatcccaaaacaattacagtagtaacatatcaaagagcattgatcacaaatcaccctaacatacaataacaataaaagttttgaaatattatgagaattaccaaaatgtgatagagacaggaattgagcacgttgttggaaaaatggtgccgatagacttgcttagggttgccatagaccttcaatttgttaaaaacaaaaacaaaaactcaagatctgcaaagtgcaataaagtgaagctaggcccatatttacaactagctgagcagacctgccacttagtttggtgttttaggtttgagatgatttccgacaactttacatgtgcttagcatcctatcaaagcagtggggagagaggatatgactgctttatcttatccagaatgcagcaatcagaaaacctataaacaagccattttaatgtcagcatagcatacatataagttctgcattttaaggtttagtagttcattatttgaattactcattgcaatgggcaccaaaatcttttcagtgctcattgctttgaaagatttcatttatacctatttctccatatggcatcaaaactgctggtaaaaaaaatgcaagtgaagttcagcagcatctacttcagattcagagggctatgttcaggttctagttatgcttctctggctatataactctgggcaaattatcacatctctgtcagccttggtgtgcagctgtgaaatgggaccatagtattagtgttacagattgtgacacttaggacgcaatactgtatgtaattagcatagtgttcagcgaatgagtgtgctctcaacagtgtggctgttatatcatcattatcattgttatttctacatgctaaggtattattttataaacatgttttatattattggcaacaagcctttcctttaacacttaccagcagctttctttttctatgcaggactttgatttaaagatgaaaaatgtatttggtggtctttaaatatatatatggtgtgtgtgtgtatgtgtgtgtgtgtgttttctccccctactgccctctccaactttttcttccagtttttttctaagagattagcagccttaaagttagaggtggcaatggtttggcctggtctaccttcacaatatgatccttactttgctgcatcggaggtccctgggtaggtcctgtaatccctaaattagtctaggaggcagatggatgaaaatagtgtctttgctggatgaagcccagttgtggcttttcctttgttcccagctccaatccaaactaatgccttaataactgaaattcccttctttacctctcttaccttaacaactattagagtcaatgggaaggacttgtcaccatagcagaaagatgtcatcttagggcttctcctggcctgtaggacctcggcccaggcctcatagcagtgagtacttgaagaagggctgaggccagcgctcctgggcgttcttcctgtgagcagcttcctcccctgagtgtaccatcccagcagaagctcactgctacttcatcataaggctgcctctttctgcaattaagtcatttcagtattttctaacatggttttccttcttcgtagagatgctcaatgttaggacaaaacacaggcattcaaactgctcatagcatttagggagttagggaatttggcttttaattaccatcaaaatgtgattatttagagactcagccccatttctacagagcctgtagaattttgcggcaataggaaaggggcttataaataagtgctaaaaatgtgagttgccaggtttccagggaagagcagataagatgaactagaacaacttgaagtatctttcattaactctaatcaagttgttaaggctcttttctgatgcagctttactatctgtaacgtgggtcaatgtccgttgccttagttattgcttagcaggtatgtggaatctggaatgctctgatatgatcaacatgtttaactgaatgaaagtgtttatccatccagacacgtgattctcctgcctcagccttccgagtagctggaattacaggtgcacaccaccatacctggctaatttttatatttttagtagagagggggtttcaccatgttggccaggccagtcttgaactcctgacctcaaatgatctgccctcctcagcctccccaagtgctgggatcacaggcgtgagacaccatgcccggcctcagacatccagtctttaatcatttttccaggcagcatggagtcctaacctttgttttgcaaaccatccgatggatttagtctacatcacagcaaaatatttttgactttttgagatgactaattatggtacacatacttcgttttcccaaaagtactttaaatttcttgatgacttttgcatctactgtcagcactgctcaaagcactgcattctgaaccccagtcctgctggacacttagcgcttaggtttcagcttcgtccccaccccctgactaggtcaagttcctctaccatgtgtgctctcacagaaccatgagtctctccttggaactactatagctgttgattttattatatgattaattatttactatcagtctccctacgcaagacagtgaattccataattctgaatggtaaaggaacaggattttttattttgcccaccattgtatcctgacaatagaatgcctggtgcttagtgggtacgtaataagtgctattggtaaatggatggatggatgaatgaatggaatctcattgtctcctgcagtatttgttttatgtctcttcccaattttgtccatatgggcttaaagacctgcacacatagtagagactccacaagcttattagggaactaaaattcatgttgtgggtcttggcaccaaagcctcatgatggattgggaaactaagagtcatataaagtcttaggaagaggccttgaagtttctatgttccattggtggtcctggctgagataaatatagcaaatgaacaggcatttatttctcacctgttctatcaagtccccaaaacctggaagtagtgtgtgagatggggctgaccctgggaaagatgttatctcttattcagagccacataaaagctctctccccatgtcaggcacatctttggttagaagacataaattagtcccttgcatttcatagtggttctcatggtgtccctcatgacagagctcacttagctagccaatgggacatctccaaaaagcattatggaaaggaggcaacgtgcaattgtgtacaataacttgggtcctgaagtcacaatgcctcagttcaaattatacccacctgcttattaagtgaatttagacaaattaggtgtaatcctcaatttcctcttctacaaaatgggagatataatgctacttacttcataggatttttggaagagcaaatggccaaatggacataaagtgctttgcagagagttgggcatgtaataagttctcaataaatgttagctagagttattaccaccatttttattcattgaaggagtttcattgcaatcccaagccagtccctatggatgcccttccattccaacccttttcagactatactggggcccatgttgtcccctgccctttcagcccacatgactttggcccaggcttttactaccagggcccaaacacagtgtccaagaatggcaccaattatactgcatattgctgtatattattttatccagcactgtgaaggccaacctgaactgcctgaaaaatctttgtcatttagtggtttagggtatgtgcaccctccatacaaatgcattaaataaattaaataatggtgtgtgtgtgtgtgtgtgtgtgtgtgtgtgtgtccagctaaattgcactgctttcttagatcatttaagcacacttaatctaatggaacatggtaggatttcagcagcttctgaatagaagttggagagaaaaaaaaaaatccgaaacgtggcaccaactaaaacccccatgtagttatttaaggcagcttaagcacttctgtggaaactgggctccgttgaagaaatagccactcctcttacagaatgaaacctcactttttttttttttgtctttttaaaaattcttccttgtatttttagattttgggtgagaatgggactctaaatctattttcaagctttcttttcctttctctgctcactcagaattattctttttatcttggttctgcccctggtgatatcttgggtaagttacttgacctctcctggctgctttttttcatctggatatttggactggatgatctttgtggtgccttccagctgttaacatttgtttgattttatgattccctcccttgttattacagaaagcacaagtgttgtgccttaagcataagataggaaagtatcccttgatcaagttgaaacatctccactttctaagttccaggactcttagtttgagcttagagagttacagttgtttccaggcagttttttgtgctaagggtggtttgggttttatttctgtttttctgtagaccttattggatatatgaccatttggtcttggtagataatattgtgtcctgacacacaccaatggtctacccttggggtgttttggaagcctgcaggcagggtcctgaggctgcctgagtcactgttaatgaaccaaactgcctgaaatgctccaatggttgacttttggcacttggcagaaaaatccttttcatgttagtttcaaggttgtcagatatcattatccccaagtattaaaaatttcaaagaaaggaggcagtgtgtttgatttatagaatagttatctagctttagctctgacttggctttggaaatggttttgcaagcactagaaaattaaatccattttttatggcactacaaggtattatctcacagcaaatgataattaaacacctgtgaaatcaattagccctttaagcagggaaaaaaagttttccaattatgttttcacacctccaaaacttttataattccaaaaccaacacttgtggagagggatatggtcgactggccgttgctgggttaactttccataaagattatccctaaattttgcttagccttaatcctgaggaaggcagtttgtgataccagcatccttccaaagagactgcaatcgcctttagagctgactcttagcagctatctatctgacacacagcggagctgtcaacgactcaacaaaggaagttactcactttgtgttttgatgccaagttttacttgacagtttatttaaaagccaagataccttaatggaaaccaagcaacaagaattccatgtgacagaaatgctgtcccattaagggccccgtagccaagagttctgagccatctacattacaaattcatactctaaaaacagactgattggttaatagctgaaacccaatacaatggaaaactgggactcatggccagccattcagccccacagtatcatgtgtgtttaatcaccggctttggtaacaaattagctattccagatgcttcttttggaaaatgatctatacttctgaagcagtagatggattttgggtatatgccataataatttgggacgcaaagaaaaggcaaaagaaacataacaatgccaggcctttgacatcttctgcattttacctcatatgtacaaaaactgttccaagaaaatttttggcctcatcctttctaatattcataaatgctttagttattaatttgtgcagggtttcattgtatcactttacataaacatctctaaagatgttctttaagaaatttcttctgcagacatttttattgggctcttgctttcatagcagatggcatttggagaacttgacgaatcataccattaactagagagagaaagctagcgtcgtataaaacaaagatgaaagaaaacttctctatatccttttagaaacttgtcatatgaattatccctgcaaacattgccagcagttcagacactttatgacctaggctttataaacccatgaggaatggggtgagtgttgaataatctgacataggttcaacaaatatttcctaaaagattactgtgggccaggcatagtacagggtctggggtcacagtggtgaataagaacaggaacactcccttctctcatgcagtatacattacatttggggagaaagaaggtaagccagtaaaacaaatacatgtgtgaattctgaccttggtaaatgccaggatggagatgaaacagggcaacagaaagagagtgccaggagcacaggttggtctgtgctggcctctctgagaaggggctatttgaatgcttataggcagcttgagagacatcctggagaagaattccaggcagagggcacagcaagtgcaagtgcaagagatagaagttagcattctctgtcaagaaattgagagccggactttgtagctgtagatggtgactgaggatggggcagtcagagatgtgggcagaggccagttctcatgggacccagtcggccaaggtgtagggcatgattattattctaagtgccaggaggagccactggagggtgttcagactgggggggtgacatttgaaagttgtctttggctgctctatagactatggactgcaggaagatacgattgaactcattctgtttaaaactagtaagaaccagagtatggtttctgttgctctgttcatgcacgcttgagctgaaggaggaatgggattaaggaggtataggaagaagggtgtgaggagactctggctgtcactgaattgcaaaatccatgaatgggcagctcctggagtactcttgcttcatggcgtcccagtgctcagagtgctacctgacatgtagggcctgctcaatactcctttgtccagtgagtaaatatcagggcatgaaggcatcctttgggccatctggtccacctctcctcaatccagtgcttaaattttctttctgtcccacagcctctttccagaatgagagtgccagggagctagctggctctgtctgcttctcaaaggaactgtgggaagcatggccagctggaggaggaggagggagaggtgattcagctccacagaccatcttccccagggtactgttgtacttctgcctaaggaaatggcagaatctagacttgtgggcctctctaatccctaaggactcaaccttcatgcaaagatattcctgtaaatcaataatatgtggcatcaaatcttcaaccataacccaaatgttatgtcccatggatacacccatgtatctctacatttatgcattcacatacccagacgggaaagattaaactttccatagacaactagcttcatgcagcgttcatagtaagttgggtgttctagaattttttgtgaatgtgctatatcagcctacacagagttctgaggtcttgtttgtgtattcggtaccaaaggctcaggagtgaggtggcagccctgactgtcaaagtcacaaggcagaggctagtgatgcaacagtgggagagaaaatgggaaggtgaggttggtggcatcagctgacattccacaaactgtcattggattctcaagatattttataaccacttaagtgcaggggccagacaaaaggattaaacactgacaagaatgcaggtcacgggacagactctgcacagtgcctgccctgggggtgagaacagtaggaatgccaaacatcctcctaatccgaggcctgatccaggctggccttgctggaaaggatatcttggatcaagaagggaagtggtcagacattggttcgagctcagttttctgtgcagagggagggagtcattgctttttggactggtgcagggtttgtcattgcagaagccatgaggaggttctacagctttttattcttcagttcagacatggaggaaggccaggagaaggttcagtttgaaccgcactgtgcatgcatttaacttgatttacaaataatgctatttgtcagggctggtgaaacacaaattttctaccctcatcagcgtgcagggagaaaatgacatttttaacaagctgccagacctgtagaaataaaaacagagaagggattttaaaatgtacaaaaggaagactaaataaataacacgatttttcattccccaagtaaattgggcttggtgtaagcataggaatgaactcattcttggaagaacccagcataaatcaagagttgggcatgtgtttgttaaagtggacattgttgtaatgaagggcttgcatcttatctttgttatcttcttgcttccatagcccctgtacactttaatgcaaattggtggacactgagcaccttacattcatttaacaactctttttttgagtagttacagtaggccggcccttaaggtagttgttgggtcaacagaaagtaggaccaaggtcctgtgtcccggaatccaggggaaggaaatgagaaaaatgggcaacttaatacagagtgagcaatagagagttagcacagggttcccaaactccagggatcagggaagccttcctctaggcagcaggagtggaagttaagaaaaagaaggaaagaggggcatgtagggaagaagtgctccctccacagccagcctcctgggactcagattgtcctaggtggggagctgacacccttagaacagacacactgcgctgcccacccctatcctggtcttctcgggctgctgtccatacttcctggctccattccacttaaccagtcccattggcttagagcctggcgaaaggtagttaatggtaagataatgacctcaggcttccccatcaccattgggcctgtgtgtgactcttctggacccatttatccatctgagttcactgttgctgctggctcttttattgttaatcccctcttttccccctgcaccccctccctgccactgtactcaggtagccctttatttagcattttcaaaaacgttttgttttgaaccagagaatttaggcccatgtgtcttggaattgcatttctctgagaagagttttggaagtgggtattgctgtgtataaaagctggtgctggccaggcacgatggctcacgcctataatcccaacactttgggaggccgaggcaggtgtatcacttgaggccaggagttcaagaccagcctgaccaacatgatgaaaccccatctctactaaaaatacaaaaattaactgagcatggtggcacacacctgtagtcccacctacttgggagtctgaggcacaagaatcacttgaacccaggaggcagaggttttagtgagctgagatcatgccactgcactccagcctgagcaacagagcaagaagactctgctcaaaggggggaaaaaagaaaaagctggtgctgcaaaacctctcctctttcagaaagcttcctgagattaatgtcatgggcacgatgtattaaatgtctcttattttcacctttgctggcacctcgttactctttcctcctaggtaggttgagagatgacagagctggtcgtggatcccatcctccttgcacaaaccgaacaaaacctgtgacactttacttcatcatctgtaaactggggtcagtagcacctattctccatgatggtggtaaagataaggcacagtaaagattacagattgtgcagctcagtgccccacccacaggaaatgcttaaaaagtggaggtattgttgttattataatttatatctggccaggcatggtggctcatgcctgtcatctcaatactttggggactgggaaggatgtgggaggatcacttgaggccaggagttcaagaccagcctgggcaacatagcaagactcgtctctataaaaaattaaaatttaaaaaaagtttttaaaaagttgttattaatagctatcttttatttattttttttttttacttacttttatatattagccattgagctgttatttaatgagcaggaattcagatggtcatcttttacccctcttgaagtatgagctacacctggtacatgttgtgttcattaatatacacaggtagcaattaccacttgggctaagtttaaggttctgaactgtcagtagacatttaacctaaggatggggggtggagtttagagttgataagagattatgacctggcgtgttcagtcaagatgtttgagtccaaggactcttctgactccctcatccctgtgaaagacaggtgtatctttccccacgtccccagtggttgtgaggctgtcatgagatcatggatatgagagtgaatgcctcccataggggtttcatgcctcagccccagcccacaaaatgttatctgcctcccttccctatgctgaaatggattttaagaggacatgaaaaggagactctcttctgtggaaagccaagaagtgtgaaagggtgaatataaattcctggccctggttttagccacgcactgctctctgcggtggacagcttgggatcagcagcctcagactgaggagcgtcacaaggaaataaattcttaatccttggcatgactggggaggtggggagtggtgtggcagttctaacagcaggcaatgctcaaggcaaaaaactgtcttgagtaaggaattgtaccacctccaaatagcgagtgccttcctgcttggggacgccaagcatccctgaagctgcagccaacctggtcagccagtcccagagcctagcactgcacatttgcatagctcatttgtactatagcagctcatttgtgtgcacagagactctgtgtgagtaggtgtcatggagaaactgtggctccttaagtccagagaattctcaaagacaccagggacctatacttttccatattctatgttttcaagtctcctaattgagatggaacagtggccagttggacccattttccagctaaaagattggttcccacttatatatgtttctcagttcaaatctttgccttgggcaattccgtacgactgcatgctgtaaacttcagttttctcaaaaataactgaaattttaggccaggtatggtggctcactcctgtaatcccaccactttgagaggctgaggtaggaggatcacttgagcccaggagttcaagaccagcctgggcaacaaagtgagaccccatctctacaaaaagtttaaaaattagcttgacatggtggtacatgcctgtagtcccacctactcaggaggctgagacaggaggattgcctgagcccaggaggtcggggctgcagtgaactgtgatctcaccactgcactgcagcctgggtgacagagcaagatcttgtctcaaaataataataataataataataataataatagtaattgaaattttaaactgttaaacctttaaaggccaaggaagggtctaaggcaacatggttagtaaatagatgacagagtaccttcttaaactgagctcctggtagtgatctggggtgaagttttgaatgggagagaaacagcccttttaaattggcaacgaatagcccatgcttgaaactaggtgaactgcttaggacctggcttcataagacatgtcagttttagacactgcatgttgtatgggctgaccaaggaggcaatgtgatgtaatggaaagaaaatgggatttagaatgagaaatccaggagttggaacacaggctggttggtcctagctgtgacctgcattggaagggtttttgaggtctccaaacttaattgcttctctatgaaattgggttatatgaagtcctgagaacaccattggtaccatgtcattcttctgctcaagcccttcagtgacaccccagtcacctgcaagggatcatctctgagctctaggagatgtcatagaaagccttcctagtggcaacccaccagtaacagcagcccacacccccataccttcccctccccaaactgggtggtttctctcaccttggtgcctttgttcctgctatgctatctctacccccaggaattcccatcacctcctcttacccctgtgcctggttgcttcttgtacatcctttaagatttagctcagggtctcacttcctccaggaggcctccctgcctacatgtggccattgcttctcttctctgtataacacccacctctacctcatgtccaatcctagcactcctctcgctgactaatcatcatttgataacacatgttgtttattctggacagtgagctccctgaagagtgcctgacacatggtagacattcaactaatgcttggtgaatgaatgaaaaaggcgcaaggaggtgctcaaaggatgttaatttcatttctctcatccccatgcactttagagaactacaacagtcataaattatttttattttctttctttctttttttcttaagggatattattcaaacttgtgtataaggaaagattaattacttatgaggatggggactggagggagtagatcagctgtagatgttaagttactttatgaataaatacttgagacaaactgtgacaacatcatggggaggctagaattgtgtgagtacagagatgagaggctggatcacttgtttcttccctatcgtctttggttagcaaaaagcaggttcacttggcaaatatgcgtgctacagagggattgtgggagccacaggaggacctgtgagcacagtgcaccagcaacatccttgtctatgtagcttttgataataaggcaaaagccttcaattagaagctgctgttctgttgtgattcacagcttctgtttccattttactttaaagggtctgttccacatttgtctcttggctctgtctttgggatactggtgtagttttcattctttttaattgttactaggggttttaaaaatgtttatatccctcttattctgatataatttaccataataacttgcaattgcatagtgctttgccatttatattcaatgtacatgatttcatttgatcttcaaaactttgaggtttggagaagttgaatgatttgctggggttacacaggaagtggtagatcaagaacccaaattccttagcccagattttctaacttgaagctggctgtgttttccattatgttctgttatcttccttcagtcataatgataatagctaccttttatggtttgcttataatatgctcgtgctttggttaaaatgtatcacttaatcctcacagtataagtattatccccattttgccaaccaagaaactaggattaaacaaattaaataactttctcaagattactcagtttataaattgaaaagctggaattcgaacccaggttttgctgtgtctgaagctgcctaaccactaagcttttaattactaagctcttaactatggtgccagtggttctgaaaatttagggtgcatcataattatccagagggcttgttaaaacacagaattctgggctcttcccccagagtttctgattcagcaggtttgggtgaggctgagaatttgcatttctaccaagttcccagatgatgcagatgttgccactgattggaagaacacactttgagaacccctgctctatgctacactcccccatctttcccagttgcacagaatggctgccagcaaaaatgtgtttcctacagaggggcaggacttcaattgtgcattattgcatagtccattttaaatggggtgcatcccatacattgttcaatacaactttaagtataaaatgattatggccatagagtggtactagtgtctaggttaaattcaaggtcatgtcatttttattgcatttttctttgtagtcgtttgtgaaaattcttctaccttttgtccttctttacctacacgtggggaacttaatgcccatctgaaaagggtagcaaaaccatttattagagtggcaaattatctggggttagttgtctccctcacctacttaccttcttgcttaggatatcatatgtttcttttaagtagtgtgtgattatgtgattcacatttctaaacataagaaacgagggagaattagtccatcttaaaacactgtgtccccccatttgacctctcaagtctccctgtctttcctcctccccccaaccaatggcaacctctaagtgttctttatccctgtaactatgtgatttcatgaatgtcatatagaaaggattcaacagtatgtacactttcgagggtgactttttaatgcagcataatttccttgaagttgtcgtgtgtatcaatagtttgtcccactttattgctgagaaggattgtaggctatggatgtaccacaatttgttgaatcattcacacattgaaggacatttgggtagtttccagtttaaggttattacagacaaactgctgtgaacatttgtggacaagtttctgcgtgaaaataagtttccatttctctgggatacatgcccaagagtgcaattactgggtcatatggtaagtccatttttagtttgaaaaggaactgccaaactatttttcgaagtggctgcaccgttttaccttcctgctagaaatgtatgaagggttctaatctctttacatcctcatcagcacttgctctcatctgtcattttgcttatagccatcccagtgggtgtaaagtggtatctcattcattgtagttatgatttgcttttccctagtgactattgatgttgaatatattttcatgtgtttagcagcactttgtgtgtcttctttggaaaaatgtttattcaaatccttagcctcttttaaagtttgattatttatctttttattgttgagtcagaagagttctttatgtattctagatgaaagtcccttatcatatatgattggcaaatacgttctctctttcttttttttttttttctttttgagatagagtttcgctcttgttgcccaggctggagtacaatggcactatcttggctcactgcaacctccacctcccagtttcaagtgattcttcttcctcagcctcccaagtagctgagattacaggcatgtgctaccatgcccagctaattttgtatttttagtagagttgaggttacaccatgttggccagactggtttcaatctcctgacatcaggtgatctgcctgcctgggcctcccaaagtgctgggattacaggtgtgaaccaccatgcccggtggttctctctttctgtaggctctttttcactttcttgatgggacctggggggatggagagcccagccttcctgactgcactgccccagagtaaagctcctgtaaggcagagctagtaggggttggtcatggaacaggtcagggaccagatgccacagactctcatggttcttgccaagatttggtagattttcttgggtgactgtttctctatttgtcattatccccttaggacaattctcagagacttaaaatgtttttatgattgttactaaattgctgttttgctggggagagtggccacagacttctttgtgtatcttctgaaaggtcggccttctataatctcctcttataatgcaaatactcccaggagatgtttatatcttaaattctcatctcatcagcattttctcattgtcaggtgcttctttggtagctccagcaactagagaagaccttctctggactctatctgttgaaatgggacagtgtctgaaacatagtatttcttgaaagaatgaatgaataaatgagtggatttaagcatctacaaggaggttgatgtgcagtgtgaaagagcatcacaatgggctgagtaggagaggatcaagcacgtggtcaaactagaatagttgtctgcccacttgtggggcatcattcttccttcaggtagaacatgttagtaattcatagattgactgtccagagagtagaatagagaggctggttcacaggctgagcatgcatagaaatctgaatgaaaatcattgttctaaggtatgagtgtacatgttctgtatgagcctctatgtgaatacacacatatgttagacatgcactgcatacatatgaacagatacgtatgtatatacatatacacacatatatgggtatggaattgtgcacatatacacatacatataatggtatggacacctaagcagtgggatattctcaaaggacattcctctttcttacccaaaaatgataagataaagagtaatcaagtattaaaactgaatctatagtcatctagcccaagtagttcattttgcagatgaggaaacagatagaaaattcatgggttttttaagtctcacagctacctagtggtttcctaactcctgcaagggtattcttcccacagctcctattacctattatgtgaaggaatacaagcttcgatcatgtcaatcttacttgctatatcagcaaatagtccttctatgtaaccatttaagcaacccactataactgtcatttgaatttttcctataagttttctgcccttcctcttcctccacacattccctaaagtaaattctgcaactaggaactttgaaacttgttacaatgcagaacattaataggattttacatttttagtaggctaatgatgagaatgtgggaccttctgtgctagtccctcaggggtttctattctgggtacttattaaaccttgctgtagtctgaagtatattcgacctttctgtattaaaaaaaaatcagcttaaactttatgcatatatttttgtgagtgtgtgtgtgtgtgcatatttctctctgctccatctattaggcagagattaaaacattatcaacatttgaacttgaagatatttgtcaaccattttcctgtgtttggtgaggatgaagaaatcactaccatctaatttattttttttttatatttaactaaattcaagccttcttaaaaatcttttttactttgaagtctattttgcaatttaattaatgcagcaagggttttagaaaatttttactctcaatggagataatcttaatccattcacggtgaccttttcttgtgcaaattagttgtacacgcttgtttaagcaaatggtcctttgcatgatgtctcttcttaatggcgggtttataattgaaaattggcttactcccgtatgcctagtttgtatgagaatataaaaatagatgtggactttaaaaatataaatgtatataccaatatacccaaaaagaagagggaagaattcagtgcctttaggctatgattaaattagactattagagtcagaaagtggtggtgacatatgctactgtcaaagtcacacctgtctgctcagcattggaagctcttgaaaaatgagagtgatttcatcttggctctaagaatcggggcctttacaggacatgagccatctctactttcccaagttttcttaaactcataatgtacttgaaactgcctgtgtaggaatgtgtttgtggtaatcactttaaaagtgacagtcctaaacaaaatgaaatgctttttatctttcttaaacttcactggcataaagaaacaggtaacactcatattttgtatgttttttcgaaaagcaaaagcaatgtaatatcattaaatggtatttgagtaaaataaattcatctcttctgtagaccagtttcctgtaccccctcctagttcaggttttttttttttcttttcttttctcgttattctttctttccctttcttaggctagcatccttctctctcacctcctctttctcctgtgagttatgtcagccattcttaaacaggaatatttttcctgggtaactgaacgttcttggttaagtgtagaaactccatcttgaaagagaagacaaatgttgttttgtgcctgtgattgaggttttctgaatagtttttaatagcatggttttgaaggggtggggaacaagaacagtcttagttttgctgaatgccgtattgttaaaggagaaggagaagcaccagtaattttctcttcttctttttaagactatggggcaacatattttatcaagacttaaaaatctgattttggaagcaaagactgggcaaaccaaattgttgccagaacgatcagacttgtctttatatatactgcttgcaaaagggatcctaattgctttgtccaacatgatgattcatgtttactcttcatgcagcaacccaacctccttcctcaaaatggaaaagtgagagctgcctgctggtggctttcccgagttgctttgcgtaaattcatgcacatgggcgcccacctatggtcaatatccccacattcgcaatgagtcttcatttgctgtttactcctcttctctttctaggtatgattatcgggaaatgctgcacaatgccactttctgtctggttcctcgtggtcgcaggcttgggtccttcagattcctggaggctttgcaggtaagaggccctggagccttcccagaatagggctgaggaccgaagccagattaagtgggtttaacattatcacctctcctgggatagctaaagagaaggtgtggtttcccttgaggatctgaaaatattttcaagaaaatctaaaacatttttgacaagtgaggggtggagggaggatttactcagtaattttagatgtaagaaattaaatggtggattcttctgggtcatgtttagaaacagaaggcaaatctaattgccagcttggcctaccaggcagcctagctggactctaaaaagcagccctacactttccctttattcgtggtactctctaaaagcaaaattgtcttttctgcctgcatcttcattgtctctcagttcctttcaattttgagaatgatccccagcatggtggtactactcagatgatccagctcttccaaggctctgcagttcagaggtcctggctccagccctggagcctttgtggtgggagtttctcagctcatcaacctcactctgcagaaatgtcctcttgagacagtcatccacatttcccacctggaagttgcaaccagccttctttgattgcagagagaaagcatgccctcaacctctctcatcctccattccttgaccctttgctactatgttctttcctcctcttgccctgcaccatgcctaaatctgtgcttttgctgcagtgcctcataacttcttatctctgccatcttaactgcaaatcattctgtcatgccctccaacagaagagcttccttctctggaatgtcttttccaagttgctctctgtgtgtgttctgcatagcatgccatcactaatgttcttgtagcctcctgggatgctgcataaagaaaaattgttctctgatttggattatgagttatttggaatcagtattttgtcattaacctagtgtttcttggctgtttatttcccggcacagaccataaattggtatgactgtggtttagatcactccacactgaaaggaacaaagttctggtttgggtgtttgcagagcaagggaaatgtgaacactctatactggttaagtccacgaactgctgcctaggaatgctgagcttcattctgctctttgttgctcatgacattggggtaaaccactttgcacgtggacttgtgggagttacgttgaccagactgtttatattcaaggttggttctatactcagattttgttggtgcgagcttttgttacgtcaataaaaacttctccagcaaggccagtcgtctctatggaagtaaggtcagccaaaccatgtactagaatagaaatggggttttagcattctagggcaagacttgcaaatattaaaatctagtctggatacgtacaaccttcgtgtgacttgataactcataaaagcttcctttccttctggcctaggcagtccaggattcatgcagtgtcaaaaatgccagtcattgagtttgtactgatttcacctctgattggaacagcttctgctgtcgctttcctcacattcacgaagtccccttttttgctcaggctgcctgcgtccctgtgatgctcagcaatggatgggagttgccattctctgaagtgattaattggaaccaagctgccgtcataggcgatgagagattgttattacaggtaaggaaggggctgtggccttcaacacatcagcagattattgctgcccccgtccaaactttcaaagaagatgaatccaaaaggtcagctctataaaagaaatcttatcaggagaaaattacctgtgtcatggtgaatatgaagtcatttaatatgacattgttcactttccaacaaaatctccccaggtccccagaatatattctgaaaagaagttgcaggtaaagaatgggagctttgattttcaagaagaagtggatctccacccctttcaataaccagaatttttagaaatattaccagagagtttttattctaccctactgtttcatattcttttcctctgtttctgcacttgccttcagattaattttcagaaagagagaggtctctagggcttgttcttgtaattagtgttatcgttcctcaaatgatccagtctgggtgtctgagcgagtgttatctttaggatttatatttaaatgagcagcccctaataaaagtttgaattgctcaagagctgcctagggagggggatacgatactcagaaaaatctgagggcaggaatgatcatgtattatttttttttaaattactaaggatttctaaagccctttgtatattcatattttaggatcaacacaagttgccgtgctcttttctcctaaaattctagaactttaatgtttttcttttgttgtaccatacactttatctttgaattaccacaaatatttgtagaattttttttaatgtctttgcccttttagtttttggatattcattaaattgagtttctaagtctgtgtgtgtgtatgtgtgtgtgtttgtgttttttgagatggagtctcactctgtcgcccaggctggagtgcagtggtgtgatctctgctcactgcaacctctgcctcccaggttcaagcgattctcctgcctcagcctcccgaggagctgggaatacaggtgcacaccaccacgcctggctaatttttgtatttgtagtagagatgggatttcaccatgttggtcatgctgttctcgaacttctaacctcaggtgattcacccatctcagcctcccaaagtgctggaattacaggtgtgagccaccgcgcctggcctcttaagtctgttgttgattctccttctgtgctgctgcccagtctgctagctgactgctgaagtaatacagcactttccctaaaataacaaatgaactaactgtaactgagagacccatgggttaagcaaactaaagtgaccacagctcctgaaacattacttctgtctggcactcagtttgtgatctccatagtccctattatctcagaaacaaaggaggaatgtgacagaatctgtttttgggggaataagttattctgccctgaatacaacttaatttcttaggtgttcattgagaaaggggtctggagtttttgtgaaagggccacttttatgccaatgatttcccactgtgattccttaaggaaaagaagtccttgcagaaacactgaggaagagttttccccatgcagagatagtgtatgctaaaatcatttattcatgaaaagccaaacaagagtgatgcatgttgtgcttgtccatgtagccttttttcttcctttttcaaatgttattttaaaaataatacatgatcattaaaagaaatttgagaaataaagggaataaaaaacaccacccataattttccttttatataccaatgctcccatgaatttgatgtgaacaaattgaaagtttgtctttggtatggagcgcattttaggatacttaattgtggttgtgcagtttctttcttttttttttttgagatggagtctcgctctgtcactcaagctggagtgccatggcatgatctcagctcactgcaacctccacctcccgggtttaagcgattcttctgcctcagcctcccgagtagctgggattacaagtgcctgccaccacactcagctaatttttgtatttttagtagagatggtgtttcaccatgttggccaggctggtcttgaactcctgacctcgtgatccacctgcctcagcctcccaaagtgctgggattacaggcgtgagccagcgcgcccagccacttgtccagtttctaccatttcaccaaacttgatgggcatttcaccttctgaagcaactttttggcttgactctaaagattttgatttttgtcacccccacccacccagacttgctggtgtttttcccctctcatattcagtctgtctttgcacagctgcctccatattgagcagcaactgtgtactatcattaacaatggttttaaagagttggcacccagcccaaatgtctgctctgggaaatgtttttttgttatgttacaattttttatttcctgttttagaacagctgggatgtttttatttgcatatattcttgtcatcatgtcaccaagagagcttaatgtgactttcttgtatctattctggtgcattccatttgttttgctaccatacatgaccttttattaagacttcattgagctcggcaacttccaaaacaatccagccaaattggaattaatttatcactttcccatacctgtctctcaggacaagcagattaataaccaatagccaagtgccattaaaacttggaactctgtcttttcaatcaattggagttgtcttccagagcactttgcagagtgctgtcagacacttgtatcatatcacaagccggtagaatacattgcacttgatgtagtaagatgaagatgcatgttatttaagagaggggaacagcattggtaggtgagtctgtgatattccttttctcctttcataaccacagcagactcaattttctggagactatatagcaatgacagctttaggcatttttcttttcttttcttttcttttttttttttaagacagtcttgctctgtcacccaggctggagtgcagcggtgcaatctcagctcactgcaacttctgcctcccagttcaagcaattcttctgcctcagccttccgagtagctgggcctataggtgcacaccaccatgcccagctaatttttgtatttttagtagagatggggtttcaccatattggccaggccggtcttgaactcctgaactcgtgatccgcctgcctcggcctcccaaagtgctgggattacaggctgagccaccgcgcccggccttaggcatttttctaatagactgtttccttgtggctacgataaaacagtgatgccaacctatataactcttagcagttacctcttgacatttagaagagggtatgattatgaaaattgaacaggatagtttttttctaatctttctttggccatctaggtaactttctcagtgagtaactaaaaataagtttccttgcactgataaaggttctatgatataaatgatttgtctaccttctcaaagaatgttttatttccatttgaccttgggctctgattacaggctaatgtttgcctgccagtatttctcctttacatgttgcctctgttttttcagtgttgcaaatccaggtatacactttgggacacagatttagtatctggttttggacattgtcaaaccaagtgagcttttccttctgttcttactgtgaagctattttattgctcctcctaaggggagtgctgaattaaaaaatgtgctaccacttccttcccctccaatggaaactctgttacagtcttagtcaaatgccatgggtgactttcctattaaagcagctaacggagcatttctccttcttgctcagactcccatatctgtcggattagtcatatgttatggaggcaagcatgcagaaagaggtgagcacaaaagggcaattgcaaatcacaaggaatcttccctaaagactatagactccgtaaatgaaatagaccttgaactgtaggtgaaaatagggaacaagcccagaaaacttaccagactcaggaagtacatttcagagctccagacccaagtaggttcccttgcaaacattaagcaattgatccagcttttaatagcatcaccctgataccaataatgataatagtagtgatgttacattaattaagttttccatgttttaggcactgtgctaagcacttatataatcatcattaaaaccttagtactttatccccactttataagtaaagaagtggagtctttgagaaatcagctaactcattcaagaaagcacaggtagtaaatgctgctagaggcaacactccttccttgatctttctgacttctgtgcccctgtgcctgaccattcagttatactaccattaaaaataatgacgtccctgtggtggcttcagatggttatattcacctcctatttcttaataactactatataaaatccactctgctaacctgaaaatgtgtagcaggataacaagatataggtccttcctttaaaattgtataccctggaagagagcagtgatggctaatcatatatgaacaattgagagatccagttagacttgggtaaaggctgaaggcagaaagagagatatagggagcagaaaggctcaaaggtgaggtagaaggtatgtgcacataaaagtgactgaccctagcttcagattggatgggaaggctcatagacattctctaaaaagtccttttatagatattttatagttcctggggtgaccaatcatagaagtgcttgggagataaagtcttctggcctttccccaagacctatagttacccctctataaaatttggttgttcatgtgcaaggtcaaggatttctggaaacagcaattgtgactatagactaacctaagcaactgataaggtgctactgaatcttagaggtgaactgtaactttcatacatcaaaggccattggggtggattcccagtaagtgctctttgcagctgacacttcttaaggtcatttcaacttaggaattgatgatttttagtagatctatatgctagaagccaaatgctatgaagaataaaagcctaacccagttgggttattttgatcaagtgcatctctttgttttacagttataattcctatgtgttcaccttgtgttacagattccttctacaatcaggtctattcatcaggataaaatcctagcacttagacagcagacacaattcttgtgggaggcttatttttcttcagttgagaagattgtattaactacactagaggtaagtgagaccacttggctcttgggcttgaataatggtcctttatacacttctctcagccttctgttttgctattagggatgtgtgattggtccagtggggcaaaaccagattcctgtacttggatatattggttaacctcttttacctgctttgccatggccaagaaaatactctcattcctgacaaactccacaaaggaaaacctacatggggagaaattatacttattgacacagagattgactctgtcttacatcatttcagggatatgtgggtcatgactgtcttgtcatttacactcaatggcatccttcgaagacatatttctggagttcatttagaaaaaaatatttaatggcttggcacagcggctcactcctgtaatctcagcactttgagaagctgaggcaggtgcatcacctgagttcaggagttcaagacctggccaacatggtgaaacctcgtctctactaaaaatacaaaaaattagccaggcatggtggcacacgcttgtaatcccagctactcgggaggctgaggcaggagaatatcttgaacctgggaggtggaggttgcagtcagctgagattgcaccattatactccagcctgggcaacaagagcaaaactccacctcaaaaaaaaaaaaaaaaaaaaagaaaaatatatataatggccaagtaagggcaaatcctctaccattccaaaaatatgagtagttttctgggcaccacagtccaatggcattgcgggacagcagaattctcaagacttaggcaagccagccaaccagcgtcaatgtggcaaagttgtgttaagaggagaatcaggatcatacccatgtggcacagaaagtgttaaatttgtgaaagcagaaaatcttttaggcagatgggcgcccgtcctcaagttgctttttttttaaggcaggacggaaaaagaaaaaggaagcatggagatgattaaaacctttggaaatagagcagatagcattggcctgaggctacaccgaagtagcacaaagagctaggaaaagattcaggaaactgcacacgcatgcattacaagcttgaagaaaggagagcagagatcttcgttgaggtgattctgaggtgtcccaaaatgaggtgggggcattgtggccttccttttggagaattcactctggaagagtgatgactgctctaaaagctaatgtaatatggaacctacactgagaaatctgagtaataccaagaaactgaagtcaccctacttggtccacatcgctgttttcttgccatcctgactatcagagccagtgctggtcatgctccaggcacaccagggcatttatccaccccatgctgagcttgggctcctgctcccaccctagggcgagctctggtcagtgttctcttaggcatagtgtgtatttttttcatcctggaactgggtaaaaggggctgtttaagacccaggcccattcccatgaaggggacaggatcataatgacttccaagggcttccttcctgcaagcaaacttttatccctccaaaagcaatctcctcaattaaaatcaattgagttgttacctctgttcacagtagctaatagagttaccctttgcttttttaatcctgtcctccatctaagatccttcctaggcccttcttaaagaatgttgaatgttattgtttctccctttttggagtgcagagtgcctttcttttttttttttagacaggatctcactctgtcaccaggctggaatgaccttaagcaatcctcccacctcagtcttctgagtagctgggaccatgggcgcgagctactgtgcctggctaatttttcattttttgtggagacaaggtctcgttatgttgcccagagtggtcttgaactcctggctcaggcagtcctcctgcctcgactacccaaattggtgggattaaaggagttattattaaagaagtatacattcattttagaaactaatagaaaacacttaaagcataaaatataaaataattcattcatgtaaaaccactattgatatatatatccccacaaacatatatattcatttttatatgtaaatttaaaatttgttgtacttttaattttaaaaaggagtctttatatacttgcattgtaacctgtttttctgcttaataatgttaatattttctcatgttattacattttttctccatttaatgactatatgatattccatttatgatatcatctaattattaaattaatccccaatttgggtagattccagttgtttctggcttttttcctttatgtacatcattgcagtaaatcatctcaaggtcaaattattgtgcagattcaatattacttccttaggataaattccttgaatttgaagtccgtttcaaataatatgccaaatgttaagatttttttttttttttttttttttttttttttgagacagagtctcaccctgtcccccaggctggagtacagtggcaccatctcagctcatgcaacctccacctcccaggttcaagcatttctgaggcctcagcctcccaagtagctaggattacaagcatgcgccatggagatggggtttcaccatgttggccaggctgctctccaacccctgacctcaagtgatctgcctgcctcggcctcccaaagtgctgggattacaggcatgagccaccatgcccagccccaatacatttctttcttcagtgttttctcatgacgtttttatgtatctttgggttgtttctggcctttcaattctatcctattagttgtttacctctaatacatccagagcacattccagtgttttaattttttttactctattatgcatcctattgtgaacttctatttacttaaaccaatatgccattatttactattaatgttctttttattttttatagataactatatctttatctaagcaatgactttctacatgtatcttaaactacatctctatttctttaggatggaatccctgaagtgattttaatgagccaaagagcctaggcatttctaaggcttataatatattttgccaaattattatccaaaaacattatatccacctagaatctcacaagctgtctgggcgtgactctcttttgctgtgctcttgtcagtcttacagatccataattaaaacacacacatctatcactttgctgatttgccagatgaaagatggtatctcattaattacatgtcttttgcatatggtttattgcatgaatatggtctctcacctattaagttagcagttctcaatttttctattgtaacagttgaatgtcttacattcatcagaataggatcaaaataagatcaagctgttttcatctctgaacctgaaaaggccttttccctttgtatttaaaccatgtattattattatttttttttagcaacacagttttggggtttttttaaacactaaaaaccatacacttcattcgaatttatagcaactgtcaaatctctttatatagttccaagattggattgtaacagtttgacctctcaaccaagttgcatgacaggtactacccagtttcccaaaatacttcataactcagattaccccagaattcaacataatcaaaaaatcaggggaaatagaagaaaatgccatccacagatacaaataacacagcaaatgtgtttataagaacaatttaagtatcacgtatcaaagatgtgaacttggcttagaacttagataatatacttcatttagtcactgctggagctactaaggcacgagaataattcatagttactcacagttacagcatagagttgaagatcctgggctaaggatgttctgtactcagactctaggtctttctccttgcttggtatattctaagccatgggaatgggattatggggtcttcagcaattatgagccctagagttgtaggtagagtgcttagactcagttgaaaacaggacatctcattttctcttcaatgccagggtcaggttgttagtacgtttcattgtacagaactctgtctaggattcttttagtttttccagtttgattgaaattctctaatgctgcatcttggtaataaggagctatttaatcaaactaggctctgtagagctcagtacttttgtgaaaattgagaactaacaatgaggacaatgaaaaaacactgcaaaaacagtgctccttcatggattccattatttgtcagaatattgcacaataacctgcactaaggattgaatcattggagcttagtcataatcaagatgagtgaaagaaagtgcctgagattatgataatatgtgaaaagagccagtggtagctaggaaggtatatagttagtggagttttaatgaagtatgcttcattttcctcctcagttatctaatcatgcacatacgaaccatagtattgctgatgctatcatacaatgatatttaaaaatcaatggggtaatggaaatagacaattgatctggcttcaagtgaggtggcatatggtggcatcgtgtatcttaggctacagtgctctggttaaaagatgaagggctacatagaatgactttaacctataaccaattgtccattatttggaaaacagaggatacataaaagtaaaataaggagcctgtcattcttccctttgaattcacatcaattagaaatattgtccttatcgagggggccatctaggaccataacaaaaaaagtcttgtattatctgtttgtgtatgtgtgtgtgtgtattgattttgtttatagccaaagaagcatccaacctctaatgtgatgtcttcttccaccacaataaagactaagcactaagtgccatgaaaagattctgggagctatccagggtagtgataggaagaattgcagagggaaaaaaatgatctttctatatggtgaaatgaattccatatttctttatgcttttagaaggcaagttgatataaaccttttagaaagacacttggcaatactaatgaatagccttaaaagtatttataccctttgacaaggtcctacagaatcaattctggtctggagcggtggctcacacctgtagtcccaacactttgggaggccggggagaaaggattgcttgagctcaggagtttgagtccagcctgagcaacataatgagaccttatctctacaaaaaataaaaataaaaaattagctgggtgtggtgaccctctcctgtggtcccagctactcaggaggctgaggcgggagtatcctttgagcccaggagtttgaggctgcacagagccatgaccacaccactgcactccagcctgcgtaactgaatgagaccctgtctcaaaaacaaaaacaaaaacaaaaacaaaaaaagaaaaagaagaagaagaataatcaatcctaaatgtggaaaattttattcgtaaatatgttcattgctttgcatggaaaaaattgctaaactggtcattaagaataatgaatcatgaatactattaatatgtaaaaatagctgtattatgtaatatctatactattaccactatgtaataaatggaaaaaccaatgcctagaaaacgaacacaggagtgagtttctttttaaaggcaaaaatcaagccttaagtataacaacttaggcagctattcttaaattctgagacgttgttataattaatgtggtattttattgttttattacaaatgaggaaaataatacacaaaggtggcaaattgcttgacccacgttaaattcaacatttgctactgctttcgtacctgtcctatgtctttctgtcaagatccgttggaagacagtataaaatgcttgttgttatttcagaagagtgctatatcttattatcatatctttgaattttaaaagataacaatgttgtgatgccgaaccaaaaagatagtctatgacaatgacaagcataccatccaaagacctgatgggaatgatgacccattttgtgacagctgtgagttccatgatatttgtctgtaggttcgatttataatgctgtctattgtcaatttattttctatcttgatatccaaacttatttaagtgaccacatcctaaaaggtacataaatttgaaaagaaaaaaacaaaaaaaggaggatctaaagagaaactataaaaaggaaataaatagacagtacgtttggaaagtacaaataataaaaagcaggaataaatgttgtacaaagtgaaattgctaaccatgtaaaaagtccttcacaactatgacaattttctcataattaatgccaagacaacagcattttaacatatccctgttgtaccacaaaaagtaaaaataaatattttcactaggttcctaaagtctccaccaaattagaaacctctatccagccatataaaattagcagttttgatctgggtgaaagataagatgcagaaatcattgaactaagatatttgagttcttttgaatttcctccttgcttccttctctgtcattaggaaaataaacataagatttgcaaagataaatgtagcccactttattacttatctagtcaccatgtggaatgagatgagggtgttaataaccttagcaaataataaaactccatttaaaatagtctgtacttaaaatcacattgcattaaatggagacctggaaaatggtgatttgggtcttaaatgtcttaaaacttacggcaggatttttttcttttttttttttaatgtaaaaaaaattgctgaaaacataaaattctgtaccaagttaattatttgccaaatcatattctaatgagtggatggtataattgtaagagtttgaaagtcacagagagaaagctataaagtggactaatcacattcaactgacaaatgattcgggatgggaggatgtttgactctaaatgtagaatttaatgatctgcaaggtcccaaagtccaaagaaactaatgaactagcttggctattattagtcttcatatgccatggttcttgtcctattatgtaggatgttttaagcaattgttaactcactacttttcaagatgaaatatagaaaaacttcagtaaccagcacccaaagtcctccaattgactttgaaaggaaaatgaaatatgacaagtatacacatctacctcttgaattaaaggaacagctgaaaacctcaatagcttctagaatgtgtcatgtcttgaatatgctttccgtttagcatctacaggtctacattgacctctcttgttctctgagaacagatcttcttgataggggcctggaacctatcttagttcttagaagtttaaccatcagggaaagactaactgctccacacagtctattttggaatgagcatggactcattattatacaaagacaagatagaacttatggtttaactgaagtttaattaggaaatttgattggctataattcatatgtttctctcactctttttcattgctccattactctctctgtcttgcagacatttttatccggagaattaaagtgggagggagggtagagtcactactctgactgccaccatctttcgaatttggattgagcatcatcctttccaaatatcatcaggatctcatcctcactgtgtgctatgttttattttctagattattcaggacagaatattcaagcacatatcacgtaacagtttaatatggaacaaacatcctggaggattgttcgtactaccacagtattcatcttatctgggagattttccttactactatgctaatttaggtaagtgaatttcctccagggagttgcccttgtttaccctgaagatgtcatacagaactaaaggcctttattcttctactctaatggggtccatctaacaccctgcattgaagattgctttttctagagccttgttataagtgacatatcaagttcaaaaacagagcagagcattgcaaaatggaaaaaaagaaaaacttcttatctgtgcagctctacttcatatttagtagagttatttctttttgagaaataggctccccaaattatggatcattttgaacatggcaatgggttagctatcattttaagcctcatcatatataaaatggagagctctccccaattttttttttcacaatcccaatatctctattccttaccaaagaaaaactgaataagaggaaaggagaaataactaagaatgtgtgacaagcacaaatttattcatttttccaaggtttattatgctccttctatgtgctatgctaatgtattgctgggtactagaaataaaaagtcaaataagatacaatctctgctttcaagcggttttcagtctaatcacagtagggaaaagggaatggcggagggataaatctctaccaccggctactgttattgccttagacatttatgtatttggacccccagttgctctcatgttagaaacatcatgaacatttcccatcagttacagttctaaacttgagaaagcctaggacaggaaagcatcttccaagctgatacagcaaaaagacaagattttccattcagtgccgttgttctccgtaacaccctcacccttttaagttgtacatgtttagtttgaaactgatgagatgaaacctaaagaaatgcatggcctgaagcatcaaccagtgacaaagcaccttttaatccaaaccaaacctgttatgggaaccatctctaattcagtatattgttgacatttgggtaacagaatttagaaattgtcagattaaggcactggttgacaagaatttctgtatatttcttgtacaatatttagatcttcctttggagttagcacattagaggtgtataaatgatgcttcttaaactattgcaggaaaatttaaagacaatgacttgtcgttcctgtttaaaaggcaatccctcaatcacgcttattcttcttactcggcaaaactttgaatatgtatctagatattgggaaggttaacttctttctaacatacaattaaagtgctgctggatgatataattttctctacaaaacctttgtataatcctgtaatacacatatagtctgattctagcctttatcccatcagtatcaaagcgtaacttgaatgtccctgcactgtgttgctcgcagttaagccactaaagtgccaaattagtgggtctaaactaatgaagttttaaaaggctcttaacctgtctctaatttcttagtgagttcttatgggaaaactccttggggggaagccatctcacttctgtctctttggtgacagtggttgttttgcatatctatgatcctttttaacctagggcttcagagctcacaactggcaaaagtctgcctcacatactttttttctcagctatatcactgctacacgaagaagagattctgggaatatggaggcttcttctccaaaataataatgttggtgagggtgatgataatggtagctgctgacatatattgagtacttgtcatttgttaagtcctgttctaagtgctttgtatgcattaagttttttttttttttctaagacggagtcttgctatgttgcccaggctggagtatagtggcaccatcggcaccatcttggctcactgcaacctctgtcttcagagttcaagcaattctcctgcttcagcctcccgataactgggactacaggcaaatgccaccatgcccagctaatttttgtatttttagtagtgacggaatttcaccatgttggccaggccggtcttgaactgctggtctcaagtgatctgcccgcctcagcctcccaaattgctgggatcacacgtgtgagccaccgtgcccagacaaacttactgaattttcaagataaccccatatttggcactgttactatcaggtctgtttcccagctgtggaaacacagagggttaagtaatctttccaaggtcccccgaccagtaagtggtagatctgggattcagacctagacagtcaggccctggatgctcttcctttcaccttttttcccactagctagttatttgaaatacgattagtcaggtagaaccctttcattacataattaaaaatcagacacatgcaaataccatgggagagacagcacatgaagggtggtgagtgttgtgtgtatttggacactgggtacctaaaaagccaaagggacatcacagaaacatcaccaagaggggcaaaggatgtcaaagcaagaacctagaagtggacattgatctggaatttattgaggtctctagactcaggcagtagctaaccagcagcttttcatcttgtttctgtcctgtcaggacataagaagcaaaggagaaatcatccaggagggaacatttgctccagcatgaggcagcggagcaaggaggagtaattttctaagtcttgctttccagcgcttcattaggctctactctcctttttatttcaggtttaaagcccccctccaaattcactgcagtcatccatgcggtgacccccctggtctctcagtcccagccagtgttgaagcttctcgtggctgcagccaagtcccagtactgtgcccaggtgagcgggaagttgacagagaagcccctgcctgctccagctccagaccagagactccgccctccttacctgttatcccccgggctccccaggctccccgggacttctctaacatcataccctgctactccctttcattcatcctgcctcgttacacccttttcatccacttagaaattcttggaagtgaaatctgcacagggaagggatgggttacagagagaccttagcactggtatagagttaaaaagtatatatacatacaccaacatagtctctaaagaagatacaagcacatgattttgtttttaaatgtcaaaatgataaagtaacatccaaaaagcctctgggaggacccagacaactaagcttcaatagaagaagcagacttgttggtgtcatgaagtgtcaacttttcttttcatagcaactatgactaattataaaattgggagcagacgattatgcctatggtaacaatattttccaaatcagtgttcctcccatattgaacggtggtttttctgatttgtgaattagtttatacaagaaggtttacaaacaaggaaagaattcaataaggaagtatgcatttttgaactaaatgcctttattggaaattataaagtcacataaaatcagcaaccattctagagcatgcaaaacatgagctcatcttagttctagcttgaatttttttatttctcccacattgcctggtgtagtgcaagttcagagcagatgttcagatgctcagtatacatttttatttaatttgatcagagttgttatctcacacaccatcataagatatcagaatttaggaaaccactttattaagctccagccaccgtaattctttttcctgcagctttcccctattcccggacacagttggttttgtttgtttgtttgtttgtttatttgtttgctctttctgtcctctctccagttgttggggtgataatgttctgaggttgtgtgggaatggactcactttaaaactcagttttgatgtctgccgttttgtcttgctgagatttccagctcctctttctctttctgtctctgagaagaggctttgggttggaggcatacataaatacatcctaccccagccatctaatgagccccatccctttcagatcatagttctatggaattgtgacaagcccctaccagccaaacaccgctggcctgccactgctgtgcctgtcgtcgtcattgaaggagagagcaaggtaagactcgaaggggacctatatgtggaaccactgtggagccttggtttctccatggggcactttgggtcttggccctagatatcttctccctgttcctggattattttttctaaaactgtacttttctcagaatattctcagatttgaccacaataggctttcaaatcagggaaatctgggtcttgataccaactcttttatagctttgtgaccttgtgtgtatacttaacctctatgagcctcagtttcctcatctacaaagtggaaacaataatatataccttgtagggttgctgttaggattaaataaagtcaggagctggcaatagttatctttctgtaaatgacaaagatgaagataaagctgatggtggtggtgatggtttgcttggctgattaatctgaatgagctatgtctatcagaatggtgtttctttctcccattcactttaaaaaggacattttcaccttaattttgtttggcatctgcctgtaaagattctcatgagtgctacatagccggcctctcttctgttctccagttcactttgcctagagctgaactatctttctgatcatctcccggcctttttctccatttgctagtgcttccaattaacatttgaggccatgtgtaacctggccctagccagccttccaatcttttctctcattgctttcccctacagaccctgccccctactacatttgatcatttataattagctgaattgcgctgtgtctcttcctacctctaattttgactttgccatttgtaagtcttgaccacccctcaactcatcatctctgcttgtcaacattcccatatattctttaagcccccgtttgcatgctacctcctccttgaaatttcttctactaaagagcagctagctcttttttctctagcttctgcttgttacttatagatcttacgcattgtgaaggaaatagtcactactaaatgaaattgagattggtgaagcagtgccatctaaaaaactttccttgtcagtccccaaggggtcaggtcataagagagtggctcacacctttgcgccagaatgacaaaatcagtttattaggctgaaccatttgatatcatcatcgactcaccaaaagtggcaatttcatatggtttgacataatgcaattgtaactgtcacaaggacaagatgatcagtgcattatctattcagttccatttatgagtgcctactgtgtgctgagctccttgtaacaggcttggaacacagtggggaatgtgacaaatatagccatggctctcataaggctggagtcaaacaacctgtttgttagagagctgcttggtaagcatttaatgagaaaaggtggatgttggaataatcacatgcctctctcacaaatcaatctcaccataagcacagtttcatgcaggcccttatatccatcccccccatagaatagcccatcataggaatggcagtgttccaattccaatgcctgaagccatgaacagtactcagaggcaggcagttaatgttgaactttgggattctttgttttgtatgcttccatgggtcaaggagaccagctctgcttctggtggataatgtctttctttggatatgtcaggatattcagacacaatccagtctgtctgggagccattctgatttctttaggtagtatagcattttcatgctctgactcactgattgattttatattttcattctcagtgaaaagaaactccccgtttctttctttataaaatggtggtgataataatagtacctttctcgtgggctttatcagatgtctcttacaagatgcctcagatcctcccagctgcatctatattcaggcccctggcatttgttcagtccttgcctccaccttgggcactgaatccagtgggctgggttcttcctatgtcttttccctgactctcagtgccctgggattgcacctcagagtgaagcgtttgcacttaagtcttgcttcaggctcagtattctagaaaacctgggctatgacatgggcccattttgagggttaaataagaccattccatatcaggtgcttagtcctatgcatattatacatgcaccaagggttcaataaatgttagctcctcttctgggaggcatcataatcttatgatttgtattatgggctctaaagtcaaaattacttttgtgtgacttaaagcaagttgctaatcctctgtgtctcgatgccccctttcaataaatggaaagagtcataatatgtaactaataaggtagccaaaaagatcagattatatgagatacataaataaatgtactgagaagtgtgggcgcactgtggatactcaataaatcttaactattattgtgttttatataattatttgtgtacatttcttatgtacctccctccccaccccacacacacacactacaagacagtaaacttcttgagtcttggtcatttcctaggcatgtttgttaattttttttttttttttgaggcagagtttcgctcttgttgcctgtccaggctggagtgcaatggcatgatatcggctcactgcaatctccgcctcctgggttcaagcgattctcctgcctcagcctcctcagtagctggaactacaggcatgcgccaccaagcctggctaattttgtgtttttagtagagagggggtttctccatgttagtcaggctggtctcgaactcccaaactcaggtgatccaccgcctaggcctcccaaagtgctggggttacaggcgggagccactgtacctggccaacatgtttgttcgttttaaaggagttgggctttcacatggtagctaaacctttcttaaatgaactaacaaggaaaacccagttcactcaggtttaactttgtaaatacattggtttctctcatgctaatccatttaagaaggtcgctgaggcaatgtgtttgaaaaaagcctctcatttctgcatgagaattcgaaaatggatggcttatgggctttttacttctgttgatgaaacaggttcagaaaaaaaggaaacagatccttttaagacctgtggttgggcagatgatgaggaagaagccctacatcttcctcattctccattttaaaatctctatctccatgaatttagaagcaatatatttgctgctttggctgaaaaattctgttttgaatttataggcgttgtctttgcagttttcccctgtgggcttaacaagggaaaggtcagggcagtgctaagctggcagctaatggtttctgcgttagtcagtggacatgtaaacagtatcaggaggattgcttcaggctgagaattctgagcactgtgtctatgaggttgctgatcactttgtgttttatttcaaaagcctgagaaagaaaacaacaacaacaaaaaacttgacccagttgacagatgtgtaggagcaacccctgaagccatgtgtgctacagctatgtcccttgagctcttggagatgagttagagtggccactgtccatgcattaaagtcctaggtgctctggtagcttcgccggcaaagaaaccgagtttgagatgaggcctgcagatgagctggctcctaggggtactcagatttggggagactgcagctctggcagctggctaggtacctcccttttcctctttccctttgtctgcagtgttaagttgcttctttccctggcctttgtctcttcaaagttgatggcaggtgtgaattcagagaggatgtcatcatccttactataacttctggaagaaggtgatgagcatatgattggcatatgtgttcctaaattcacttttgaggtcctttccattcagatacagcccggtggccaaggtgctctatagagtcacaccatctgggggaaaatcctgggtccgttttgggcaagatacttaacctgtgtatctcagtttccctccctgtaaaatggggttgttataaagatgaaacacgatgatatatatgaaggacttgcaacatatcctggcacacagtaaatgttcaaaaaatgttattcttatggtgtcagcattcttatggttagttcctctatggtacattcaacacaaaggtttaagttgtgactatcacagggtaacctctccaccctcaatttttccagctgatgccataatctccaaagcccccaccacacacacacacacacacacacacacaccactgtgtgtgcacacgtagtccacctttccttattccagaactgcccaaactttatgcatacaccaccttcacaatttttctaaatccatggatcatatgtgctattatttaatattttttcttcttcttctccttctccttctccttctccttcttctcctcctcctccttctcctccttctcctccttcttctttcttcttcttcttcttctctttttttgtttttgagacagagtctcactctgtcacccaggctggagtgctgtggcaccatctcagctcactgtaacctctgcctcccgggttcaagtgattctcctgcctcagcctcccaagtagctaggaccacaggcatgcaccaccacacctggctaatttttgtatttttagtagagtcagggtttcaccatgttggtcaggctggtcttgaactcctggcctcaagtgatccacccacctcagcctcccaaaatgctgggattacagtcatgagccaccacgcctggcctaatatatttctttaaatcagtatacttctcattttaatgaagttatttgtaactttaatattacctttgattgctgtagctgctaatatatgtgtatatattttttctaatctgtgctaatacatattttaatttgtaaatgtttgtaatttgtaaaagcagcactttctacagtgatctgctctccccgtggtttgtgtccacacttggaatcacttctccatccattcactctttcggttgggaagagtgggtgtcaggatgcaggttctctgctcagtgcctctgcatctgccaagtcttgtctttaatacttcattactatctatacctggtgaattctttctgcccatcagggtcctgcttaaatgtcacttctatgaggccttcacctgctcttccagacagctagttgctccatcctgtggtctcctggcattttttgtatcaagcaaagactggtcatctgcttcttggtctcctctacagaccatgaactcttcaaagacagggaacatgtctgatttatctttgtaccctctttgacaagcaagatgtctgctacacagtaggtgcccaataattgttgaacaaatacatctgcattgatgggaaatgagattccttcggtgttgaggggtgacatgatagtagcgcattctttatgcaggtgaggatgggagaattgtcctgaaaacaagactctgaagttacctctttccctcattccctccccactgcctacttctacttcctcccaggttatgagcagccgttttctgccctacgacaacatcatcacagacgccgtgctcagccttgacgaggacacggtgctttcaacaacagaggtaagaacccatgcctgaggagcagcaggtgggctgttcaggcagtcacctcatgttgcacgatgctaatgcttcttttagccgtgccttggcagaagttgaaaacatttttcaaaacttcctacagcgctggttttaatcagcccgattcctgttagcaccttgctgccacctggcactctgaggcgggcatctcccctttgttgtctctgctaattggctcctcatttgcataactgggcctcacccctcctcccaggcctgccctccttttttgtttttaaacagcacagttgtgagcagttgcgcagaactgaggggaagggggagggtgcgtgttctgcattaggttgaaaccatgctttccggaggagataatcccattcctctccacgtatcctattgcctcagttaggagactctatgtggagctctaaaggcagcttttctgtcttggtttaaagagctcattttctttcacctatacaagagcaaacggtttcacttcaaggttgtgatggagattcctatttcagatgttcaggtagttgtgccaaaaataagattgcctaaagaatgcgcgtggaggagagagagaggaggaaagatagatatggtagaaaaccaatttttacaactcgaatgagtattgatctctgaaaccttcctttaaaccatgcagaggaccaaagacagctatataaaaatggagtatatgagaaatacattattaatggcaactactaaaaagcatggagacgtaactacttacacctttcccctccctctccctgtcttttttcctttttgttcacaatcattttccttttaatgtaaacatcagtgtaacctgcattttcctggacaccaatctagttctaatggcctgctgcccacagagccaagactcaatgttggcctaggtgaactcagtgtctccttgaaattccacagatgtggcctgacgcggtggctcacgcctgtaatcccagcactttgggaggctgaggcgggcagaccacaaggtcaggagttcgagaccagcctggccaatatggtgaaaccttatctctactaaaaatacaaaaattagccaggcgtggtccaggtgcctgtattctcagctactcgggaagctgaggcaggagaatcgcttgaacctaagaggcagaggttacagtgagcggacatcgtaccattgcactccagcctgggtgacagagcgagactccatctcaaaaaaaaaaaaaaaattccatagatgctttcaaggtgccatcagatagagttgcatagatgttatgtcaaagggcaacctaaataatcccaggacaaaatgtcctggacctcaccttgttaaaatgctttctatgcagccgaagctctataaatacttgttgaatgagtggttgggccagggtggggggatgcatgctttggggattaaaggtggacacaccgccaattgtgtcatgtgtaggttggcaggaggaagggatgttgataagcttaacattcatagggaaagacagctatggaatacagggtacaggtcactctggcttgcatttttctgccactttctgcaagggaagctggaacacattcattcaacaagtatttattgagagatttctttgtcctggtctccatgccaggtacttcagttacacagttccaggctatatccatctgagtcctggcaacaaactgaattcaaatcagatgattcaaatgaaggaactttggattccttagggaggtgtagatggggttaaaagaccccataagagagaatgaggcacctggtgagtaatgacagcaggaagcagctcctccctttggcctgaaggagttagagaaggaactccttctttcaaaggccctgagagatggcactaggatggagaggctgctctacaagtgctatgatcatggaaggacgtggctactgccagaactctaatggcaaaggagagagggagcagagaagagatacactgacctctctctctatcctgcctcgattttcctgccggtgactcccattgacctaacccaaccaggtgatgcagtccataggggtccattatctgagggcacagggcaggacaagaagagtggatagtggattttggagggcaaacacaggcaaagcagcacaccgccatggtgcaacaaatggtcaagacaactacagcatgtaccttaatcatcatcctatgacctgaagtattgattcatcctctatctttccctgggcacaaggcaattagtctcactctaggattgtttttccctatcctatggtgaaataactttcaactgctgtgatgcatcctcatgctggtgaatttcttttcaaagaatagcaattccaaccactcaatgcatgctgggaggaacatgtgttgtatgtgaagtaattagaagtcaacgtgggttgaaaatgatatgtaaatctaagaggctggcagtctggtttgcttttgcctgctgatcagtggagtggttgtgttgcctaaaatggtcctgggcaaggatttctcttttctctttttttaggtgaatagatgttggttcacttttcttttcctctctaaggatctcagattgtttaaatgtctctctgcagcattaaggatggatttttaaacagcatcctataaagggcattatagttggtttatagttatttacatttatctggattgctgcagacgctgctcaaaagaaaacagatgttggtttttgagagaaagggccttaaactgacctttgccttctttgatgtgttaataatctgcatgaaattagagctatcacaagaatcatagttttatctgaatttacttttgagttcctttgaaatgacttgaaacagccttaagatagtaagaaattcatgcgatgagaacaccccattgggttctgtagtagttgctagtgcatgtgtttccttttcaaagaatgatagaaaaccccaaagagtgctgacggccaggctgatcctttgacaacaggctgcataatatactgtcccatcagttgtctccattagtattgaccactagtgaaaaggtgtaggtaatcacaacctaatttcaattttctagcagatgctcaccatcccctgctaccttttaactttgagataacgtgctccctaccaagctttcttaatgtcggttccaccacccgggttttttccccgctctggattttttttttttttttgacggagtctcactctgccgcccacgatagggggcagtggcaccatctcggctcaccgcaacctccgcctcctgggttcaagcaattctcgtgcctcagcctccccagtagctggaattacaggcgtgcaacaccacgcccagccaatttctatatttttagtagagacagggtttcaccgtgttggccaagctggtctcaaactcctgacctcaagtgatccgcccacctcagcctcccaaagtgctgggattataggcgtgagacactgtgcctggccccgtgtggatgttatagttttggggaacaagccatatttttaagtcttccttatcttaagatagggcagtgtattaggatttttcaggcaaacagaatcaatagaacataatatatatatatatatatatatatatttatacacacacacacatatatatacctacacacatgcacatacatacatacatacatacatacactgagagagagatttattatgagtaattggctcacataatcctgggggctgagaaatcccatgatctgccgtctgcaggctacagacccaggaaggctactggtgtaattctagacagagtcctacagcctgagaaccagggagccaatgatgtaaatcccagtccaagggcaatagaagttcgatgtcccagctcagccggcaggcaaaaagaaaaaggggaggaattcctccttccttcacctttgttttgtattcaggccctgaactgactggatattgcccatctgcactggcgagggcagtctgctttactgaacccgtggattccaatgttagtctcatccagaaacaccctcacagacacacccagaaatcatctttaatctgggcacttcatggtatactcacattgacacatacaattaaccatcacaggtcctgctttggaacctctgagagggcaggacctggacctagcagcatccctccgtcccccagctaccatcacagtgccaggactcaaaatatttgcgaaacagatgaaatttccatttgtattgcttatccagaagagatacggcaaagataacgaggtgaatcatagcgtgtataagagacaaattgcttttaacactggagtaacagagccaaaagagaagttttgataaagtacgtagcacatttgaaaccagactgcctgagtttgaatcttggctctgccacttattagctcagcaaattacttgaacttatatcttagtttccctttctgtaaactgaagaatgtaaaagcccctgccttacaggggtattgtgaggatggaatgagttaaaatggataagcacctatagctgcacctgttgtattataacatttcacaattatgagcattatatgattgtttgctgtcactatttttgttatttttattttctgtttattattttgatttaccattcatcaaatgatcatagaaatcagaagtgagtttatgcatttgaaaacagatcacttgctaactataagtgctggtttatagcaggttcagaagcacctgctttgggctactataagcaccggagagacatttagctgcatttcctttaaaataattctgtggcttcagttgttcttgtccccacttattcttagtgattttcactgttgatgctttcttctagtgtctcttaaactgtgcatcttcaaacctaagaagcctgaattatgttttctttatgatacctgctctgtattcctgttagaacttgtggtgttttttttttaaagttatttctcttactcttaagagggtgcttttattttaggcactttggctttgatatatgctgggtatgatatatgttgtatattcattctttggatatacatgggaaatttctcatttataaaacagatgtgtttgtgtctcacgtgaatcaaggcacgtgcacctttgaggaagggggaaaagaagctttttcaacttatgttttagcttgaacagactggatttttaaagggcatatcagcaaatttttttcttcctttcatttccatactactctgaagtttctttaacagaaaacattaaaatgtgcataattatggggcaaaatgtcaagcagtcagtttaatttgctgatgaatacatagaattaatgtttcgccacagtccccggattttgcattatgaattagtggggagaaggtaatgttttgttgacatttgttaacactgttgattgcttgtttggcttgtgttctgcctgcaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaagtgaggaatctggacatgtctcttacagactttacatagctttttatattggctgctgcataaataggaactaaggccaaatcttgttaacagcattgaggaaaattagtctgtatccccgcttaagttttgctgatgtgtcaaatgtgtgtttttgaaaccagtgaaacctcttggcatgtttcatttccagaaattatggtagagtaacattttcagttggtctgaagtgtgaaaatactctcagggcatattaggtaactgaatatttagaataacaacaacaaaagtaaatacctaagtcagcacccaagggcactgttctaggtgcttgggattcatcactgagtaaagcagaaaaaattccttgccaatgcaggtcttatattctaacaaagaaagactgtctacataataattccatagtttattaaggagataagtgatataacagacaaagtgtagaaaaggatcaagggtgctgaaggtggagatggggcagattgggggtgtccagggtgattctgattgcacaggtgagatttgagcagagacttgaaggacaggaagtcaagaggacatgtgcaccaagagtgttgtggcaggagaacagcgagaataaatgccctgaggcagaatactggagaaccatcgaggagaccactgtgactgggtggaatgggtgacaggaagtcagaaaagtcagggggcatggatgcacgaccttgatgtccatcatgaggacttgactttttctctaagtgatatgggaggagggcagggtttgaacagggtgtgacatgtacagcatgtcactgtaccgaatactgtaggcagttttaacacagtgataaatcctgcaggaccttgatgtccatcatgaagacttgactttttctctaagtgacaggggaggaggacagggtttgaacagggaggagaaatccggcttttcttttatgcatccactgtggattctatgttgagaagaggctataacagacccagagttgaagcagaagccctattaggaagtgattgacattatctaggcaagagatggtgggatcctgggaccaggaagtgaatggtggccatggtaagtagtgatcagattattttgaagatgctttagcatgatgcctagagagtctggatgtagagtttgatgactccaagtcttttgacctgaaacactggaagattagagggctgatcaacagagatgaggaaaactacagatggaacaagtatgagggaaaatatataggttcagtcttggacatgttaagacatccaaaaggatatatggaaaaagctcaggggtggagatacaaatttggcagttgtttgcatatatttggtctttaaagccaggggactggagtaagattgccaaactagtgagggtagatagctaacattccccactcaaccagtaacaaaatacctgctcttctatcattagtgaacacaccaatcttgccttagtctttttagtaaagaatagggaattttgctatctcagggatagcttggaaatgctcaaggcataaacatttaggctgactgattcttggtctcaagatttcacttcttgaaagttcattgttcctattgcttctgccaccaccactctaagaatttgattcactcaaatgatttttcctataaatatatgctatatgtatataaatacattttaaaaacagtaggatgagaaataattcaaattaattatgggttttctgttacgattgaccaccccattaattcagattttgctctaacaggattgaaatatatatggtttatagggcacaaatatagaacagtctattgttggactcagagtcaagggataatattaaatacagttctgattaagccaatgattaaaattgttaagcagctttataatatatagatcatgtgtaaataacttatcttgccatctaattatttagttcttctttctaactcacctgtctgatgttagagttagactggacaagcaatgtctgtatgtctgtatctctgtgccttgtttcctcatctgtaaaatgggagtaataatagaacctgccttgtaggctccttatgaagactaaatgaagcatttcttgtaaaacactttagaacaatatctggtatataacaagtaccatagaagtgatagttatcgtcatcatcatcatcattatcattaccattcatgacatgtttagggattcaaagaatgggtatgtgttttctgtctcagaagtccacttgtcatcatgtgataatggccccctgtgaaacccatctttgatttttacagatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacaggtaagtatagaagagccctcttcccttgcttcactcactggtggttcagccccaggtaatgaggactcacgttcctctagctgttccacccaggagcatataatgaggagaaaccaggaatgaactacatctgaaagctagaaaagagtgtatgattggtgcagggataattaggaagacacaagttaagagtatctttatgccaaggatgtaaagctctcctataatctttaaggtgacatgagaaagatatgtctttagagtttgtcttagtccatttgggctgctatgacaaaaataccattgactgggtgacttaaataacagacatttatttttcatagttctagaggctggagagtcccagatcaaggcaccagcagatttggtgcctgacaagagactgtttcctgattcatagatagccctctgctcattgtgtcttcacatggcagaaagaagggcaagagagttctctagggtcctttttataagagcactgctcccatttgtgaggactccaccctcatgacctaatcatcccacagagacctcacctgcaaatatcatcacattaagaattaagcttcaacatataaatattagggggcacaaacattcagccctcagcagaattaaagccctacaaataacttatgaaagttgattgtaggtaccttatttaatgtctagcaaaccatactctctttaacacagttttctggtgcttgcagttgagttgaattgtgtcttggtgacataacaggaatcacaatatttaattttcagttctagaatcaggatttaaaatacaggcaagtcagtaaccttctgaaactcagttggctcatctttaacatggaaatggtgaaatctaccttacagggttgaaataatatgtttgaaagcttttataaaagtgaagtaaaatattgtgttgagttatacaattttagtattaaaggtattttcaaggaaatagaatccaacattttctttttataagtaagaaaactaggacctagtgaatttaagcatattgccacaagttgcccagtaagttagagacagaattgggaattgaatcccagggtctgtggacttcactgcttgtccttgtacaccccaccatcttggtatcaggtccacctggatatgccgaatttcatctatctttattcatcttgagcagagcccctactatatgtaagaaatcaaaaatcttagccaggcacagtggctcatactgataatcccagcattttgggaggccgaggcaggcagatcacttgaggccaggagtttgagaccagccttgccaacatgtcgaaaccccatctctactaaaaatacaaaaaattagctggtcatagtggtgcacgcttgtaatcccagcttactcgggtggctgaggcacgagaattgcttgaaactggaaggcagaggttgcagtgggttgagatcatgccactgcacttcaggctgggtgacagaacaaggctctgtctcaaaaaaaaagaaaaagaaaaaagaaacaaaaaaccttaagaaagagcattaagattcactcacgttaaatcatggagcatccaacaggattgaggttaatctgaatgaacatactttaacatggttatattagttcaattttgaggggctttgcatgtgccttgttctcacaggcattggaaaacatatacaaatctagcttttgcaaaggaaatcttagctaggcctcatgttaagctgatagtttttcattcactaaatttagtaagcaaaaatttaaagtttataaagaatttaaagtttataaaaagttatttagtacttagtgagcatgttaccaggcactgttctaggtattggttatgatgaaagagctgtccttagcaaagagtctggcagaaaattctgtttccttctaattacagaaagaacagataagaggatttgtaaaaatttttaaggctgagagaatattcgaattcaagcaagatgtattgtctattatgtgcccaaacatttttatttatattttttatttatctcttaagaatgaggatacattctgagaaatgcatcatttggtgatcttgtcattatccaaacattatcaagtgtacttacacagccctatatggtacagcctactatagcctattgctcctaggctataacatatatagcatgtcactgtactgaatactgtaggcagttgtaacacagtgataaatatttgtgtatctaaacatttctaaatacagaaaaggtacaataaaaatatggtattacagtatatgggacaatagtcatctatgtgatccaacattgattgaaatgtcattatgtggtgcatgactgtatattatctcatttaaggacatgacattttaaaaatatttttttactcagagttcttcagaacactcactaagtggggaattctagtcatacaaggcctcttagggggtggatttgtgctattttcatagattagcctaattctaccaaacagtatttctagtaattcatacatctttaacaaaaaaatctaaatttaaccttaggtctaactaggtgtattcaggtactatatttgcccccttctttccatcatacacattaatttattgaatgtttgtatgaccggtaaagtaaatagatatcatcctctaggattaggcttttattacataagaaaggcatcttttctaatagatgttggttgactcagaataaatgttaacatctagaagcaaaacgatacctgaatgattcaactgaactttaaaaaaaattttttgaataggaatgagtgtaaactctagacagtatttctagttgcatatatgagtattttgcctgggtacagcaccctttgggaatgagtgggccaatcaaaaatggcccacaggccgggcacagtggctcatgcctataatcccagcattttgggaggccagagcaggtggattgcttgagctcaggagttcaggaccagcctgggcaaaatggcaaaaccccatctctactaaaaatacaaaaattagccatgcatggtggtgtgcacctgtaatcccagatacttgggaggctgagacacaagaatcacttgaacccatgtggtggaggttgcagtgagccaagatcatgccaccgcactccagcctgcgtgacagagtgagactctgcctttaaaaaaaagaaaaaaaaatggcccacaaactcatatccatttagggtcaaaacaagttacatttgggattgtctactctgatatgaactcaaccagtcagctccatttgatatctttctctgatttatcaagtagagttcccctcatataaaggctgaagaatgaagcttgagttctgcccctctctagccttgaacaaataactctaactttcttaaacttgcttcctcagctataaaatggggatgttattacctgggtagatacttcaccagattgtggtgagattcaaatgaactccatgaaaacactttacaaatagtgttttgtttgttattctgctgttcagaggtaacttgacatttgtgtttatcttcaatgttattttcgagcatgttgacactatgattctgaagtgactcttactgcttctcacactaaaatgtatcttcccatgaaagtatttttctaaaactgtgagtacaacaaatacacagaacacacgtgcatacatatacatcattaaagacttgcctattgacataaatgggcttgtgggggttcccccataattgggcagcccatcttttccatgtttcataaaaacagggattgaaagacaatgtgcttagtcattctatttaaatttcagcactccagtcattaaggcattctttttaaatcaatgccaatcatttgcatgatctaaaaatatttaaccaactttaggggcaacacagagagctaaaaacatggtagccatcttttctatttgtcgagagttaatctttattctgggtgagcagtgattctttggagggctgattgccctttaaaaagtaacctttgggggttttagtcaagcaggaaagccaacaattcttgggttaagagaagaacagaattttgagattttagtataaagttagtcatacagcaacatgctctatataccactgaatctcaccttctcatcctcatggagtcacgtcaatggggaggctacagaagagaaaacggagttttagatgctgcgtaacactagccttgagtgacatgtaaaaggcactattttgttcttcttcaactatatatgtgaatttttaacaaaggatttagtaggacccttataaaggtaaagagatagtagaaggaaggaagtgatggatagagagaaagatagacttctaaaagttggtgggtatttctaaatcaactacataaacaggaaggatttagaaaactctttgaaagcagaaacacatctttaatcttagtacttggtcccaagtgcaaagagaggttttagattgagtcactgtagtagtcgagtttcagttgctaagtcgtggactgaccagagaattagtcaataaattttagagaattaaagtcaacatgaatctttgtttttgtgtttttaacactgaggaacgtagcataccttgggaaaaaccaatatcagcgattgcattttcagcaggtgcatagatggtgagacttggtggccgggccagaccccaagctttgctgcttgctcatttgcctgactccattttctgcaatgtttccatctcaccttgcacttctctcatcattatccttgtttctctccttctccctagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatc

SEQ ID NO: 36042 - DNA, 5358 bp, Homo sapiens
gagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactggtgagaggtagcggcttacgtggggacccggaggccgccgctcaaggtcgtagccggcccggccggggtttctcatgggcccagctgaggtcaccaacttgggcagaggcgactgcgggtgcttcaggggaagagggtcacccgagcctaccatgggccggacctggcggcggcgcggtggtcagaccggccgtgcctagcattcgtacgtgctatcggagctttggtctcttttgtccttcgcaattggcgggaggacgatgactgtcagtgacacactcactttgtgggtgaggcagcggaggcaccgagaggtgaagtgatgtgcccagggcccaggccgagccactgttgtacccagaacccaaagtctagagttgcagagtgtaattatagatgcccgttggatttttttgtttgtgacagagtctcgctgtgtcgctcaggctggagtgcagtggtgcgatctcggctcactgcaagctccgcctcccggattcacgtcattctcctgcctcagcctcagcctcccgaatagctgggattacaggcgcccgccaccacgccggccatttttttttgtatttttagtagagacgggatttcaccgtgttagccagaatggtctcgatctcctgacctcgtgatccgcccgtctcggcctcccaaagtgcgagaaagaggtgtttttgagtgagctggagcacggtgccactcctcagggctgtcgagtccctgcttgtgtgtgtgaaaaggcggtagaatgtggtggttaggagcacggacttttcttcaggcgctgccctcaactagctgtgtgaccttgggccagttatttcatctattcctcagtttcttcatctttaaaatgggaataataattccttcttcagaaggttactgtattaagttaaaatatctagagtgcttagaacaggacttgatgcatatttaactcattaaatattagctgctgccgttgtttttgttgttatttttgttatttatagggctttccttagcagcagcttccaagcagaacccggttctttgacatatgagaactgtgtctgctccacagagtccctgtcttcaagctgacttttggaaaaattgctactgaccagaacttaaacccacgcgatactagagaaggagaaacttgagtgatctgctggttcagggactgcaaattcagatgccttcaggggcaggcagataaaagatgtgtgtggggagtgactgtagcagtgtgtgtgtgtgtgtgtgtgtgtgtgtttcggggtggtgcattcaaattcagcagtttgaaaacataatgtttgcctggcagaatacttctaggagtacccagaaccctctctggttgcaggaggaaggtgctgggggaaggaggaccacattcaaaaagggtggcttgtgaagggtaaatcagtggccaagtagaagacagaacccaggtatcctgactctgaggatccagctctttctaaaccgacccctcccaagaccttccctcaaattctgttttgggaagaaagtcccaaagtcagaagggtcttgagaggaggaaaagaaggcagagggctacaggagcctagaaagcaagggaagaggagagaaaagaaggggtcaaggagtatgcatccctatggggaagatcagtgatctgtagctggccagttactcaaacctgtgccacacgggttttatggtatccatcatcaggactccagctgaggaatcaaatcaaggaaggggaataagtaatagtgttgagaacttagaacagcctgagcattaataaaaaacaaaagtaaaattttaagtatttaatgaaaaaaacagtaatgataactcacttttttttttttttttttttttgagacagagtctcgctcttgtctcccaggctggagggcaatggcgcgatcttggctcactgcaacctccacctcccgggttcaagtgatttccccatgcctcagcctcccgagtagctgggattatagttgcgtgccaccacacctggctaacttttgtatttttagtagaaacggggtttcaccatgttggccaggctgtcttgaactcctgacctcaggtgatccacctgccttggcctcccaaagtgctgggattacaggcgtgagccaccgcgcccagctaataaaataataattattttttttgagacggagtctcgctctgtcgcccaggccggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctttttttttttttttttttgagacacagtctcactctgtcacccaggctggaatgcagtggcccatctcagctcactgcaccctccacctcccgggttcaagtgattctcctgcctcagtctcccgagtagctgggattacaggcacccaccaccatgcccggctcatgtttgtatttttagtggagacggggtttcaccatgttggccaggctggtcttgaactcctgacctcaggtgatccacctgccttggcctcccaaagtgctgggattacaggcgtgagccaccgcgcccagctaataaaataattattattttttttgagacggagtctcgctctgtcacccaggctggagtgcagtggtgcgacctcggctcactgcaaggtccacctcccgggttcacaccattctcctgcctcagcctcccgagtagctggaattacaggcacccaccaccacacccggctaattttttgtatttttagtagagacggggtttcactgtgttagccagggtagtctcgatctcctgacctcatgatccgcccacctcggcctcccaaagtgctgggattacaggcgtgagccaccgcgcccagcccataaaataattttttaaaaaatacactcaggcacaagaaagttaacttacacgggatcatatagctaacaaaagctgggatttgaacccaggttgttcaaactcttgaacaatgctttactgcctcttcaaattcagtggtctttttccccaaacaaataataagttccttgagagcaaataccatgaatcacatgtctcatcctcaagcacctagcctagggtcaggctaattttttggtgaagaaatgaatgggcgacctgtatgtgttcaatgagtatcatttgactctaggttttatttaaccatacaatttctaccctgagtcatgtttttctctctagtgcaccaattccagctggacatcactgtgaaaatgggacgggataaagtccgagaaatgtttatgaagaatgcccatgtcacagaccccagggtggttgatcttctggtcattaaggtaactgaccctccctgaccaatttaaaagatcagccaacttgtccactacttcttagtctttccaaatgaacattttgtctccaagtttagaaagcagctactggttcggcagtgattattgctgtgtttcagagaaatacttgaacttggaggttatcatctggttaaatagataagattcatcaagggaacatccactgggacttgcattttataaccataaaaaaagatatagggaggaaagtttgaactcttcttgaacctcatccctagaagttaccacttcatctgaatgccagtttacagctggaagaggcagttagggtggttatgagtcctgtataaatggactcaaatcctggggctgattctgtccccctggccagtcacgttagcatcaatgggagcttcagcatagaccagtcagtaacagaagaaatgataagcagaaacataagttaagccagtcaggttaggtagtcatgggataggagcctgttaacctgtatgtttctcctcttggtaccagttaaccacagagttaaagaatctgaaaagtgtcagaaatgatttaccctgaccacctcattgtccagacatagaaactttgcccagacagagtagttacttgcccaaggtcattcaacaagtccatgctgagcagagaatagaatcctggccttcagtgtcatatgccttcaacttgacaactttgactgatgacctctctcctcactgttcagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactg

SEQ ID NO: 36043 - DNA, 30377 bp, Homo sapiens
gtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgagcgcagccccctcctcctctcctcgcccctcggggtcctgccctccccaggccaggcctccgcttccggccgccgcggagagtcggggtcgtggggtgaagttcactcaacctcctcggttttggagcggacgtgataaaaacccagcccgaaaggcttgtttgggttaaggagaaaacccttacttgtaaggcgctagcgacagcgatttcggtgcaatttcctgtttagttgagaccaaagtttgcttgcatgtgaccttggaggtcattcctttcttcgcctaacagtgaccccactagttcgagtccaagtattagaaaaaatggggcggcgccataggccgcgggcgcctgctgcggggcagctgcgcacaggagcccgccgctcggcctcggtggtcagggctccccgggtgaatcgatggagaggcctgcagaaatggtagctggtgttctgctggaagacctgccctgctcccatttcccttctgttgctttagattagagcggtcactctatacctaagttctagggttatgaacttgtttaaaacaactgtgtaataaactcccttttcaaaacaagtgggcacagtcaatggaatcttactttaaggatgtacgagtcgaagaacattgaggtggaatacatatcgaggccctgagacaggaaaaagcttggcaggatctaagaaccaagcattttggtgctccagggccctgtgggctctgtaagaaggtggggttttgttccaaattcagtggaaggcaatacagggatttaaagcggggtaatgacaggatctgatttccactctgtccgaatttggggcggtctgtgtaatggcgaagagaccatttaaggatctattgtagaggtccagggagcagcaaatgatggctttgactcgtgtggggcagtgtaattggggagaaaaggggagggatgagttgagatagatttggaggtggatttgatagaaagtggattggatgtggtggagtaaatataagaaggaaatgtcgagaatgatgaaaagtgtctggtttgatgaaccgtgttcatgatgatgccactttacagagtgaggaaaattgggaaaggaatagatgtggaaagaaggattgagaattcagttttaggcagaaaactttttggtgcctgtgaagcagccaagtggagatgccagctaagcattggttagggggatctgaaagtgagaagaaccaaagtggcatgggaacaaatcaagggaaaaatccgtattctgggaccaaatgcagtgtttacagtttcctgcaacgtggatttcatttgccagtgcccttcctgactgaatttactacatttacttcataaagcagcgtggtgaattttttttagacgaggcatttacacttcatttaaaaggtgcattgtcatgagctatcttctaaaaaaggaaataatatttttactgatatcattttaatattttatcagtggttcttaccctttcttataatacagacctgtttgaaaatttcacaaatactataaacccaaaaaggaaaaaaatgcacattgacacctgtattaaggaagtataaagtttataaatttctggtacaatttactgtagtgttagagctagtgatcgtatttttttccatttccttattgtagcaattaggaggacactcatgtcgagagaggtaaagtggttgtgtataataacacaggtagttagtggctgtgactagaacccaagctttgagcttgaaatagtgatgttacaggccagctagaatcattaaagataaacttctctcaagcagcataccaagtgtttgcaggatgggtgggaagaaagaagagcatgtgactgattatagggaaaaggacacatttgagttaaattttgttaaggattaacattaatttgtcagatttcagtcaacaagaagaaccggctcctaggtttttattagcacccatcccagtacttggcaggaggttttcgctcgacagatcatagctctcctactgctcctagctttgttgggaatgtttgtgtattttttcaaggcaagtagacagggctgctaaattaccttaatcttgaaacaactggatgccaccgcagctttccttaatttgccctcgttgctgcctgaagttgctctaagtgaatatttacctaacaatgtgatagaaaggtagtgctcctgtttctttcctagtggtgcttttcctgtattgtcaactcagcacatctttccagggcctttcttggagctacttggactcactacactctgggttaataggtctcttcactgtctttcagttttgggaaatttttagcctctgaattttcagggtgttcaaatgagatttcagtttggtgttaaagattgttaagttttagaccttttagtatccacgtaaaattgacatcaaatgaaaattgacatggtatacaatttatgaaattaaaaaaaaaaaactttaaacctttatagtctatctgcacatcccagattatttgttaaaatgaagatttaaaataataataacaaattattttttaaaatagagaaacccagtctctacaaaaaatacaaaaattagccaagcatggtggcactcgcctgtagtcccagctactcgggaggctgtggtggaggattgcttgagcccaggaggttgaggctgcagtgagccaagatcacactaccgcacttcagcctgggtgacagagtgaaaccctgcctccaaacaaacaaacaaaaaaaacccaaaccaaaaatatatgattgagaacattttctctgttcaaaataattgttttagttcagttaaggtcttacttgagctaacctttacagtctgggagcatcaaataagaagtaatataggtaaaggggaggtttttttttgtttttattttcccatgcacaccctttcctttgtagatattgcatatttcactactagcactgccctatcaaatgctttcttagaatatgagacataggggagaagttcataaaaggaactttgtagagagacaaatgaaattaggctctattgtttctgagaagtgaggggtcatttccatgtgtgcaatatgtcatttttatttctggatgctttatatatttttgttatctttggatttcaaaagtttgacaatgatgtgccaagctgcaggagaacggggtgtggagtgttacgtgtggtgtttattagagttgaggtttaccaagctttaatatacaaatttatgttttttatcaaatttggaaatttcttctttattatttctgcaaatgtttttttaaatccattctctgtcctctcctatgactgtaacttgttagtccttgaggttctgcccgtgtttttttactatccgactttaaagaaaaaatttacaaactttgtttttgagcagatttaggttttacaaaaaaattgagcagaaagtacggagtattaccatgtgctcccttgcccggtccgtttcccctattattaacattttgcattagtgtggtacatttgttacaattgatgagctaacattgatatattattattcactgaagttcatattttgcattcaagttcattcattgtattgtatagttctatgggttttgacaaatgtgcaaatgaccgatgtcagtattatagtgtcatgcagattaatttcaccaccctaaacatcatctgtgattcacttatttatccctgtctctgaacccctggcaagcactgatctttttactgtctccatagctttgccttttccagatatcatgtagttggaatcatacagtatatggcctttccagactggcttctttcacttagcgacatgcatttaagattccttccttttatggcttgatagctcacttctttttattgctgaataatattccattgtatggctgcaccacagtttgtttatccattcacctgttgaaggacattgttgtgggaagtcagggaccctgaatggagggaccggctagagctgtggcagaggaacataaattgtgaagatttcatggacatttatcacttccctaataatactcttaacgcctgtcttactttaatctcttaatcccgttatcttcgtaagctgaggatgtacgtcacctcaggtccactgtgatgattgtgttaactgtacaaattgattgtaaaacgtgtgtttgagcaatatgaaatcagtgcaccttgaacagaataacagcgatttttagggaacaagggaagataaccataaggtctttactgcctgcggggtcgggcagtaggagccatatttttcttcttgcagagagcctataaacggatatgcaagtaggagagatatcactaaattcttttcctagcaaggaatgttaagaccctaggaaaagaattgtattcctggggggaggtctataaatggccgctctgggagtgtctgtcttatgcggttgagataaggactgaaataccccctggtctcctgcagtaccctcaggcttattagggtggggaaaaaacgcttcttggtaaatttgaggtcagaccagttctctgctattgaacactgttttctgttgtttaagatgtttatcaagacaatatgtgcacagctgaacataggcccttatcaggagtttttgattttgccctttgccttgtgatctttgctttgtcctttgccttgtgatctttattggcctcagaagcatgtgatctttgttctcctttttgccctttgaagcatatgatctttgtgacctactccctgttcgtacacctgctccccttttgaaatccttaataaaaacctgctggttttgtggttcaggtgggcatcctggacctaccgatatgtgatgtcacccccggcggcccagctgtaaaattcctctctttgtactctttctgtttctcagaccggccgacacttaaggaaaatagaacctacactgaaatattggggggcgggttcccatgataggacatcgtggttgccttcaagttttaacaattaggaataaacatttgtttgcaggtttttgtttgaacataagttttcaaatcatttaggtaaatacaaggaacctgattgctgtatcatacatatggttaggtgtgtttagttttataagaaactgccaaagtgtcttccaagctggccataccatttgcattcccaccagcagtgaatgaatttctgttgttccacatcctcaccagtgtttggtgttgtcagtgtttgggattttagcctttctaaaatccaaaagactaatagttgtgtagtagtatctcattgttttaatttgcaattccctaatgacatacaatgttgagcatcttttcatatgcttatttgccatctgtatatcttctttagtaaggtatctgttcagatcttttgcccatttttaaattgggttgcatgggtttttttttttttttttaattgctgagctgtaagaacactttgtatgttttggataccagtcccttatcagttaggtgtttttataaatattttctcctagtctgtcgcttgtcttttcattctcttaacagcatcttttgcagagcagaggttatttattcatttgtttttagagggtcccgctctgtcacccaggctggagtacagtggtgtgaacacggccactgtagccttgacctcctgggctctagcagtccccttgcctcagcctcccaagtggctaggaccacaagcacacaccaccatgcttggctgatttcttaattttttatagagacagggtcccatcatgtctcccaggctggtctcaaactcctgggctcaagcagtcctcccaccttggccttccaaaatgctgggattataggcatgagccactgcacacagccagaagttttctattttaatgaagtccaacctaagttttcccttcatggatcctgcttttggtgttagatctaaaaaattatcaccaaacccaaagccatgtagatttttctcgtatgttctaagagttttgcattttatatttaagtctatgatctctttgtttttgtttctgtttttttagataagagatctcactctgtcacccaggctggagtgcagtgacttgattgtagcccacggtagccttgaactcagcctcctgaatagctgggactacaggcacatgccactatgcccaactaattttttacattttttagagatggggatctcgctatgttgcctaggctggtttcaaactcctatcctgacacagtcctcccacctcagcctcttgagtagctgagattataggcttgagccacagtgcccagcccactatcaaagttgacgcatttttgcctggattcattttgtttggtatatagatgttttgttgttccagcactgtttgttggaaagacgatcctttttccagtgaattgcctttcctcctttgtcagaccttgaggttctggctttgttttttaatcttttttttttcatctgttcttcagattggttaatttctatttatctatcttcaaagtcgctgaatttttctcctttcatttctattttgctgttaagcccatccagggaattttttatttcaggtattttccagttttggaatttccattttggatttttatagtatgtatttctttactgagatgtcctatgttttattaggagcatattttcctctacatccttgagcatagttgtaatagaatgctattttaaaatccttgtctgctaatttcagtgtctgggtcttcttgggattggtctctgttgattgtcatattttttgtttcctcatatgtggattaactttgaattatattatgaatattgcagatggaacattgtggagactggattctgttataatcctgcagacagaactgacttattgattggttggctatttattttttgtagacagttactttgcctacaaaatcacccccatgcacccccgtgataaactatgtctccccttgtagtgggcagcagcttaaatctaagttcagttttttaaggcttggcttaggtgcttgtggtctgacctacacatgaatggctaaggagtcagccaaatatttgggcagagtttatatgtgaaatttggaatctcgctctatggtgctcctctttcccagattctcattcactttctagtggctgtgcttaccatgaattttattctctgattcttcaagccagtaagactgtttctgagttctagccattccatgcatcatggactgttagtcttcaagttagttgctataaataaattggacacttaccctgttctgttcccttcctctaagtatcaactcttctccttacctgtctagttttgttcatttccaagaccgtcaggtagtagttgttcttatatattgtctggagtttttcattgttatctgttggagggttggtcagataggagcatagtaggccatgaccagaagcagaactaatgaaattaggaagaaggcatggaaagaggaaagaagaatgaaataaagcaaccactgataggccaggtgcagtagctcatgcctataatcctagcagtttgggaggccaaggtgggaggattgcttgagcccaggagttcgagaccagcctgggaaacatagcaagaccccatctctacaaaaaaaaaaaagaaaaaaaggtaaaaattagccaggtgtggtggcacatgcctgtagtcctacctacttgggaggctgaggcagggggatcacttgagttgggaaagtcgaggctgcagaggtcgaggctgcagggagctgtgatcacatcactgcactctagcctgggcacagagcaagactgtctcaaaaaaaaaagaaaacactgatataaaaataggcagagactgttaaggaaggaggatgaaaggaaacttgaaaagattcaggaaggcatcatggtacagaataaccaatttaccagaacaaaacgtttgtaatgcactcgactagtatttatggccttttgtaactatctgaatttgtatctgtaaaaaactgagtggatctgttctaaattatagttatatatattgctcctaatattcctttaaactgcaaatttctcaaaataggaatgaaaagagaggttgaaatagaaatattttaggctaggcttggtttgtttgatgaaagagatcataaactggaagattatacttagataccagtagtggtataatgcttgaatagtctcatttgtagatcagtatcttatcacaaacccattgccgaaagtcccataatttcttgacaagatgtggaaatgtgagcttagattgtcttggagagaataaagttagtatatgcaaagtgctagcatgaagtctattccatagtaagtgtcccctctatgttagctataatatttaccttgcagagttgctgggaagattagcttttgtgtggaaagtgataaaatgtctagtatttagtagacacctaatgaatgtcaatatgatgaaatggctataactgatgctgcttactgatatgccggttttgcactgtacagctctaatgatgatgagtgggtaccactcacatcataatcatatatttgtatagtcacaagtttttttttggcagatggtagtaggtgattgggaaggggtgatttttatttatttgtacaaggacaccgatttaactaatagtgatgctgcaaatttatagtcttagtttgtattagtagatgtatagataattcctctattctttgtgattagataaaatgcatgctatttttgttatattcttatattctaagggacacattttaataggatgttggcaaactacagtgtctttagaggaaagcagtcagaattaatgtcaaataaaaaactattgaaagaatgcctttaatttacctgagatgagagtcactaggtttggggacttacaggttagctgacttcagatactggaggtgggggatacacatgtagaaggtaacctgttttgcccattttttttctaagagtaaaagataatagttcaggttatttatttgaagtctgtaacttgagtcatcctgtgactctagaaccggtagcagcatatattctagaaactacatctctatctgtgttggtgcttttggagagaactagaattggtggatggaagactttgtaagctgagttagttcaatataaagaaatatcattcgttggggccgggagtgggtgactcacgcctgtaattctagcactttgggaggctgaggtgggtggatcccctgaggtcaggagttcaagaccagcctggccaacatggtgaaaccccgtctctactaaaaatacaaaaattagccgggcctggtggtgggtgtctgtagtcccagctactcgggaggctgaggcaggagaatcacttgaacccgggaggcggaggttgcagtgagccgaaatcgcgccactgcgctccagcctgggcgacaagagcaaaactctgtctccaaaaaaaaaaaaaaaaaagcaatatcattagtttatgttgtccatgaccagcacactgtttcatgcagtagagtatgccctcttactgaaagtttcctggcagaggtttagagagaaccttttgtcaggaatttttagaggtagttcttatagagtgagtggttgacctcagacaaccctaaggcaccttctagtttggagattcttttattctaatactaggcaatatactccagcacatagaagaaggattttagttctcaacatatgtttctagcattgtgaagcatcagagaacaagaaagttgtctaaccagaatggctttacatcacagtgtagcaggacgagccacagtcaaaactcctcagacactggattaaagaaggaagaggctttatttggcttggagcatccaccaacttgcgtcttaagagccgagctccctcaaaaagaaattcttggcccttttaagggcttacaactctaaggggtccacctgaaaggatggtgatagatcaagcaagtgtggggaacgtgactgggggctacatgcattagcttacagagcagaaagttttgcaatgctttttcatacaatgtctggaaattacagataacacaagtagtttaggtcagggattgatattattattattattattattattattattattattattattttaactaccagggccgggtggtggcaccaggccatctggctatttatcttacttctgtttctttttaactttttgcttttttcttttcctcctgttttataaactaggcaaggggggcggggtgcgcaggagaagtggtggtcttcttccttaacagcatgcagtgcagttcttggtacctgcatgtaggtaaagatcaaactgtcaaactggtagtccttaagactctgcttccatgggtatgacttgttctaggtattattgcctaacagaaatttccattatctaattttaaattgtgtaaggtttcacagtgagattattcgaagcatttagaggtatttactaacctgtgatggcttacaaatctcttcttgttgcaataggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcaggttagtagagtaaaggaaggtgttcactcctattgcttctttgatcagtttctaaaaataattcctttaacatatcataatggtaaacaagttaataatagttatagactttttttttttttttttgagatggagtctcgctctgccgccaggctggagtatggtggtgcgatcttggctcgctgcaacttccgcctcccgggttcaagcaattctcctgcctcagcctcccgagtagctgggattacaggcgtgtgccaccaagcccagctaatttttgtgtttttaatagagacagggttttaccacattggccaggatggtctcgatctcttgacctcgtgattctcctgtctcggccccccaaagtgctgggatgacaggcgtgagccaccactcccagccaatagttacagactttatacgtttgtaatttgagtaattctgtgactccagaatcaacagcatgcataattcaaagcatcatatgttctagaaactgtatgtctgacttgggatgcatttcagtgcttcctaaatagcagattgacttccttggcttacttgaagttaattgatcttctctatatgccaccttagtaaacccaagccattacagcacacctcccctaattttcttacacattgtaggagcttgatcagtgtttgttgtaagaaataagatgcttccttaccctctgtcttgctatgtgtgatgtacaaaatcaatcattcatatgcaggtaattgaaaattcagaattcctttaaagtatacaaacatttgttggatacctagttagaggctattataggtgctatggcacccaaggtggaccaaaaggaggtaataatctaatgaaaaagataagatatatatatatatatatatatatatatatgatcagtttctgtgatatatcttatgtatcatatatacacacacaaatatatatatgatacatatatttaaagatgtcaatgatgtgatcattgctaaaggaaagagaatgacaatggacacagaagtcactaggccttgcatttgaacttgatgctgttcatcttgccgttgtgtatcttcacatccagaaaaagcagtgacttttttcctttggcagttatgtctgttgaacctaaaatattttcataaagaattctcaatattgtcttttgttctttttattttattttgtaacttttacctctgacctaagaaggcattagaacagattgaatagaaattggatacttccgttttttgcgttttctagaattttgaaggaaaaatatttttttcccagcatgtattctctcaaactttataacacaaagtcactataaatagtatcagtttcattgtgtttgtgcctctgttcctaaagacagtttttcttgtgttaagttttctgtcaggccaagatagagttttcttgtaaggatgttaagtgcttaacataaatatttggggttaggcctttatggttaagagagaacagaatatgcttcgaataacatttgacaaataccacaaagctgcttttctaattgagttttatattattaaatatcacttggaataaatgagttttacttatttcataggaaacaatgaaatccaatgtggattctttttatttctttttcttccctaattgccctggctagaatctccaatgttgaatagaagttataagaaatggatatctttgtcttattcctgattatagggggaaagcatctggcctttcaactttacatatgatgatagctgtggatttttttttttttttttttattgatcattcttgggtgtttctcgcagagggggatttggcccacaggacaatagtggagggaaggtcagcagacaaacaagtgaacaaaggtctctggttttcctaggcagaggaccctgcggccttctgcagtgtttgtgtccctgggtacttgagattagggagtggtgatgactcttaacaagcatgctgcctttcaagcatctgtttaacaaagcacatcttgcaccgcccttaatccatttaaccttgagtggacacagcacatgtttcagagagcacggggttgggggtaaggtcacagatcaacaggatcccaaggcagaagaatttttcttagtacaaaacaaaatgaaaagtctcccatgtctacttctttccacacagacacggcaaccatccgatttctcaatcccttccccacctttcccccctttctactccacaaaaccgccacggtcatcatggcccgttctccatgagctgctgggcacacctcccagacggggtggtggccgggcagaggggctcctcacttcccagtaggggcagccgggcagaggcgcccctcacctcccggacggggcggctggccgggcggggggctgacccccccacctccctccctcccggacggggcggctggccgggcggggggctgacccccccacctcccggacggggcggctggccgggcggggggctgaccccccacctccctcccagacggggtggctggccggccgggggctgacccccacctccctcccggacggggcggctggcctggtgggggctgacccccacctccctcccggatggcgtggttgccgggcggagacgctcctcacttcccagacagggtggctgccaggcggaggggctcctcacttctcagatggggtggctgccgggcggaggggctcctcacttagacggggcggttgccgggcagagggtctcctcacttctcagatggggcagccgggcagagacgctcctcacctcccagatggggtcgcggccgggcagaggcgctccccacatcccagatgatgggcggccgggcagagacgctcctcacctcctagacgggatggcggctgggaagaggcgcccctcacttcctagatgggatggcggccaggcagagacgctcctcactttccagactgggcagccaggcagaggggctccccacatcccagacgatgggtggccaggcagagacgctcctcacttcccagacggggtggcagccgggcagaggctgcaatctcggcactttgggaggccaaggcaggcggctgggaggtggaggttgtagcgagcagagatcacgccactgcactccagcctgggcactattgagcactgagtgaacaagactccgtccgcaatcccagcaccccgggaggccgaggctggcggatcactcgcggttaggagctggagaccagccaggccaacacagcgaaaccccgtctccaccaaaaaaatacgaaaaccagtcaggcgtggcggcgcgtgcctgcaatcgcaggcactcagcaggctgaggcaggagaatcaggcagggaggttgcagtgagccgagatggcagcagtacagtccagcttcagctaggcatcagagggagaccgtggggagagggggaggaggagggggagagggagagctgtggattttttatagattccctttgtcagattgagaaagttgccatctgttcctagtttgttcagtgtttttgtcatgaaagggtgttgtattttgtcaaatactttttctgttgactttttgtgttgaaatccacattggatttcattgtttcctaagaaataagtaaaactcatttattccaagtgatatttaataatattaaactcaattagaaaagcagctttgtggtatttgtcaaatgttattcgaagcatattctgttctctcttaaccataaaggcctaaccccaaatatttatctgttaataatttacacgagatgatcgtgtaaattttttttattctgttgatatgtgatatttgacaaaccttggcaaaagaatatccattggccaagaatttttttaatgacattaatttgtaaaataagataatttcatctcagtcaacagatgaaacatttagttagtagattaattgatgttatactgagttcctcccagttccatctgcattcaaaacccttaacttataaatgtgccgaatttgtcaagttttgaaaaacttgaaacctacacaaaagttaaaagaatagtacaatgaacatcctaaaaccccgtaccttgatagaccaatgttttacattttgtcaaacttgcttttgctcttgctaacagcctccaaaacaggctgttaatgtttttggttgttgttggttttttttttttaagtcattctttttattcaaagtgtggttcttggactagcaacatcagcttcaccagggaaatggttagaaatgcagaatctccggcagacctagacctgttgattcagaacttacattttattataacaagacgcccccatatgcattttaaagttttgggagtggtggtctactcctacctcttactctcctgaccaatcattcatctgtcttctccctaagtatgcagtcctcagcctgttttacattagaattacttgggatgctttttaaaagtgactactgatgcccaggccccacctccagcctttctggtttaattgatttgcttaggaacttaagcatgagtatgttaataaagcttcctaggttattccagcctgcaaccaaggttgagaaccacagcctccgatacttcctctgttaaggagcatactactttaggatagcgtattccatttttaaataactctaattgttataaatttctgtcttatattaaggacttaatgggatttctctaagtagcaattatctttaatatatttgaaaaccaattgactgtggttacacaacattatgaatgtatttaaataataccattgaactatacacttaaaaatggttacaatgatacattttgttatgtgtattttgccccaataaaaaaatagaaaaaaacccaattgactgtagtttttattcaaattgtaaacacatattagatataatatgctgtacttagatgcattttgtcctaccttagagccatatagtttatcatttttgatagattgccaacatttccatgtatttcgtgcttgttcttaattagtagatttatagagaaaattatttttcttttccttctctcttctagagttcttcagatgctatatatttggcaaggcatgttggtttgcgtgtgggaatcccaaaggagaccccagctctcacgattaataggctctgtggttctggttttcagtccattgtgaatggatgtcaggtatggacaacatttttttaaattctctgaaaatatgttaatagttactagaagaaatgtcccactgcaatataacactttagctttagggaggattgcttgagccctggaggtcaagtaaaccatgatcataccactgcactccagccatgggcaacagagtgagaccttggctccaaaaaaaagaaaaaaaaaaaaaagctaataatgaacctgaaagtggaataagcctgtcataaaaggacaaatactgtatgtttctacttctttgagatacctagcgtagtcaaattcatagagacagaaagtagaatggtgttcccagggactggtgagggaaagttagtgtttaatggatatggagtttcagttttgcaagatgaaaagcgttctggagatgggtgatggtaatggttgcatcacactatgaatacacttaaactactgagctgtatacttaaaaatggttaaaatggtaagtattatatatatatatatacttcaatatttttaaaagctagtatgttcatcattctttcgagtgcttcctacatgctaggcaccctgctagatttacattcaatatctcatttaatcttacaaccatcctatgaagcaagaactattattattattcccattttacaggcaaggaaactgattaaagccattaaggttactcagtcatagaatttgaacccaggtctgtgagtgttacctgtgaggcactgaataaagaccgtgaggcaagcaggaaatctcaagaatttaggagaggataaggaaatgtattttatttcaaaggaagtgaatgatgctgttagtagaagtacaaactagtttgacctttttaaaggacagttggttaaatacatttgtttctttgagcacagagaagaaagtgaaatccaatttcatttgtaaaagtcttcattttattacaaacaaaataagagccagaggcgtattttaataaaacaattttcacattaatttgtttctataacgatatatcttaaatagtgacctcggttttcctagtaataattttaagaaccatcaggttcatagaggctcattatttgctccttttctgagaaaggcaaacagtggaaagtgttggaagaatgaagtggtttcctttttatgagtcacctagattgaactagttcttgtaaatctctgttcttgttcagatacatccattaatgggataaatttttcttttgcctttttaaagggtatgtcctttattatctgctgtacatttatgccaggtattaatatctgttgattttcaagatttatattgtgttaagaattactattcttagccacatgtaggtagggcctgttactcaggcaaacatgattgaaaccttttagttttctcctcctacatcttggtaatggatactttagcatttgctttacagttactttaaaagcatttccttttgagacactgtaagctacagtacaatatttgtttgatttaccattaatttgtaaaatcagtgtgtttcttaatacattgtttgggtacggtaaaaggagtttttattactgtttgtttttaaataggaaatttgtgttaaagaagctgaagttgttttatgtggaggaaccgaaagcatgagccaagctccctactgtgtcagaaatgtgcgttttggaaccaagcttggatcagatatcaaggttggaaccataaaaatttaaaagaattagttcttattagcattatataagtacttttaataacatacctttttatgggagagaaaactaattttgaagccaatttcgttgatgaggattggcaagatatgaatgattagaagtttgtaaactatttcaaaactctattttggtggttagttttgacattttaacccatatgaaattagattctatctatctcagcagacctctagtagtataattatcctgtgtaagtggccataggcatgggagagatggaggaagggaagaagtggattaaaaagatagacaaaagagtgaattaatctcactactaaacaattagtaatctgagtaattaaatctttaacgtgacttatagaagttttatttctgggacagtctcagaatagatttcttcatcatcacagaaaacatctttgaatacagattatattgtcccaaatcaaacaaaaactgattcttttatctttgagagctacaacttgagaatgatggtacagtactgataaagaatgatgttttcttctcattcccatgtgaaagggctactgacattttatattttttagcattttctatagtaatgtttgactcacactgttcacccagtttctcacctggcctttttggaagttgaaaggaatgggacttaagagaatctatgcggattttagccaccaaacacatttgagatatcttttatgaagacaggtcagtgagttaaatgttgatgaggcagcaaagtggggcacacttaccagagactaactacttgaataataattaacaacctttctgtaactctgggaacctgtcccaagatcttttcagcctcatagtaaccgatagaaccagctattcctgtcactgaggcgcaggatgaaaaagaaaaacagataatactgtttattacagagctcagggctggtttacaaagatggctataagaaaacattgcatgaagactcattgtcaggttttctacaaaatatgaccttgaggatttaatttttgatcgtagggtaacttctgtgatctcaccatgcacgtctagtcctgttagctgttcttagacccccacatttagagagggacagagaatgtgtgcattttattttgtgacattgaatgttttcaaaaacattgcatgtttttaaaaaatatcccataactgaatatgaatagtggttatcagaaagtcttaattttacttttgtttattggaagtgttgattatttaaagaaattataacatattacttttaaaaggaaatgccttaacaagtcactttattaatgtcttttaatagctggaagattctttatgggtatcattaacagatcagcatgtccagctccccatggcaatgactgcagagaatcttgctgtaaaacacaaaataagcagagaagaatgtgacaaatatgccctgcagtcacagcagagatggaaagctggtgagtgaaactggaaagtatcagtatctatagaataaatatctataggaaatattttcatcatttctattatggttatataatatttacaaatcatacctttaagaattattacatcttttcattattcctttgtctttagatgatcagatattttattaattattgcaaaattaactaggaatttctcttttgaaaaagttagtactacttaaaaagtggtattgctacttgaccctagatggacccttgagttttgtgctgaactggtcctgttgtcagtagaacatgatgaggaatacgatacgttctgtcagaggtgatagctcactgtggcaactggaatatagaggatgtcctctcccacaagccatatcataatcataagaaggggtaatgtatttggaaaagacccactgggtcttttatgctttccttctgccactcctaattaagaatcattgtacctaactcagagacttagaactagtccgagactctagttagagtgccctggtgtagcacagcaggttgctatagagccggtccaaaacaggcaaatgtgacagcagttcttttagcagtgcagcaagttgaagaaatgtgatatttaaaaaattaaactgttaaagcaagtggaaactcttatttaggaatattaaatgcttgaagtaatgaggataaagtccatcttagcatttcagaaggataagtggaatagagctgatgccatctaactcgtgtgtttttttacttatatgttcatagtggaagaggattggtctagaagtcaagagttatcagttctgtttctacttctaccacgcacaagttatcaagctcagtcatatcatttattcactgaacctctgtaagatagagataacaatatttgccttccctatttatctaataaggttgttttaaaaccaaataagggcatataaggaaagtattttgccaattgtaaagtgatatgaaaattaaggttagtattattcctgaccctatttccaaagctatagattactacagtacattctagtcagtggaggtcaaagtaggtaagatgttttacttataattgtattagtgattgctcccataatttcttcaggttgcctatcactattaagtttcagttagattactttgtggcatagacaacttggtaactttttaattgcttatctcaccaaaagaagtttaaaaggggtattaagtccatttattgccattacatctatagcaaacagacagatgctgctaacagtcttagcagtacctggtgaaaaaaaattgtggttaaaaaaatataatttttaaaaatataatttttaaaagatgcaaaatgcatctacataaacacatgacagtatcgtaaatcctccaatacggaaggtaagttgtgtaagtaaatagtaaagactctataatttttaaaagatgcaaaatgcaactacataaacacatgatggtatcgtaaatcctccaatacggaaggtaagttgtgtaagtaaatagtaaagactcaggctgagcgtggtggctcatatctgtaatcccagcactttgggaggtcaaggagggtggatcacgaggtggtgagttcgaggctagcatggccaacatggagaaaccccatctctactaaaaatataaaaaaaattagccgggcatggtggtgggcacctataatcccagctactggggaggctgaggcaggagaatcacttgaacccgggaggcagaggttgcagtgagccgagactgtgccgttgcactccagcccaggcgacaatgtgagactccatctcaaaaattaataaagactcaatattaaagtagactgtgaggaaaaggtagatcagaaattaaattgaataatatgtttgatttattttcatgtttctctcttttattcttatgatagtctctctactatttttcagctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcggttggtatcaccacacagattagcttgaattcttcctggtgtgttcaacaaaagtaatcatgaagtatcttgtaaatactttttatgccagtctttagttgtttagcttaaactaatagtgttcatattcaattaatttaggttttcatagacccacacaaaatcttttcatatttatttatataatactcttctgatttcttaattttttcagaactaagaaatttcagaaacaaatctatctggcttattttggttttcaaacttttttttttctcatgcatacagtttatcgtatttcttcttacatctactcacatctagataaaagtttttccttgacacccttttccttgttctttagtaaagttgtattctgtgccttaaaaaatctccttcatccaccacagtaccacttttctaattgtatctcacactgtgcactggcttcctatgtactgccatattcctaatactactagtccattagttcaaactttgattaactggattattttagcctttagttaatctagtatttttattttcaagggtgtagctgatggtgctggagctgttatcatagctagtgaagatgctgttaagaaacataacttcacaccactggcaagaattgtgggctactttgtatctggatgtgatccctctatcatgggtattggtaagtttatagtaaaacaaactggttctataatatttctggaggtaagtcttctttggcattcagagtcctgaaaaagtggccaaaccaaggtcacctgtagagaaaagaagattggtaatcagtttaaataaaaaatctttatgaagaactgtcctagacacaatagaaaaaccaagaccgtgtaaactccatggaggaagtaatcatatcttagtgtccatttgagatttaaaaaatcaacacacagtaattatatcttattgttcctttgagagtttagaaatcaacacagaaaataacagaagaattacgtgatcctgacaagataaaagaaattatgagatgggagaaatcctggggtgaaacagagaaggctgtatggagaaggtggtatcgcagctccttgctggttgttttacacacattcagtcttcccacgtctccagtaagggagacttctttgtgaatgagaaaattgaggcttagggaggttgtcttacaaggttccaaatcagtaagtgacagccagggtgtgaatccaagtctctctgaaatcaagtgctctcttcactgtgagttaaacgcatagtctcaggaagtcaaattaatattcctcttgctcaggtgagtattagcaaaataaagacttataattagattggtaaaatgctagatggaaaaaatttggaagtccataaacatgtatagtcttggcttaaaatatttgatttagaagtagaacaaagagctttttgctggatgcactcctaggaaccacacacgatgctgaattttaatagttcctgtcattctctgggggaacagggaaccaattaggtgccttacttagaaaaataaaatttggtgctcagtaactttgatatatcccacctacatataacctcccactgtaaggaaaagcctgccctagggtatagatttcagattgtttagcccttttttgaataactaaattgttttctgaggtgggttccaagagaggaggaggaggataacctgttactgacctgccatctcagagatccttcagtgtaagcctacaggttctactcaaacaataccacttacactgacttgggattaatactcaaccatatttgctgccatgtccctcagagaagacatatctctgtatagagttcctaagaaaaaaagctggcatgttcatattttgtcatctttcactatgtgtctcaaatttatgtcagcaagaactgcaagatattttgacacatatgaaaagtcaatcttaagcttattagcttttggctatccactattggcaaaagataacttttgtcttagaaatggaaggtggtggaaaaattaaacatccgtatgttgttatggcatttattattttgatatctagggtagtggttcccaacctcagatgattgtcagaatccactcataacccccacacccttagattttgtttcagtaagtccagagtggagcccaagagcagagttggttttgttttttgtttttgacacagagtctcgctttgtcacccaggctggagtgcagtggcgtgatctcagctcactgcaacctcattcttcccagtagctgggattacaggtgcccgcccccacgcctggctaatttttgtatttttagcagagacagggtttttccacgttggccaggctgatctcaaactactgacctcaggtgatccgcccacctcagcctcccaaagtgctaggattacaggcgtgagccaccatgcccagcccaagagcagagttggtttttttcctgcatacacctagatgcttttgatgatcaaacaaatgtatgtgacatgggttggctattttatactcctttttcagtttaactttatttaataggttctggtagattagcatagccagtgaaccaagaaagcgttgttttccttccttctgttcctgggcctgaatatttgccctaaagtacaaagaatgctcctgtggtaggattgtcatttttcctcggggcttgaacagagctgtacattccagatgtcccacagtatcagctgcccccttcatctagaagtttggctgtcacttgtatatagtgatgggattaaacaaagtaactcgttgaagcatcccagatgaataagtggggagaataagttattaagtatctagtgggaactggtttgttaatctaacttacaagaatagtggttctcagttccatgattacctaatgactagcaatccttagccctgcagaatagctgcagaccaaaaaaaaacggggaaagccatgacttgaaaagaatagtactggttctgaggaaatacacagctatagaaagacagcactccctggaactcctcaggggtggcaatggtagaggttggtgggtggaactttgagcctcttcagctggagcagtctggcattatctattacttggcatcatatgcaaaaagaattctgatgcttaaagagaaaaaggtggaaaacccattcagagtgctattgatgagtagcttgttgcccagagagatgcacaaagtcgcacagctattagtgacaggaaccaggactagaaataaggtctccttttcctaacaagaatactaaaccttcctgaagtcccagtaaataacagtggtctgggaagagtcctttaaaaatcgagttatggcctagcatattgttacggtggattctgagttaaagtgaaagtacgagtcatgcttgctgtgttgtttatgcagacaaggaagtgtgtacagtggtctgaacattgtccaccttttatgtgtctgtcaccactgttggctacttcatcccctcaccaggctggataactgatgctttactactgactacccatctcattttcatgatttcatgctttagacatacaaagagaatctggaatcagatcctgtagtaaatcagtagctgtagtaaatcagtagccacatgaaactggcattttaaattgaagtgcattaactggatagtcctaatcaataagcacgtggtttgttgtccaaagagtattttaactacgtgacaaaataaatattatatttaggtttcattatgcctttcttgtaaagactgattttccattttataaggtaaaatgcttgtgaaacttgatgcagaatatttgactacttgaattcagcagaacatactacatatttttctttgtagacatttttggcagtttcattctttaagaacaagtcgagaagtagataatcttctctacccaaattttttaccttttgagaaaaaatatggatttaaattatgagcaatattaaactctcattacatcatcagaaatctgggagctaaagtttatttcagaagtcttattagatggagttgcatttcttaaattaggagttatgttttatttaaatttcctgcctacccttggagttgtaaacatcaccttacttcataaaaccttccctgaagtgcctcgtagtttcccatctctctgtgcccatgtggagatactgctatttcttgtcttttatccaaatgggcctgaaaattcagagtgtagccacagtaacttctgtgctgtgaatgcatatggcttggatcccaagtagagcactcagtctgccttgctctttgatatcaattataatctattaacataactaaaatcccatatatggactcctttggctgttttcaatcttaaagccgtttatggtagaacttttcatgtaattctcttatctgcagtttgaatgtataaacaacttttcaccttggttccattttatttttattattattttttttcttttttagagatggggtcttgctgtgttgcccaggaggctaaagtgatcctcccacttcagcctcccaaagtactgagattacaggcatgagccaccatgcctgggccctttttctgcctctttatggtcacttcatttaataggtacggtcaaggtagtaagatttgtggctactaataactgccgcattatttcttccttacttggaaagaaggagaagcttgatacgtaaatataagatgacatttatttctatatttttatagaagatttttattattatataggtcctgtccctgctatcagtggggcactgaagaaagcaggactgagtcttaaggacatggatttggtagaggtaagtgtttttttttttttttttttttttaacaacatgaataaaccatgtacttttatagcataaatgactttaatttggtctcattgctctttgaatttcattgtagttagcctttccaaatgatgtacatctaaataaatagtaccttcattagatgccttgtgttgatacttttccccacctggttaacatgctttatttatatttgaatattcaaactgcctgatttctcttactcaagtataaattcctgggaatttcttactactttataaaactgttacattttagactattaacatgcctgttgaatattaaagtgaaaaaatatatgtaaaataattgacataatagaaaagcaatatttagtgccaaatctacaagtttcttgcccttctcgccagatagagccccctcccttaaatgtatctttggcttttatacgatagttgtagcttgatttgggatgcacctatcataatttttgacactggaacttaaatttattgagtgatttctttttaaatgttagtattagaactaaagtgtcttaagcataattaaaagaagaggtggagaaacatttaaagatggttatatacattccacacttttggaatatttatttgaaaattttaggtgattaagcatgtgatgcctggcattgggaaataactaatagaacaaaggaaatctatttaacttgatagcgaaggggtaggcacaggtgtgatttcctctatgataatctctcacacaggaaaccatgatttcagacaaatggtttatctttaaatctcttccacttttagcagatcacagttcagagcctcaaagaggctgtttaatttattatatttgtgtcagcaaataggtaccactaaatttctcactttagacctcacatttaaaactattaaactatatcaactttgggaagttgttcataatcatttggaaatgtatacattctcaaggacataactcagaccatagttttcctaggttcaaaagcctagtttcactacctattctaggtctcttagtacctccttgaagatggctctgtatatagagtagaaagataatggtggatctaagcacatatgaggcaccatcttgagagaccacaaagtatagtaggaaagagcacaagactgaattttatcccaactctgcaaaagttacctttcttagaatgagtttccttatctataaaattcctgaattaagatcatatgataatacagtactgtaaacttgaagtaaggtaattgccagtttgtgtaagtataacataatatacttttcagttctgccacatttcaacatagtaactgttccctttatgtacgtggctttgaaggtttattctttgttgtgtgtcagcttcttggaaggatagctcctagtactgcataataataataatacttgcaaccacttattgagtacttgccatgtttcaggtaacacactggacacttaatactcatgattttatctaactgtgacagtgactcttagcatgataccacagtcacattttcacacgcggaaacgtgaatttaaagagtttaaagaatatgcataaggtcacaccctaacaaatggtatagccaatatttgaaccatccatccagttctaaaacctgtgggctttctacagtatcccactgtgtctggtatgtgtcaatttatgggattactgagaattgcctctaagggatgcatttgactaaaagtattatttagtaaatatacacattttaaacctgatagctttatgcagaatgattgtagataaaataactttgcgaggtaatttaaataggaagaaacagcagacttagctgttgataggactggaccattctcatttaaaaattagtttgtgagtaaggatttttgttagtgctctaatttttgttttaaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggtatttgctagaaatagctgcatttcagatttgctgttttttatagaaatgcatggatttaggcttccccagaacactccaacatttttcattcttcttcatgtctcctgcactggctgttaccaggaacaagttacttgggcagtgcttttcatctggtctcatagatgagtcagtcaccttgttagtggctttgcacttaagaaccaagctcttcctctgtgtgtccagtctctgtgcactgtgtgccccactcagcttgtgttcactgcatgagcagataatgaggccctgcttctcatggcacttgtattttagtgccagttacaggagtaaaataaatctattttagaaaaaaaaagtactgagtgagtactgatctagatgccataatttatgaaatctaagcaaactgacatttgggtctaagtttttcttttcactgcttgcagggttccaggaggaaccttttgggtgtttggtgcttttcagttttgatagatagtaccagaaggaggagctcttctatttttggaatattttgctctgtagaaaaattgcaaacaaaaccaagtaagtcaggctgaaaaattactctgactccctgttaggccaggggaaatgtgactcttatttcacttaatgattccctgagttgaaataggtgattgccacatacaaaagtaattcctggataattttctcgaagtcatcatattaggagtgaggagtactttaaaagagtctaatttttatgaaagggacatggatagtttctaaattatctgccctttcatagggacaaactttattaattacatttcttctaaggtgccatgaggctctcacactatataaatcaaatatataaatcaaaggagcttaatgttcatccccttccccagcttcccatttatccagttacctcctcttctcactcctttcccgtaacacacacaagcttctgtatgtgtttcatataccctaaatctactctataaccctaaatccactcatctcctttttagtttgcctccctcttctggtgtttgtttttgttctttgttttttgttttttttgattaaaaactttcagctttccaaagtctgttgcctgttgtaattataccaaaattgaggactggggaaaagattgagcagatgagctgaataaggatgagtaatgcagatgtgatgttattagttctatttcattaatctgattttttattagagtagatttcagtcactgctttctttttcaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 36044 - DNA, 50534 bp, Homo sapiens
cgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgaggtgagcgcgggccggggacccggggcgctgggaagctcctgcccgcccgaccctgcagcgcggcgctgggctcggccggctcccctggcgtgtccgtcggtggccgagctctgggcgcacaggtggaatttcctgttcagcgggtgccgggccgcgggcgggcggggctggccggacctttggtaccggaccggctgcgccccgccagggggaggcgggaagcccctgggccttcctgcgccctcggtcctttctttccctgagttgaaaaaaggggctccgtctcggcccctccatgactctcgcgctgttagtgaacatctggaagaaaccaggggcttggagtggggttatttgggaggaagtgaaatttcaggagggtttggagtctcagccatccttggcctctgcagaaagtttctttcgtctctctccttccccgtcaaaaggcgctttgggacctcgcagaggacaactgggaggccagggctttggctgccatacgggctggagctaagaactccagagttgggcttgcctgggcttctcgagaggggatggagccctttgggaaggcggctgtatgggaagggatgtgggaacacacatgtcttgagccttttgcgaagtaccgaaacaggaagctcttctttggcagaaagaacaatgaaagacctattgaaagatctcaaaaagattacatgttcctgtatggagttggggatgggtcgctagtcacttcattgacggacccacctaggtggtagtgcccgggcgggaccagcagccaggtctctaccctctctgtccaaggcagacccccaggtttcctggaaggccagggcataccaggtcagggcggcgctgagaggcaggggctgtgtggcagagagttttgctcctctgcaaatgatggcctccctgccctgccaaccctcactttctcccctccttccgggtgcccctgggctccatagtctccgccgttgctccctaagtcaggcctgattttggtgctgtctcagatcaattccttttgtccaagcagcatcccgacctagggagcttgcagaaaatcagacgctggggctttggaggctgcctgcaccacagacaggacctggggctgggctctgctattttctccacttttcaccctcagcaaggaggaaagcttccagtggacctgaaggcttgggcccttcccctggctgtgcctgtgccctgctgtgaggcagattcaccttctcttccttgctgtaattgctatgtttgtgtccttgctaattgcctacttggggttctagactccctgcctcttcagcagagaacctgctgtttggaatttgttatttcagggcagtccggtgcccccaccccaagtttgttctccctgacttccctttctaggactctcctgcccacacggggaaagcagggtcttcctggtcgtgtggtccagcctcctctctgagccatctcaccacctgacaagcagccaggctggggctcaccttccactcacccccaggatcccacattcagcggacttgtcttgtcacctgcaagccctggctttagtttcccccatccctgctcatttcctcctcctctgcgaagctcatttgctctctgcgcccttgggctgttccttccccctctgccattttcattctcttggcttgctctttgtcttttctcctgccgagctttattgaactaactcagtacctagtcccatgggtgaagggaaggctctcagagaccagtaagatgtggttgtttcctttaaagaacatccagtcttgagagcgaaactaagagacgaatgccaaagttagctgtgaggcggagtgtccagaggaaattggccaaagctcatttccatgtcttgcagattcctcccatccctggcctcaccagaaatcccagtccctgggatcaccctgtagtgtgtgtttgcagctaggatgtccatccccggccgggaggtgtggctgctgcccctgggtttattatctgggtcagcagagcctggcccacagggtgctgttgtttctgggttccttgtccccagttgcatccatccgtgcacccttgtttggtggtatttgtatctggctgtccccttcccaaggctggtggtgtggcccctgccccacccctgctgttcccatcaagtgttctgcgtggccttcagagtcctgatgcacgttactgcatctggggatggtgtgagccctgcctgcaagcaagcagggaaacagatgccacttcttatggccattaatgagagccagggagcctgcctccctgagggtcttgattcctgttgagtatttgatggtgaatatgaagctgccttgacatccactggttccttttccgatcacaattgccctaggtaagactcagcatcccttaggcatccagagaccaagtttggaaaaatcggatgttgtgtggccaaaatcagatgtctaggggccagggtgtacacctctggctattcagagggtcacctgcttgttaatttgtcaaccattcaggcattcattcacataacaatatctgctaggtaacccactgactgagcctgtgccaggtgctgggaaatagcagtgaggaagaccctagactcacagcccctgtccttgggaccacccaaggtagtgtggggtacagggaactgaattctgactcatgagtactagcttctcgatatgcactgggtgagcacatggcatctctctaacccaggctggaagggccaggtcagcaaattagggctgcaggcatctgtgatgtggtggcaggaggtaacatgcagccaagacccggggccgccttgtctagccacgtgatctcagagatgttactcaatatctctaagccttggtttctgtggctataaaatggtgatgacatatatgttccaggtttgttgaaaggattaagaggggtactttacatgaaagccctttgtaagttgcagtgtggtgttcaaatgatgcagcttgagtttttgagttgaaagggacttgagacaagcaagaagatcgtatagtatcagtaggtcgcctgtcgagaggctgagaacccaggctgtcagtggggccctgacctcacagaggagccatcctgccctgccaaacacagggaagtgcccccaggattcaaggaactgctcgccagcaacagagacctcttcctaagaccttctgattttcattcccctgctttacccagcttctaggagaaatatctttctatgaaaagaaaatgtgtgccagctgcatatccctttctccttctcatcccctgcccctcccaccatagaaaattaaacttttattttgttttgttttttagacatgggggtcttgctatgttgcccaggctggactcaaactcttgggcccaggtgatcgatcctccttgtctcagacttctaagtagttgggattacaggcgtgagccactgtgcccacataaaactttagagaactgccttttttgttctctagagcatgtgctgggcaggtgtgtgcagtgggtgaggaagagggttgggaaggcagaaagcagcaggaagctaggattgtcctgtaggtggggcttcagctgctggagtggaccggaaatctgccttctccaggggctttctggagccttccctctgccttggtcctgagaacacctggaaattcctcgtttaggagttgagaaaactgaggaagaggagaagatgcccctagtttgatggctgccttcgcctgctagcagtggaaatggtcagagggtggacctgctcgagccgacttgctggcctgttgccacgttgtcaccggctgcggaaggagaacgagtcacagctccctccccctacctgaccctcactctgctccctgggaaccagactaccagactgcctactgctgtggccagtggcttctgtccctcggaacactgtggccctcaagttccctgatgtctgctccttctctggtctgtggttctgccaaggctggtggctcatgtctcttttaaaagagaagttgtctttggaagaggaagggaaacgtgacagagtcccctgggagcccaggtcctgaagatgatgttgcttctgatattgtgcaatgattactggagtgtctagaatactaataatgatgaacactaataatcgttagcatttattgagcatggctggctgcttgtcttttttcctgccaagcttcattgaactaactgtgtacctagtcctgggtcaggcatggctgaagggaagtaagatgtggtcttactagtctttgagaccaagtattacccttctcagagacaagtgttgttattactgtttttttttttttttagacagggtctccctctgtcacccaggctggagtgcaatggtgcaatcatggctcactgccactttgacctcccggctcaagcaatcctcctgcctcagctttctcagtagctgggactacaggtgggcaccagcacgcctgactaatttttgtattttttgtagaggcagggtcttgctatgttgcccaagctggtcttgaactcctgggctcaagtgatctgcccacctcagcctccaaaagtgctgggactacaagtgtgagcccccacacccagccttattattattattattattattattattattattttgagatggagtttcgctctttttgcccagctggagtgcaatggtgtgatctcagctcaccacaacctccgcctcctggattcaagcgattctcctgcctcagcctcccgagtagctgggattacaggcatgcaccaccatgcacggctaatgttgtatttttagtagagatggggtttctccatgttggtcaggctggtctcaaactcctgagatcaggtgatctgcccacctcggcctcccaaagtgctgggattacaggtgtgagccaccacgcccggcccagccttattgttattacctttttataggtgaggaaaatggagcacatggaggctaagtaacttgcctgaggtcgcagagcaaaatagtggcggaatctagattggagcccaggtagtctggccctgtcatatcctatgtgggctgtgacatgcggaacagggctgtcagcccacagggttcaggaggggatggaatactaaaggttgacaattcatcagatttgggtaagaaactggatttctcttctcaggttgtttctgagatgcctgggactaaattatagaaaccatttggtaggatgggaatagaaacttacagaattctcagagttcttagcctggcctggttggcagtggtgagaagtgtgtttggggtttgctcagagctcatgggtagtagttgccctttttgctttgttaagaatctttccagaagcagctccctgctaaaaattctgtctcagatgctcatattttcaaaatttccctattctgcctggacttagcaatattttgggattttcccccgaatcctgtgatagttggctaactgatcaaaatcttggatcctttgactctttttggcccacgttggtgatgctgaggtggtggtggggatgatgatggtggtggcgatgttgaaagggtggagaagaatgtgatgacagttatttctacctttcactaaatatctgcacttcaattcctgacctcactttatcctcacaacagctgtgtgggggaaagaatgcccagttcacagacgagaatactgaggctcaaagggtttgtgtaaaggcagtaagaagtagagtaagaattcaaactcagatctacgcaacttcagagcctgggagctcaccaccatgccattataaaattgtgttcctgagatgatggtgaaggttgcatatccccagcaaactgctagaacatgttattcaccagagagctgtgagcacataagaaggaagtggtgatcacccggtgccagtgctggtgtgctacaaacatcatagaccagcttgtctggtttccccttttgatgaggttccttagctggtggaccaggagcacagctggagttgtgatttcaacatgctttacatagacacagctttatgtattatacatatgattaaaaattatggcggaagttttaaaatgaaaaccaattcacccacctctgccaacaaatcacttttcacgcctctttcccctccttgctgtctatggttcaatgtgtctagttggttgttgtgcacacaccacttgtatcctggacaaggtgttttattggcctcctgtctgctgggtgtggagccctgggtgttggaggatcgaagttctggtaggcttgtgtctgattgaaaggctgtgcctaagggggggtctgttcttgaatccacgtcactttgggtggtgacctcaggctgctcgtcaccccttcctgggttctgtgccatttcttatttagtaacagctcagatgaggacttggggcatttgcctaccagctccacagatgacaccagctgggagggaaaggctgataccttgtatgacttgattatgagtcagagcatctggacagactgtctgataggctgcgctgagcagaatgcatccgtctgggtcaggagtcagtgctttgctcactgaaccacctccctcaaccatggagcagaaaccacgagacccagagttctgagttgacagtgagcccaggagagatcaggcatggaagtgtgactgcccaaagtcgaagtgtgctttcttccccctatgtttttatttggttataccttttaaagttattattaaaagtctaatatatacatatttaaagaaaacttagccaactcagataagtagtaagaatttaaaaatgaggccgggtgcggtggttcatgcctgtaatcccagcactttgagaggccagggccgatggatcacttgaggtcaggagttcaagactagcctggccaacatggtgaaaccccatctccactaaaaatccaaaaattagccaggcatggcggtgggcacctgtaatcctagctactcaggagactgagagaggagaatcacttgaacctgggaggtggaggttgcagtgagccgagatcgtgccattgcactccagcctgggtgacagagcgagactctgtctcaaaaaaaattttttttaataaaaatgacacaaatacccctacaaagacattttaacaatttggtattgcctatgcatgttttctaaaaaaatttttttcctcattaccacatttaggaagcttttctttttgaagtcacacaatatagaaatgtacagtgtaaaatgtgaaacttctgaaattccctctcccagattttagagcctctataaatagttttgtttatattctcccacaagtcttgtgtgtgtgttctgctgtttgtgtgcacacctattctcctccaaatggaatcatcactaattccactctgcagtaaagatatgattttattaatgaacttatcaaacatttattagatatcatacctcatgctagatttgtggagcaagacagacccccttccctcccctatcacaggagtctgggagggaggtgttggagagggatctcccagaattactccaaggagatgcctgagctgaatttcgaagggcaggagtgactattttttttttttctgagatagggtcttgctctgtcgcctaggctggagtgcagtggcgcgatctcggctcactgcaacctctgcctcccgggtttgagcaattctcctgcctcagccttccaagcagctggaattacaggtgtgcgccactgcgccaggctaatttttgtatttttagtagagatggcggtttcaccatatgggccaggctggtcttgaatcctggcctcgagtggtctacctgccttgaactcccaaagtgctgggattgcaggcatgagccaccgtgcccagcctatttttttcatttaacattctatcttagatagcttttccatgtcattatctactttttgaaaaacgatttttgattgccttataagctttcatcgagggaacatatcattctttccatcttcttattttaatcgttttattgtttgggtgtgttacttgaatgcatcattggacaattaatagaaaaagagcaaacagaatgaggaaggtaattggcaagcagaccctgtggaggccacgctagtcagacctcttgtgggttatgctggtgaattctggaaacggtgtcttcaagggaagatgactaagggtgagatggaaccagatggccagggtttagaaaacattttgtttgaatgatcagaggagttgagcatgtttagccagaggaggtgcagactgagagagcacacgagcaccgatgtagagcttccactggagcgtctcctgagtggggaaactaggctggttctgttgcagtgctaattagtgcagaggtgattgcagtgctgatcacacttggtggaaggaagagcttcctaatactcgtactaaggaaaatgctatttcttccaaaaggatggtctcgcgaggatgagaggtgggtgacatgccctgcagaatctgtctcggctctgagaatccaatttcaagggtagatccagcagttctcccctcgcttgtatcctattcccccaggatagagtctggttctaatagaggacacagacttcctggtgccctcccctgggggtggggcccctctgtttgcatagttggtcctttccccaaaacaggtgctcagatttgtagccatggaagcgtgttttagaacttacccagttctagaggctgcaggcaggcttgggtttttcccactagcttctgcagatccctgggtccaccaagtcagaaacagactgtggcacctccatgccatgaaatatgactcagcactgaaaaggaacaagctgatggatgcaacaacttgaaagacctccagggaattttgtgcagttaaaaaaaaagccaacagtcccatacataccatattatttatttatataatataatgggttttttttttttttttttttttgagacagagtcctgctctgtcccaggctggagtacagcggtgtgatctgggctcactgcaacctccgcctccctggttcaagcgattctcctgcctcagcctcccgagtagctgggactacaggtgtgtgccaccacacccagctaatttttgtatttttagtagagacagggtttcgccatgttggccagactggtcttgaaatcctgacctcaggtgatccacccgccttggccttccaaagtgctgggattacaggcatgagccaccacgcctggcctatataacataatttttgaaatgacaccatgttagtagtagaggacagattagcgattgtggagctgaaggggtgggggacaggagggaggtggctgtggttacagaaggccatgggcatcctcgtgttggagctgttcagaatgttgactgtgatgccagagacaggggactacgctagcgatgacatagatggaacttaatacttaacgtgagtagcggtgaaacgggaagtctgaataagatccgcggatgatactgctgttgtggtattatgatacagttttatgaggtgtgactattgggagaaactgggcaaggatctcagtatgatttcctacaactgtatgggaatctacaagtatctccataaaaatgtcagtaatgaaaggcacactagctcgtgaaatcagaatgtggatttaataaaaagtcaagaaaacgaatgaaaagaagttactaggtgctggctgcacctcttgtttctcttgtcgggttttgggggatctgcctgtttgtgctgctgcaggcagatgcttctgctctgagtccggtgacttggggcaggaggaaggtggggcagctgggccgggaagtaggtctttggcacataaggagagggctggtgcaaactaaatgggatcgaagaggcagagatggaattttccggctagaattggcaaaagaggttatgtcctggtgtgtgtgttttgggggcgacacactgaactgaggaccaggagagatccggcaaagtcgaactttaaatggggcctgaggacagtgggtggccaggccaggtctgaccccagagagcctgggggactgtcagcagagccctgaggtgtggactgagtattttttccccttcttggttgagggcacttggcaactggcagattattccagcctgccctggggaggctgcctaagtctggctatggggagagaagaccttccatcaacccatcaattagtcaatcaagtgctaactctgggcaaggttgagggtggagggggagggagagaggcagtaggaagaggaaaccggggcactgtgaccagccaggacttcctggtccacccagcatggtgcaggttggggaagaggtgaggccccagggagaaagtacggtggcttgttgtggtcccgggaggattcctggcaaggctcagctttggcctgtgtgctggagggcaggcaggttcggtaggcggtaggggagcccagccattccgagcaggcagatgggttcctaaccgagaggttaggaacctcttggttcctaacaggcttgggggcctttctggctagagccaacgtcagagttgagggagccagtgcccttagaccaatgttaaaggagtgacgacccatatacagtggtgggcacagcaggggcccgtctcttgggcccaagaagtgggttttgtagtagatagagttttgcagagtgttccttttttttttgtttttgaaatcaacactgtatttattgatttagactactttattgaggtatgattgatatgcaaaaagctgtacctttttgtgacattacagacaggggcctgtgctagcaatgacatagaatggaacttaatattcacatgagtagcagtgaaacgggaaatctgaataagatccacagatgatactgctgttgtgcttatcacgaatgacagcaagatagtgtcaattaagacagccatttcaagctactgacatcctgctcttttctcttgttttttgtttcttttgtttctatttaatgtgtacaacctgatgagtgtggatgtatggaaacaccagtgataccatcccataagttaggctgcaaaatatccatcaccttccaaagtttcctcctgccctctttatctattattctatttatttataataataattactattttgtgataagaacacttaatacaagatctcttattgaaggtatggaccaccttttgtgtatccattcatttgctaaggaaaatgcttagtttgttcccacatcttggcttctgtgaacagtgctgcagtgagcataggatgcagctctctcttcagatcctggtttcaattccttcctttggataaatactcagaagtgggctcgctggatctgcagagcatgatctctctgggcttcagttcgcttttctgcaatattgggggggtctcttgagtggtgcaagatcaaagataaccaggtccccgcacgtttgtgtctttccacaaggtcagacttttattgatgcaatttcaatcataaacaccactagccacatggagttcccaaaaagacaattctccttagtacttcctgttcactcaggaggcagagcctcgggcacacaggctgaagccactccacaagtcagtcaacattgcaagccatacataatcatatacttaatatataaatgtatagattaaacatcccacatcaaagtaacatttatcatcaagagaaaggggttaggaaaaagggttaatgaaccagtccagggagagccacgaagacaacaagaccctcctgccctggcctgggcagtctgtcggtttcgtggggaagagtttctgatgttggcagaggcttcgctggcagatgctaggtgcttatcatgagtgacagcaagatagtgtcaattaagacagccatttcaagctgctgaagtcttgctcttttctcttgttttgtttttttgtttcttttggttgcttttttttttgagacagggtctcgctctgttgcccaagctggagtgcagtggcgtgatcacagctcactgcagccttgacatcccaggctcaagtgatcctcccacctcagcccgctgagtagctgtgccaccatgctaagctaatttttttaaaaaatttttgtagagatgggggtctctctgcattgcccaggcttgtctcaaactccagggctcaagcaatcctcccacctcagcctgccaaagtgctgggattccaggcatgagccactgtgcctggctgtcttcttttttttttttttttttttttttgagacagagtctcagtctgccacccaggctggagtgcagtggtgcgatctcggctcactgcaagctctgcctcccaggttcacgcctttctcctgcctcagcctccccagtagctgggactacaggtgcccaccaccatacccggctaattttttgtatttttagtagagacggggtttcaccgtgttagccaggatggtcttgatctcctaatctcgtgatccgcccgcctcagcctcccaaagtgctgggactacaggcgtgaaccaccgcgcccggccattgctgtcctcttcctatggccacagagtcctctactgaggacagacagtggaggagtgtgtatgtccttgtctggctggatgccgtgtttatttatttgcaaaacatcttgtccctgttgacaaagtgaaacataagatgaggtctttttctaggatggagttatttatgtcaagggtgctgtgtacgagcctcacgcatctgcagtgggaccctataggagggcaaagaaccagcttcagtgaggactgcctgacacaactctcttctttcctttctggggagctggtgcaggggagggtgtggcgtcaccacgcgagtggtcaggactgagagccctgagctgctggggcaaatacttttctctgtgcctcagttttccccctcttaaaagtgggttaataaccacttacggccttccaaatagaacataattagctaattcctgctaatgactgaggcctacctactgtctctctttgattttaatttctccacccactgtttatccatctgccaaaagccaggcagcccaattcctccctctggtctggtggagcagctgaagttcagattcaaacttcaaaacaaactgaaaggctgggcgcggtggctcatgcctgtaatcccagtactttgggaggccgaggagagcagatcacctgaggtcaggagtcgagaccagcctggccaaatggcgaaatcctgtctctgctaaaaatacaaaaattagccaggtgtggtggcgggcgcctgtagtcccagctactcgggaggctgaggcaggagaatcactagaacctgggaggcggaggttgtggtgagctaagatggtgccactgcactccagactgcgtgacagagcgagactctgtctcaaaaaaaaaaaaaaaatcaaacaccctccaacaaaaaaaatgaaagaccttaacagcacaagtctgtagtgtgggccttagtgaggagcgacctggcaggtctttccaggatcccaggagccaatccttggctggcccacatctacccgcccttgtcactctgtcccgacccatggctccaggagggctctgctgctgtcccgcttctctgtaacccctctgtccactttctctgggagagagcagaaggccagccagggtgtccctacccacttgcacccatgggtggtttaccccacaagaccagagagtgctggccaggtcgcagcatgctctgggcctcagcttacacataaagcttctggtagtttccaaaaacattttttaagacaatgaaaaccttgtttcaaatactttttttgcagagcctgaaaataatgaaacaattggcttgaagcaggagcaggacacagagggcctctggatcattctttaagacaagttagggattcaaaaccacggacagacccacagcagcaggaggagggagtctgcccacaggctgcagccccaggagctgcttttccacctctgaggtctcccaagggattgtcccatccctcctcctgggggcccacagccaggtgagggaggcggtggccacagcaaatacactcattatttttggacatctttgtgccatgtaggtgtcttcaagaaatatcacgtccaattcttacagccgctaggcttcattttcagatgaaaaaagggttaagagaggaaaatttatcaaaaacccagatagctgaaagtgtggcagagctgaattttgaacccaaatctatctgactccaaatccagtgttgctctcctgggccctctgctgcttctcctgggggtgaggtgtgtgggtgtggggtgggggtgggggtggcagttattaccaactccccgtatagagccacccttgacataagtaactccatcttagaaaaagacttcatcttccatttcatagggcactttgcccacaaggacaaggtgttttgcttgataaatttaaagactgcaaacaaacagacaagcatcctcctccactgtcagtcctcaccagaggactctgtggccataaaaagagcaggactttggcagttcaccctctgctgtcactggtgataagcacccaacatccactgccaaaggctctgcccacattacagactcttccctgaaagactgatgaaccagccagcctagcccagcccagactttttttgtcttcgtggctctccctggactggttcattagccctttttcctatcccctttctcttggtatgtttttcaggttttgccataaatgttaccttatgggtacctgataattacgcgtctagtatatcttgcatggctctgcatgccgagagagcattcatgtaggagaactgcaggttaggtggtactcctaacagaagtgttctctgaatttcatttatgactggaatttcaagcggaatggcaaattcattatatctatcacgtgccatccctaagatagctgattttcttggattcgtttgtccttgtgttagattttttcaagtccgtctccagattttgttgggtctgaatatgggtggacagatctccaggctgatgtgatccagtcccagagggctagaacatatcttggctgattggtgggtttttttttgtttttttgtttttgaaatggaatatcactcttttcttttcttttcctctctctctttctctctctctctttctttttgtttttgagatggagttttgttcttgttgcccaggctggagtgcaatggcgcaatctcggctcatcccaacctccgtctcccaggttcaagtgattctcccacctcagcctcccgagtagctgggattacaggcatgtgccaccatgcccggctaattttttgtatttttagtagagacggggtttctccatgttggtcaggctggtctcaaactcctgacctcaggtgatctgcccaccttggcctcccaaaatgctggtgggattacaggcgtgagccaccacacctggcctggagtctcactctttcttgcccaggctggagtgcaatggtgcgatctcggctcactgcaacctccaccccctgggttcaagcgattctcctgtctcagcctcccgagtagctgggactacaggcgtgtgccaccacatccagctaattttgtatttttagtagagacggagtttcatcatgttggccaggctggtttcaaactcctgacctcaggtgatccacctgcctcagcctcccaaagtactgaaattacaggcgtgagccaccacatccagccttggctgatttgtggttctaatggtttatggtttggtagttttataatagctcatgacagtttcctgctcgtgtagggatgcaatgcgtttctgtgcctgatagtgccgtggtgtctgctgcattctcccacagatgtaggggccagtctgcatctgtgctctgtctttggcaaaaatctgttctcagtttcagtaactctgctgtggtgtagtctccgtcctcactggtgtcctgaggactgtgattctcatagttatcattggtacctctttttctagttattataggtcttgctgtatatacccaccccaagggtcattgtaatgtcctaagttctctgcagggggttcccttggtcccaggggttcctccttaaaagttacccctgacagggatttacttttccttttttttttttctttttcttttctttttcttttttcagacagagtctcgctgtgttgcccaggctggagtgccgtggcgcaatctcggctcactgcaagctccacttcccgggttcacaccgttctcctgcctcagcctcccgagtagctgggactacaggtgcccaccaccacacccagctaattttttgtatttttagtagagatggggtttcaccctgttagccaggatagtctcgatctcctgacctcatgatccgcctgcctcggcctcccaaagtgctgggattacaggcttgagccaccgcacccgacctacttttccttaaaattccttgagctggctctttgcctgtctggcgatctgtgagatactttgcattaaaagtacagggattttttcttttagggcttaacttttttttttttttttttttttttttttgagacggagtctcactctgtcacccaggctggagtgcagtggcatgatctcggttcactgcaacctctgcctcctgggttctagtgattctcctgcttcagcctcctgagtagctgggactacaggcccatactaccgcacctggctaattttttgtatttttagtagggatgggatttcaccgtgttagccaagatgatctcgatctcctgacctcgtgatccacctgccttggcctcccagagtgctgggattacaggcatgagccaccgtgcctggcggggcttaacatttttagggtcctcaagtctgactgtacatcctcagggggtcatacagggagtctttctgacttccaactctatttgggcaatggttcgatttcccaccttagccaaccggatgagtaggggttatgcaataattggcttcctcttctttcagccgagttaaaaatttgtttttaggccgggcgcggtggctcacgcctgtaatcccagcactttgggaggctgaggtgggcagatcacgagttcaagagatcaagaccatcctggcaaacatggtgaaaccctgtctgtactaaaaatacaaaaattagccaggtgcggtggcaggtgcctgtaatcccagctactcgggaggctgaggcaggagaaccgcttgaacctgggaggtggaggttgtggtgagccgatatggcgccattgcactccagcctgggcgacaagagcgaaactccgtctcaaaaacaaaaaatttttttgttttgccaactgccatctcctaagttgagaccatgcttgctatgagcctttctggccccactagcttcctagcctggcatcagccgagaccttgtcagctcttggagctacaggacctgggtaaagaacctcatcacctgaggttttcctcagggagctagactttcaaggtgaagtgagatgacgtctctttttgaagagggtggcagtttgttttttcaaacggcttgatttctaatttaagttttagtggaggctttcgccttagcatcgactataccacctatgcccagtaagctgactgtgccaattctcatgagcggtgcgaggtcctaaccgggtccatgcacctttgtgtctttccacaaggtcagacttattgatgtgacttcaatcacacaaggcgcgagccgcatggagttcccaaagagacagctctccttagtacttcctgttcactccgtagtcagagcctcaggcacacaggctcaaaccactccagtcaatattgcaaactatacataataatattcttaaccaatatataaaagtataaacattccacatcaaagtaacatttaacatcaagagaaaggggataggaaaaagggtttaacaaaccagtccaggaagagccacgaagataaaaagagtctcctggtgtgagctgggtcatttgtcggtcttgccgggaagagtttctgatgttggcagagccttcgttggcagatgctgggtgcttatcacgaatgacagcaaaatggtgtcagtgaagagggcatcttgaggtgccgaagtcctgctctttttaagatgaagtctttttctaagatggcgttacttatgtcaagggtgctctgtacaaggctcctggtcccttgggctgcgtggggagggccctgggcagtgctgggagttgggacgggacttgaaacctgcaggagctggctgctccctggcagagaaccgctgggtttctgtgttgacaacgtcctcacagctgggctgagtcaggtcctgggggactttccttcaggctgtaaccaggtgtggggacttgtggtttacttccttcagtgggagttcttggccgtgggtcagctttgtgttcccctgatgggctggggttacagatctacagatatttctggatcttccttggggccctgcagccccacctgttttccagcagctccttctggcggggcggctgagggcggcgacgggtcaaagggaaaggtgggcgggccggggttttggggtgtctgccagcagctggctgggtctgcagctggccctgtgctctcccaggaggagctggagtgtgtatttctgggaaaagtgatagcctcagggacttctgggatgatgcttataaccaattgtgggagggtccccagggcgtggaagcaaagttcgacctggcacagcagcttcccttcatcccaggtggttgctcaaaatagaccagctgagactctaagccagcttctcctcctggtgacaggaaggggtgagcctcctggaaatggtgggtggagtttctccaactttcaggttcccaagaatgacctggagcacttgaataaaaacttccacatccgaggccctgctcctgatgcatgacatcagcacctccagggagaggggcttgggaatctggatgtggaacaaacactgcatttgtttcagttgattgttattgttctttttcatgaccagacaagtccaggaaatgctgggggttgcgatcaatgggaaccataggcttttgcaggtttcgtgaaaattggcttctagagagatcgattacccctggttggggagtgggtgggaggattccagtgtggcctttcttttcctttctcatttgcccatcggtcatccccagataagcactcaagtgtcctcttttatgaggccccgtgctgggccctggactgccatggtggcaggtggggtgaagtcccgccctcaggagcctgctgaccgcctgctctgtgcacagctgctggagcttccccggggctgctgatttaactggggagggcctgtctatgtggggtccctcctagccggagacaggtcccttttatgaacagcagcctgatgaagaggccttcctgcaacatgcctctggtatcattctcagctcagcattgcccaggggacaaacacagagtttgttcttggcagtcattccctgctgtcatctcaggtgggcttgagccgtgctgggtttccgggaaatctggccaggatccagcacaacctttagccagtccggcagggagcggccacgaggttgtgctggctcggtctttcccttgcaaaggaaggcatcttcgacctgccacagaatgctttcttccccggggaaacccttgcaggtgctcgggctctactttcctttctcgcttgaacaattacagggatagtttatggttctcatgaccctggtgggggtgatgacatcatgggattgaaatccgtcccaccttggagtcaccgagcgtgtcagtcaagagccttggccacaaatcagtggcacttggcagcagcacacaaatccagccaccctgtccttgtctcaggtctgggcagcacagctgtgtccctagctggtggcatcgcccctgccccttgaccttgatcttcagcctcagaagcaggctacccattgtcatgtgactgcccttcacggtccctccccaggattccaaggggcctcttgaggtttccaggttcagccgcttccttcccagcagatcacacccaaccttagccacatgaggaacgatctttagaaagggtctggcccgaagcttcatttttccctgtctgctttggttggaatcttgtgtggctttgtgtgcagttggtagtatttttgttgttggtaagtgtaggggcccttccccattgcttttctctaaggataaccatgctctgagcagcccatggcaaattctggctttggacttgttggtccccagagccagtggggtcgtgggccctggagagtttgcactcagtggcaggtcttagtgtgtgtttgaggaaccaggagagcgttcctctcagagggaggattctctggttgactcacacagagttttgttggctcagcatttagctttcagccctggtgagtttctctgacttaatgggagtaggctggctgcaagaatctttcctatattatcaaataaaataggtctcttttttggccctctagaaatcagtgttttttttcttttcgttttggagagcccggccttggggaggatatgcatcagttgctctagtgtgcctcagacaatgagataagatgaaatagggcgtgctctaggacctctccacttccccttcccgggtttctggatctgacccttcgctccctgcagaaagttgggtgagatggcaatggtccgatctcatccctgctgggtgggatggcagtggtccctcttgggtgagatggtggtggtctgatcttgtccctgctggatgggatggcggtggtctgattttgtccctgctgggtgggatggcggtggtccctgctgggtgggatggtggtgatctgatctcgtccctgctgggtgggatggtggtctgatctcgcccctgctgggtgagatagtggtggtccctgttagatcctggccctttagggtctgtaccctgcttgtcctgagccctttatccccaacctcccgcctggaagtcattcctcgttcccttgtctgagtggcctggagccgagctgtgtttctgggtcctttggccaggatctaactacagtgggccagcaggaagaggctgtgatatttacatggcctctatctgtgtttatggtaagcagacacacctggcttcatagcaccgttttatgtgtgcacctgcaaagatgtttacttttaagaaagagagacaggagaagtgaaagcaggcgcaggcataggatctctcctgtcggctgtggcccagtagagaggtgttatgcctacagttgtctaagtgtctaagtggatgggagttccctgagacctccccctcccacctcccccacccaggagttaaaagagctttgctgcttcactgactttattaactttgtgaccttggacaggccactccctctctttcatcctcagtgttcttatcaataaaacgatgggattatgcaacagtatctctgttacacctgaaaatggagccaagagctaaggttataaaaggaagcagcccagttactgattagacagcacttttaggctgggtggagccacagaactcacactgcagggaggacagaggacccaccattgagctagcgccactgctgacagcctcgctccgtggcagagtctggggtgacccctgagtcaatgccctcagccaccttaccccttctcatgggagtctctgtcttctgtttccctgaatccttgctcccagaattctggaacctaaccacactgggaggcagtaaaccaggaccagattctggatctgccaccaagtactgggtgaccttgcaaaatcagcattcttccctgccttctttatataacacgggtgatagcaccagccagtcttgaatgagtcacaggactgtcatgaagatccagtaagaaaatggttgtgaaattaccctgtgaattggatatacatctaaacatgataaattattatttcattacatttctttttttctttgtttctttctttcctttttttttttgagatgaggttttgctgtctctgtctcgcccaggcaggagggcagtggcatgactatggctcactgcagcctcagcctccctgggttcagatcatcctcctgcctcaacctcccgagtagccaggactacaggtgcatgctgccatgtctggctagttttttgtatttctgtctttcttatcattcactgagccctttgaattgggtttagccgtgttggccatgctggtctcgaactcctgggctcaagtgatctgtccaccttggcctttcacagtgcaagtgtgagccaccatgcctggcccttttgttaaatatctttttttttttttttgagaccgagtctcactctgttgcccaggctggagtgcagtggtgtgatctcggctcactgcaatctccgcctcccaggttcaagcaactcttgtacttcagcctcccgaatagctgggataacaggtgtccgccaccacacctggctaattttttatgttttttgtagagatggagtttccccatgttggccaggctggtctcgaactcctgacctaggtgatccacccaccttggcctccaaaaatgctgggattacaggcatgagccaccgcgcccagccacttttgttactttttttttttttgaaatggagtttcgctcttgttgcccaggctggagtgtaatggcacgattttggctcaccgcaacctctgcctcctgggttcaagcgactctcctgcctcagccccccgagtagctgggattacaggcgtccacgaccacgcctggctaattttttttgtatttttagtagagatggggtttcaccacattggccaggctggtcttgacctcctgacctcaggtgatctgcctgcctcggcctcccaaagtgctgggattacaggcgtgagccaccacacccggcctacatttcttatacatatatacacatacatggtctgttcagagtgtagccgaaatctgtgttttctcattcttaaatatgattagactaccagaggccaccagatgtctaaagaaaacccagcctgaaaggcgaagttccaaagataacataaaaatgtctagttgcagctgggtgcagtggtgcaccctgtagtcccagctactcaggaggctgatgcaggaggattgcttgagccaagaattcaagaccagcctgggcaacatagcaagaccctgtatcttaaaaaaaaaaaaaaaaaaagattgcattgcatctatagctaattttgagaatagacaccttaatattgaatcatctaatccatgaacagcgtatattgctcaactaatttaggtcttttagaatttctcccagcagtattttacatctttcagtgtacaggttttgtgcattttttgtcagatttacctctaagtatttcatatttttgaagctattgtaaatggtgtcttttagttttagtttccagtttttcattgctgatatgccagtacaaagacagctacgggagtgtttctagcagctctgtttgtaatggcctgaaattggagacaccccaaatgtccatcaataggtgaacaggtaaacacatgttgtgtgtccaaacgatgggataaatgcagcaacaaccaaaaggtatgcactgctgggcacacaggaacctgcgtgagtctcagaggaatcgtgcggagtgaaagaagccagatggaagagtgcatactgcagaattccatttacataaagctctgggaaaagcagcctgaagcagatgagtggtttcttggggacaggaaatggattcagggaggaacatgtgggaggggccaggaggagattttgaaggagacggacacgggcatcatcttagctgtggatggtttcatgggtgcatatggatgcccaaaattgtacacttaaatatatacactttattttatgcaataatacctcaatgaagctgctttttaaatttaatggaaggtttgcaagagcaagtcaaagaaattcccaaagtagaaccaaacgctgaagaaacgcaaaatacgggagagaaaagatgacagctagaggcgtagaggatccattcttatccgtgatcttctgaaatgtcatcacaatacaatctgtttggctatatgtgctgtttcatttgtctttctcaccattcactgagccctttgaattggaagatttacaactctcttcagctcttggaaacatcctttcagtatttctttggtaatggtctcttctctgccaggctcagaaaagattgggctcaagtattctagaagacagaggtgagacaagaaaggacattgttagaaatacccaaatctccaccttggccccaagcaaaaagacaaaggccccagcagactcccacagtggatgggaaaaatagtctggagagattgaatcaaagaatatgtgggcttgagaaccccaggtacagaggaaggctgtagagagaggtgaaaagaaggggaatgagtctcttctcctacgtgttcctgaatgctagtggctgggtttaaatcactccagccaggagattagaaaattattctctggagcaatggaaccatccacaggaagatgtatatagtctaaccattgggagtgcccagaaaaaaaatctgtttagccactcacttgtgtccccgccagtgaagccagttgtggcaaggcatgcacacagagcttccaaacagccgccaggagcttgtttctaaataaaaataaccaccaaggatcccccagcatttgaggaaagtcttcaacatggaagaaaaagtcaaaaacagagaaaagatactcaatggaaatataaagatgagaaggttttgcattcatggaacaaatacaagatgccatgaaagaggaaaattcaaagaaacagaaagctcttagaaattaaaattttgataccaaaaatgaaaaactcaattgaaaggttaaaaataatgagatggataatacagagaaaggataaatagaggataaatataataaggattaaggaatggtagaccagaggaaatgaaagggagacataatctaaaaaataagacaggaaaatcactttgggaggctgagatggaaggatagcttgaagccaggagttcgagataagcctgggcaacatagtaagaccttgcctctacaaaaaattagaaaaaaattaactggacacggtggtgtacagctatagtcctacctactcaggaggctgatgtgggaggattgcctgagctcaggagttcaagattacagtgagctatgatcagaccactgcactccagcctgggcaacacagcaagaccctgtctcaagaaaacaaaaagacccaattcaaagcacattctcaaggctttcaaagaaagacaatgaagtcataagtaaaagataatgagtttataacattatcatatttctcaaaagcaaattagaagctaaaaaacagtggaaccctcaaaattctttcttttttttttgtttttgagacagagttttaccctgtcacccaggccggagttcagtggcgcaatctcagctcactgcaacctctgcctcctgaattcaagcgattctcctgcctcggcctcccaagtagctgggattacatgcacgtgccaccgcgcctggctaatttttgtattgttagtagagacagggtatcaccatgttggctgggctggtctcgaactcccgacctcagatgatccacctgcctcggcctcccaaagtgctgggattataggcgtgagccactgcacccagcttgagccctcaaaattctaagtgaaaattatttgaaacctatagttctatacccagccaaagttccataaatgtgtgagtgtagaattaaggtattttcagaaacatgcaaagtatcaaaaaatattcttctcagaaagtatatgttcatctcttctgggtctttgtggttagaaaaaaatttttaaaaagtatgtgttccaccacaatgaagtgtaaaccaagaaagatgaagaaaatgatccaggaaataggagttttaacgcagaaggagattaaggaaaatcccagggcaatggtgaaggaagttccagacaactgctatgagaaaggacaggcggctccaggactgtggccctcaggaagaacatgaaataagttatttaacagatgttacatgtagaagattgagaagagtattgcagagctctcagattgtatgtaaagatttgggtacaagttaaaaagaaaccccagtcaatgaaaattcacagcaggaaaaacaaagacatatacaaagaaaggaaatataatagtgaacaatattttcacaggctaataatgaaaacctagagtatggatataattttttttaaactctgggcctgtaactattgggaggatggggagagaaagggtggaaggacactaaaatccacattgtcataatagaaagtcagccgatgtctagatagatgaatcaagagattatggcgttggcatattatttagaaatatagagacagactccagaacaagcattttgaacacattttaagtggccgtctggggtgtgtttctgtgtgtgatattagatcaagtcacaaatatggccaattaggaaactaaaattggagttacaagtatcctatcccagtaaggcaggagtgaggagaatctttcatgcagtgagttgataatgggtaaatgtgacaaaccaagacatatcagcttaaatttacactgtcgaattacgagatcaccaccagaagaatgacatcaggaaactgtcaaaagggccaacacctgtgggtgtgggatgggctgttgcttttgttgtgagccgtattgagtgggcgtgaggtagttaaactgagagtgccacagtgccaggccatggtgcatccccaggattcagggcgggcagacggcatgtgctatcggcagaagccttcgccggtccgtcactgggtgcagcagacaccccacctgcccctccgtattctggcccctcatcatggatacccttggcagggaggaacccggggaagttgccatcctgtcttttgggcgtttggtttgcttgcttttccctctgttggggctgcgcgtgggtgtggattcccacagtgggcctctcactgtgccttgaggtcctggactggggctcccaaggttaaacacagagcagttttttccatgacagcaccacctttttacttttggctggttcaccattggcagggcaaggccgctgggtagggtgtgcagttgagtgctggccacaggctcctgggccaggtgatggggggattgaatctggtaggggctgtgtccgagggagcagggcctgctcctagaagtctgcacaggggtaccagttgccagtcatgggcctgggctggggccactctccggggcacccacctacgtcaaaggtgattcactgaaggggagacctggatgaccgggttcgacagcccttcattgcgttttaatttaaatgaacaattcgtaagcaatgatcgcctggtgctgtccagaccctgagatgcgtggttgggaaggccgacctcatgttcctcccagagcatgcccagggttcatgtcccggggtctgcgctctgggcagtggtccccatgcctctgggggaagcccccttcttctcacccaagcccctgctttcttctccaagctggacctcacaaaatgtgaacatcttccccagcggggtgcaggggaagagcgggtgagagggtctgagtggtggcgcctctctccctgcagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtgtgagtaaagctggggctggctccggggaggacgacaaggggtggctgtccctcttccctcagcggacagacccagggccacctactgagtacacgaggatctcttggcctctctggaaccctgatggggagtgatgggaagcagtcagggctgacccatggccccctcctggcattcattccccattgtggacggcgagggacaggcgggggtggtaccacctcccctgactgagcgccttctggtctcacacagaccgggacgtgcgtgtccagaaggtcttcaatggctacatgaggatcacaaatgagaattttgtggatgcctacgagaactccaactccactgagtttgtaagcctggccagcaaggtgaaggacgcggtgagtgcagcctgcccagagtcctgctgggctgtgtgcgctggtgtcccacctgctgggcaggagggacatgcctcgcctgtgctcccagggccctgggatgggggtgatctgcaaaggggacccgggccctggaggggagggagcagcccgggcttggggcagggtcatcgccgcatggggctcaccttgagtctctgcccttcctcagctgaagctgctgtacagcggagtcccattcctgggcccctaccacaaggagtcggctgtgacggccttcaggtgggtgtggagagaaggctcagtgggatgcaccccagactggctgggagtaggatcggggtacagtgtgtggggcaggaagcgggagatggtgctggaggtcctggcctggagagccaaggagggtcctcgctgtgtcctcctgtgcgttacttggcagcctgactcttctgcccccatggcaaaggtgcctgtagctgttgctgtgatgagctgcccaaaggcctgtgacgtgcttggcatgatgccaggaacggctgtgattctttgttgtttttccaaatttgggtatgggggagttggggtactcaggcagccttcaatgagcccccacattttctgtgcttgagcagtttttcacgcatacttttgtaaaaaaatagactttattctcaaagtgctttttattttgctagttcgtttgaaccctggggaatgctgtgtggcaggtggcattcccagttcctttctcaggtcagaaaacaggctcaggaaggtgacactcggtgtgtcctcgcttgtggccaaactccaatgggtttcccctcctcattcctacccctgagcagcccccagaatcggtctggttggggatgagactgtgagagcagagggcaaagggcaaggcctcttgctttggggtggaaagagggatgacacaagaggagctggggaagggcctctgcagatggcaggcccaggtgtgccccgagccgcccatgtgtcctggagtcgctctgggcgcacgtgggggaaatggggcccagagctccgcctcaggctcccgctctctccccagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccgtgagtccgagggccaggggtgggcgtgggactggccagccttccatggagtggggctgggccctggaccattgcaggggaccggcactcccagggcccagtgccccagagagaagactacgtgctggccgggcacctccctttagataataaggaagcaggaataaggaaatggattgtatcaggaaatgctttattctccttcttattcttcagccacggactccaaaacagtacagaggacccaggacagtaagtatcgtgcccgcctcctcttctgggtggggaagaggcgggatgtggccagatgcccttgagccagtggggtccccagaagcatgtccctctgaatgaagtatattatgacgatctttccaggcccttcctcttccaggcccttctgagaagcccccttcctgatttcccgaggcccagggcagcctggggcgtctcgaaggggcgaggcctgaggtccacacccacggggtctcagggtcctcccccagctctgcccagccctgcccccacacgtgccctccttcttgtctcctgcgcagacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagtgagtaccccggggggcgggtagggctgtgggagcttggcggctgccctgtagggggccagcttcttcaacgattgggatacagtttatgactcttggccgcaggccactgctaaacatccaggcagcaggaggcacgtgtggtgtgatcctcagctgcagctccaggggagtctgggaggtgatttttctcagccttggcaaagcagaggaaggctctatagtccccagataccaaatccagcctgtgcggcctgtgccctgaaccgccggagagaaggcactgcccacggttgtaaaatgtaggctttattattcagggatatgaaggccaacagatcaggagatgactgctcttgaaaagacaattttgttggcgggcacggtagctcatgcctgtaatctcagcgctttgggaggctgaggcgggaggatctcttgaggccaggagtttgagactagcctgggcaacaagactctgcctctataaaaaataaaaagcttagctgggtgtggtggcgcatgcctactcaggaggctgatgcaggaggatctccagcccaggaggtcgaggctgcagtgagcggtgattgcaccactgcactccagcctgggcaacagagaaagaacctgcctcaggccacatgaggaaacaccaggttggtcaaggggtaacaggaatgaggggaaaatgtaagcaagagccttttatgggccgggcatggtggctcacgcctgtaagcccagcactttgggaggccaaggcggctggatcacttgcggtcaggagtttgagaccagtcaagccaacctggtgaaaccctgtctctactaaaaatacaaaaatcagctgggtgtggtggcgggcgcctgtaatcccagctactcgggaggccaaggcgggagaatcacttgaacctgggaggcagaggttgcagtgagccgagatcgtaccactacactccagcctgggcaacagagcgagactctgtctcaaaaaaaaaaaaaaaaaaaaagagcctttatatggtttacacagaaaaggcaagacaaatcagggtgagaggtttagaactggcttgtttgaataatttcagtaggctccggggcataggagctgtccctagttctctgatacttgggcctggggtggttagggcaaagaatagtggccctgagtgtgagatcctttcggaggaggtggggctgggcccccataggtgggtttgcatagggaaggtttgcttgcaggtgagtcctttcctatctctaagcattggccagccttccacagtcagcagggcctcagatgtcaaagcacctgcattacagaaaacggaaaggcgtggttaatgcacctgtgggataccccacgtcagggtggggcgtacctcgcagaggtgctgtgcgtggtgggtgagccgcctctcctgcactcgctgggccagagccttccgtggctgtctagggaaatgagctcggcggacgtttcctgattaataatgggctaaaattcaggccaagaacaacctagaaccatctgccgccacagcttcgtaaccaggacttcttttccatctctctaatttattaattgtacaacaaagaagtacatgttcccagtgggagaaggaaatcggcaagcaaaaggaagactaaagtcactcgtcatcttactgtctagaaataaccactgttaattctttttctttgagatggaatctcgctctgtcgcccaggctggagtgcagtggcaagatctcggctcaccgcaacctccgcctcctgggttcatgcgattctcctgcttcatcctctcgagcagctgggattacaggcatgcgccacaacactcagctaattttttttgtatttttagtagagatggggttttaccatgttggtcaggctggtctcgaactcctgacctcaggcaatctgcctgccttggcctcccaaagtactgggattacaggcgtgagccacagcacccggccaaatttttgatgtctattttcccagccttttttgctgtgtgtgtgttaagaaataggattatcccgtgcattcagtctcattacctgctttaacaaatgaagtatattatgatggtctttccaaatcagtcaccctctctctcagggtttttataaggttgcattgtttagaaggaggggacacaatcaggatgacatggttgtgagcagtgtggactctggagcttgaatgcctgagtttaaattctaagcctgccacttattaaccatgagatgttgggcaagttactgaacatctctgtgtctcagtttcctcacctctgagataggggtaatagtatctacttcatagagctgttaggaagattatgagttaatagatttaaaagcaccgagaaccatgccaggcatgtttttttttttgagtctccttgtcacccaggctggagtgcagtggcgcaatcatagctcactgtaaccttgaactcctgaggctcaagcagttctctggccttgccccggagtagctgggactgcaggcaagcgccaccatgcccagctagtttttttgattatggagatgaggcgttacccaggctggtctgaaactcctggcctcaagcaattctcctgccttgacctcccaacaggctgggattataggcccgaccttggcatgttcttaataaatgttgattgttactactgctgttgttctgattgagcccacagtttatttaataaatcctctgttgtgggcatgtattgtgtctagggtgttgctctttttttttttttctgacagtctcgctgtgtcgcccaggctggagtgcggtggtgcgatctcggctcactgcaacctccgcctcccgggttccggtgattctcctgcctcagcctctggagtagctgggattacaggcgtgcaccgtgatgcccagctaatttttgtatctttagtagagatgggatttcaccatgttggccaggccggtctcgaactcctgacctcaggtgattcacccgccttggcctcccaaagtgctgggtttataggcgtgagccactgcgcccggctgggtgttgctctttgattgtgacaaaggtgaactgtttatcactagcgccttccatcagtgattgtgacaaaggtgaactgtttatcactagcgccttccatcagtgattgtgacaaaggtgaactgtttatcactagcgccttccatcagtgattgtgacaaaggtgaactgtttatcactagcgccttccatcagtgattgtgtgggggagggacttacttgaatgaaggtctttttgactccattcttggcctctgtggatgggaccagagttaggggtggggtcctcaggcacctctgcctgagagcctggtttgggtgtgtgagaagcttgggttctgtctgctcttcctaatgcccgccctctgcccccacaggttgtgtggcacctaccctccctcctacaacctgaccttccactcctcccagaacgtcctgctcatcacactgataaccaacactgagcggcggcatcccggctttgaggccaccttcttccagctgcctaggatgagcagtaaggaagggcagggcagggcgggactgccctcgggccacagagaaggggaaggccttagtgggggtgacctgagcttaggaggccacaggctagaccctgtggttggcgagctggcctaggtcagcagcagaggctgaagcttgagccaaaggcatctggccgaccgcctgggtcaggagccctcctgaagcttcggcacccggcacctggccttcctggctgtgcacctgctgtgcagcatccacgcgtccaggaggcagctccaggcctcaggctgcagagccctcgtccgcctgctcggccgggcaggttcctgatcctcttgctttctcccaccttccctctcaggctgtggaggccgcttacgtaaagcccaggggacattcaacagcccctactacccaggccactacccacccaacattgactgcacatggaacattgaggtaggagctatggggcgtgtgaacgtgtgtgtgtgtgagcatgtatgtgcacgtgtgtgtgtctccctgtgcagatgtgtgtggatgtgtgtgcatgtgtttgcatatgtgtgcatgtgtgtgtgtgtgtgtgtgtgtgcgtatgtgtgtgtgtgagacagaggtggatggcaaatgaggaagacagaagaaaaggaagaggagatcctttatcaaccccaaagaggcagccagatgtcgtgactcacacctgtaatctcagcactttgggagaccaaggcaggaggatcacttgaggccaggaattcaagaccagcctgtgtaacatagtgagacctcatctctacaaaacactacaaaaattagccaggcaggtgatacatgcctgtagtcccagctactcaggaggccgaggtgggaggatcacttaaacccaggagtttaaggctacagtaaactatgacagtgccatcgcactccagcctgggcaacagtgagaccctgtctcaaaaaacaacaaaaacaaataaacaaaccccaaagagaccatgtgtcttagggcccagggtggggtcaggtcttcctgcagtgtcaggcagacccagactcttatcttagctccttgtcaggtgatggaacgacctgggcagttgctgaagctccctgggcctcagcttgcccctaggtgaagtgagggtgatagtgcctgggtctcagaggcgccgtcaggaagaaatcaaagaaggtgtgtgagacaagagagtcgcctgtccgtgccgctcacgccatcccagccagagctgcctccctttcctttctttaaaaatgccaggagggccgggcgcagtggctcacgcctgtaatcccagaactttgggaggccaaggcaggtggatcacgaggtcaggagttcgagaccagcctgggcaacattgtgaaaccctgtctctactaaaaatacaaaaattagccgggtgtgatggcgggcacctgtaatcccagctgctcgggagactgaggcaggaaagtagcttgaacccgggagtcggaggttgtggtgagctgagatcttgccactgtactccagtctgggtgacagagtgagactttgtctcaaaaaaaaaaaaaaagaaaagaggctgggtgtggtggctcgtgcctgtaatcccagcactttgggaggccgaggcgggcagatcacctgaggtcaggagtttgagaccagcctgaccaacatggtgaaaccccatctctactaaaaatacaaaaaaaattatctgggtgttgtggcttgtgactgtaatcccagctgctcaggaggatgaggcagaagaatggcgtgaacccgggaggcggaggttgcggtgagctgagatcttgccactgcactccagcctgggcgacagagcaagactccatctcaaaaaacaaacaaacaaacaaacaaacaaacaaacacgctgggagaactttgcaacctgtcttggtgatggaaggcataccatctctccctggtccatgccgctgcctccctttgacgtcctcaggttcagggaggagggaggggaactgcacattcccagcagcctctcttccctcaggtgcccaacaaccagcatgtgaaggtgcgcttcaaattcttctacctgctggagcccggcgtgcctgcgggcacctgccccaaggactacgtggagatcaacggggagaagtgagtccccgggggtatgggggctgccgggcccatgctgcagggggaggggtcccaccagacccccagccccccggctcccagctgtccctcctcaccttgtgccccgccccccctccagatactgcggagagaggtcccagttcgtcgtcaccagcaacagcaacaagatcacagttcgcttccactcagatcagtcctacaccgacaccggcttcttagctgaatacctctcctacgactccagtgaccgtgagtgaacattgttgggaggagggctggcgggggcctgcaccgcatgttctgtctaccctgcatctcgttagcatcgtgctttgctgattctaaaatgctggagaatgtaagagcatctcacccctcccgtagctttgggaggaaaacacgctacctttgatgcattaatgaaagcaggctggctgtgagcgctggcacacactgtgtccttctgggttgcagtcccagcatgaggtacctgcggctggagacgcccctcatctgagcttccccggccatctgtccctcaggcccaccttcaccgtgactttgatcatctgtgcttgcctctgtggcctgttagcaccgttaggattcacagtgtaattctgagacacatgaggaagtgccattggctgtatgagcagtggtttttccacatatgcaatgtgtttttatttcaaccctgcgtcatagaataaccttgggaagacatttaactatgcttaggaatccaactttaaggtaaaattcaagggcctggctcaccaccaaaagtacacttggatgaaccaacgcctttgatctaaacacttacctgtgaccgaagtgtccctgtgccgaggcggtgacaatggtctccttacagctttgtcatctgcaaagtggtcagatgcctccggatttcagaaacattgaaatatggaaaatgtttagggtgaaggaagtgcgcgatgccgcactacatttggataggacacatcacatgcatcggggaccagctgagcgtcacaggcggggcctggccctcaggggcaccaggcagcccagcacacagggcagggcagggcagggcctgcgaccagctggcctctctgcagggcacctggggcttcctgggcttcgatcctcagtggtggggagggaccctgccagcccaggttggggtctgtggccagccctcttcccacactagctgcgggtgcaggaacccctttgtcacagcttggtgggcctgggtaacccctgccctgggccacagcacctgccctgctcctgtgtgtttgtggctgggaggttggcccgagggagggagccgggagccagcggagggaggtgggtgggtgctgggggcctcaggcctgcctgtgcccgcagcatgcccggggcagttcacgtgccgcacggggcggtgtatccggaaggagctgcgctgtgatggctgggccgactgcaccgaccacagcgatgagctcaactgcagtgagtcaggctgggagccccggtctccccaccctccttccccaccctgcccgcgtcccatggccctgctggctgactgccgaggcagaaaggccggaggtggtgggagtttttgctctcggccctgtgtagagacctctggccccactccccaccctgccatatggagatcttggcctgtggggcaggtggtggggtatctcggaagtgctgaggtcagcttggtagctggtggagcagggccccttgggcctctctgtagatcagaaagcggtccccaggtagctctgatcgcctgggcatcctggggaagcagtgagtgatgagggcctcacggccgacctccccttaccccactccaggttgcgacgccggccaccagttcacgtgcaagaacaagttctgcaagcccctcttctgggtctgcgacagtgtgaacgactgcggagacaacagcgacgagcaggggtgcagtgagtgctggggaggggctgcctgggcgggcaggtgggcggggcgactgacggtggctcctggtggctgagtcctggtgcctctccaggttgtccggcccagaccttcaggtgttccaatgggaagtgcctctcgaaaagccagcagtgcaatgggaaggacgactgtggggacgggtccgacgaggcctcctgccccaagggtgaggcccgccccacccatcttcctgttgggggcctcgcccctggaggaggctgccctgagcacacgcacatgcaggacgccccgagtttaatgaacacaaaccacctgtgtgttaagtgtgatgagaaagggctctggttgggggagaattttccagaaggtggagaacctgtagcagggcagggaggccagtgggcgtgggtggggcaggcctgggtgagggggtaatgtgcaggggccatgaggcgccattggtggtttctggcttctggtcggatgctgcagaggaattgagcccctcccttgtcctcctccttgaacagtgaacgtcgtcacttgtaccaaacacacctaccgctgcctcaatgggctctgcttgagcaagggcaaccctgagtgtgacgggaaggaggactgtagcgacggctcagatgagaaggactgcggtgagcagggcatccgagtacggttgtgcaggttgttcactgtgtgaagtgcccaccagagggtgcacctggaggtgcaatcccgccagcacctcacttagcagctctgtgcttgggtgagagggtgtgtctcctggaggaaaggatagccttgccagttggcatgaaggcaccaccccacgggctggctctggtcttggagaaaggcccgtacggccagcatctcagcgcctctgtagcatggcggggtcgtggctgcagtgcgttgctggcccctgctgtgtagacacagctgtggagcagtagcctggagaagagcggcccagctcacccaagcccaaggcagggtgtcacccctgcctgcccatactttaatctgcagcctctgtgtttcagaagcgttggctggccacaggttagatttgagcacagctccagcgttctgtgacctcacatcagcggttcattcgtccctctcagagctgtggccttcagcattcaaaggcgcttctccctgctccatgctgccccctcccctgtgatgtcccaaatgatgtcaagtcaggcagatgacacccaaatcaaagtgaagctgaccagccagcctccggaggccctcgctgcatttgtgagggagggggaggtgggaagatgagggtttgaatttgggagcggggagaaggaggggcatggtggaagggagtctgtgaagctcaaagatagttttgggggtccctcacgccctggccacgccagcagtgctgtgcacgccaaaagctggcttccccacacagggtctcctggcacacactgcatgtccccttgtggtttgatgtccccaccttgacttgctgtcctctggttctctgctccctctgcagactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtgggtctctgggtgggcagcagggagcctccttgctggccctttgcatctgggagtaatgccaggataggttggcaccgaggcagggcactggaggggtggccacatgtgttagtccattcttgagttgctctaaagaaatacctgagactgggtcatttataaagaaaagagtttatttggcccatggttctgcaggctgtataggaagcgtggtgccagcctctgcttctggtgagggcctcagggagcttccatccatggcagaaggtgaagggggagaaggcacatcacatggcgagaacaggagcaagagagagcaggaggaggtcctagactcttaagcagccagcctcgtgtgaactcagaactcacccatcaccatgggaagggcaccaaaacattcatgagggaaccgtgaccaaaacacctcctaccacgccccacctccaacactggggatcccatttcaacatgagatttggaggggacaagcatccaaaccaaatgagcagatatcccaggacggggctcaataacagtaataataaaaactcactgtattcggtgcccacttgcagccaagtgctgtctctgtgcctctcctaaaaccccctagcaagttaggcagcttgattgtatcctcactacagaaagtaaggttcagagaagtagggacgtttgcttggggtggcacagctgttaagtggcagagccagacttgagcacaggtgtggtctccggtgagtctgcactgtgcaactcctcggattggccaacgtgagctttggattcatgctccagctctggcttgccggtggccctgggcaggttattcaaacttcctaggccttgggttcttcaccaatgatagtgacagtatcagctcccacccttagagttgtgagaattaaatacaatgctgtacttgagacactttgcgctgtgcctggcacatagtaggtgctcagcatgtcatggcctcagacacacagacagatgagaggcctggaagggtcacatgggcatcccaggaacaggggcacaatgccgggctgcgctatttgtgtcttagctcctggcctctctgggcgtctggctgttggctgaaggaaggagtgttagggcctggcttgccctgaagaggcaggcacaggggcatgggccttccaggagaatccaacctcggaagaaggggatgcgctttctgctggctgcacgcttttccatggtaggcagctccaggagcaggtgacccaagccctcagctgccctttgcagggaggagagatgggcccacagcaggagggaggcctgaggcacagatggagtgtgctcagacccatgcacagggcttgggtgatggagatggacagcaagagcctgtggggagtggacccagttccatggtccccagcttcgctgggtgcttgacacgtggctttgtccagcctgaggctgtcccttgtctcactgtgtcacccaggctgaagttcagtggtgcaaatcatagcttgctacagtcttgaactcctgggcttgagcaatcctcctgcttcagcctcctgagtagctgggactacaggcacatgccaccatgcccagctagtttaaaatttttgtagagacagagccttgctaagttgctaagcttggcctccacctcctaggctgaagtgatcctcccatcttggcctcccaaagtgctggcattacagatgtgagccaccatgcctggcccaaccacttctctttgaggttggcttttgtgcctctttgatatgccccattctttccttttttgagccatgtccttgctttctggcactaccaggtacaataggctcatcttatgtttccccagcccagccctaggaccagccatttctccaaggagtcctttactgggaatggtatttagagaccaaggtccggttgcttagtgtgttcattgtcaccatggtgtcatgtccaggcccagttagcaggtagagctaggaaatggctgggtgcatactaagaactgccctgccatcctgcactgcttcctcttttcctttgcttcgttgctttctttctcatttccttctccttcatcgtgtgttgatcatcagtcatgcttctgccaacgagtagtgcaattaatcttcaacacccctggttactattgacactagagagaccaacatgaataggacttggtccctgcagattgtgggtcacagacttgtaagggtagggacaagacatgacacacatgtgcagtaagtgctgtggcagggctgtgtccaggctcccttgggcccagcatgtggagtttagaattctaaacccatatgcctgagggactcggggggtgactgttgggaacactcaacatgggtgtctgaactgagggttgaaggtgagggtgtctgtcagctggaccaggtggctcagaccttccagacaaagggagtgtcgtgtgcagaggcagggaggtgtgagatgtgcaggggcatggtgtcaagggaccctgagcacatggctaagtcatcatgcattcattgggcactgccgggaggcggcatcacgttgcggttaaatgcacaggctgcctaggttgcagttgtggtctacagcgtgttagctatatgatcttcggcaagttgccctctctgtgcttgagtcctcatcttaaaaagcgcgaccctacctcacaggactgtttcagggataaaacaacttactgtgtcagcatcgagaattgtgcttgggacatcagaagttctacctgagcactagcgattcccaactgcactccagcccctggggtcaccatgggggatatcagtggctgcatcttcacaatcagtctctcagctgctggtagacgtgcatgccttaaacgttagaggctgagtctgctgatagaatcaaatactgtcagacttaccgattggctgggtttgcagacagggcttcatgaaagcggggtcttgagctgaggtcgccaggtgaacagggcgggcttggaggagggaggtggaaacccgcaggcacagggcaaagagctggatgggggtgtccatgctgagtgttggggtcacggggaattgagctagagggacaaggatggctctcccctctcccccgtcccatgagaccctttcagctacatgctcgcctcctgggtgttcctgaaacatctctactctcttctatctgcactgccaccaccttgctcgtcctagctcactgtagcctgggcagctgcagcaccctccccatctacttccttccctctcaggactctggtctgcaccactcgagcccagaggggccttccccaaatctgatcaccccaatctcttgcttcagcgcctgccacggcttgcagtataaagcaggaactccttcacgaccgacacggccacgttatctggcccctgcccgtccgtgcagtctcagtctccagtgcagtcctcatgccttccccatgctcagtgtgagggtttcctaaatgtgcctttgctcttttttctttttttttgagaccgagtttcacttttgttgcccaggctggagtgcaatggcgcgatctcagctcactgcaacctccgcctcccgggttcaagcaattctcctgcctcaccctcccgagtagctggaattacaggcatgcgccaccgtgcccggctaattttttgtacttttagtagaaacggggtttcaccatgttagccaggctggtcttgaactcctgaccacgggtgatctgcctgccttggcctcccaaagtgctgggattataaggtgtgagccaccacgcccggccacctttgttctctttaaacatgcggcattctccaccccttcaggccataggtggccaggcctacgtgatgtcgaggcttggttcataactcacttcgtttccggactcccagcccatcctctcccacagctttctacccagtcctctgtgggacccttcttgtcacgctgtaattggtggttttcatatctctccacatgtacactgtgaacctgaaggctgggtcatagatcgcatcacagatgcccagagattgttgagtgaatgagttgatgggggttgagtacgtggctggatgtgagcaggctgggaaactgttagaaaggtcaggtcgattaacagtgaacgcagaaggcctgggtgggtcacaagacctcacctggcaactcttgggaattcttttaggctgtggaatgggacgcaaaggatctcacaaaaacagcttttgggaagtcattttctggtggcaacagattacagtgaagcgagattgggcatagcctaggttggaaaactgagctttggccttggcgtgcgattccgtggggaggtggctgtaagaaaggccagaagggggcctggcgcggtggctcatgcctataatcccagcactttgggaagccgaagcaggcagatcacctgaggtcaggagttcgagaccagcctgaccaacatggtgaaaccccatttctactaaaaatacaaaaattagctgagcatggtggcatgcacctgcactcccagctacttgggggcggctgaggtgggaggatcgcttgagtctgggaggcggaggttgtggtgagccaagatcatgccactacactccagcctaggcaacagagtaagactccatctcaagaaaaaagaaaggccagaaggtgatggacgctggggcagtgagagtggaccagggctcgggtgggcacgcgagtgatgtggaggcagaggctgggtttagtgctccggggtcggggaggtgccctggctgggtggttcagtaaccttttgaccttcctgagaggtgagggaaaatgaagcgggtcttcatgcctttctcttgtcacgcacattttctattttaaatatgtatttttccaatgttttattttgaaatttttcaaacctacaaaaatgttgtaaatacaatgaatgaaaaaaaggactagtacagtgaacacttttttttttgagacagagtctcactctgtccccaggctggagtgcagcagcgtgatctcagctcactgcaacctctgcctcccggcttcaagcaattctcctgcctcagcctccggagtagctgggactacaggtgtgcgccaccttgcccggctaaatttttgtatttttagtggagatggggtttcaccatggtggcctgcctggtctcgaactcgtgacctcgtgatccccccatgccttggcctcccaaagtgctgggattacaggtgtgagccaccgcacctggctgtacagtgaacactcttatacctttgatctacattcagtgattgagttaatcacgtttgctttctctctgtttgcacccgcatgtatttttcagaaccatttcccaactgggggcagccattgtgaggcttcccaccaggtgcctcggcctgtgtctccaaaaacacggatgctgtcccacactgagaaatggcggcattgctttgtgctgcgagctgacgtacgcgtcataaatgtcctccaatcatgcccatcatgttcttctttagacgtttttttttttgtttttttttttgagacgcactctttcgcccagtctggagtgcagtggcacaatctaagctcactgcaacctccacctcccaggttcaggtgattctcttgcctcagtctcctgagtagctggaattacaggcacctgccaccacgcctggctaatttttgtatttttagtagagacggggtttcaccacgttggccaggctggtctcaaactcccaaccttgtgatcctctcgcctggggctcccaaagtgctaggattacaggcgtgagccaccatgcccagccttcttcggagctttttaaaaaaagtcctaggatgcagtcaagggtcacgccttgtatttagtcattaggtttctttaacctcattttaatcaagaacagtttctctacgccttttattttttggttttttatggcattgacatttttgaaaagttcgggccagttatcttacaggatgcctctcaatttgggttttcccgactgtgttttcatggctgagttaggaagcagtgcgcgggcggtgctgtaccctactcggggagagcaggatcccccgtgaagggggctggtcgggagaggaggctgagcacctggctcgggacgcccaacaggtttcgccatcataaaggggcttcccccttggtcgtgactacactgcaggtgattctttgaatcagcgtgagtgtctcgttctccagccgtactttgcccggcgtctcagcgtccgttggtgattctcacattgttgattattattgtggcaggcgcgaatgtggttccttattgtaccgtttcttcagcatttaggggctgctcactctttctttctttctctttctcttttcttttctttttttttttcttttttgaggtggggtctcactgtgttgcccaggctggagttcagtggtgcgatcttggctcactgcaacctctgcctcctgggttcaagcaattctcctgcctcagcctcctgagtagctgggattacaggcaccggccaccacacctggctaatttttgtgtttttggtagaggcggggtttcaccatgctggccaggctggtcttgaactcctaacctcaggcgatccacccacctcggcctcccaaagtgcttggattacaggagtgagccaccatgcccggccaggggctgctttttctctgtaaagaatagctttccttttccctgtataaattcttttgaaattactttttagactcagggtggactgatggattaccccacccttttttattattccacctgtgtagtagtgtcaccctgtcaccacttatttcggggttcttattgtcctaactttagccagctttgtgaggccgcattgctgtttgagtgctcgatcgcttcctgcagaaacaaaatgttccaggttgctttatgcttcccattaagccccagatccgaaatcagctgtttttccaaggagccctggttcctttcaatagagaaggatatttagacactaagttctgggtgctgctggagacagtattggttttaggccagtttttaagaattgtgagccagcgggcacggtggcttatgcctgtaattccagcactttgggaggccaaggtgggctggtcgtttgaggtcaggagtttgagaccagcttggctaacatggcgaaaccccgtttccactaaaaatacaaaaattagccaggcgtggctgcacatgcctgtagtcccagctactcgggaggctgaggcaggagaatcgcttgaacctggtaggtgcaggttacagtgaactgagatcacacctctgtactccagcctgggtgacagagtgagacttcgtctcaaaaaataataataaaataaaataaaaaccatgaacctttcctgatatctctgatctcattccacatctgtgcctccctttccccccagtggggtgggctccggctctgcagtgcacgtggaaaagcttctgaattgctaaacctattccatagccagcaacaaacttagacacaacacaacatatttttcaattcattttggtcttaggttatatagcactacattaaaaatttatttgggctgggcgtggtggctcacgcctgtaatcccagcgctttgggaggccgaggcgggcggatcacaaggtcaggagatcgagaccagcctgaccaccatgatgaaatcccgtctctattaaaaatacaaaaattagctgggtgtggtggtgtgcacttgtaatcccagctactcaagaggctgaggcaggataatcgcttgaactcgggaggtggagattgcagtgagccgagatcatgccaccaccgcactccagtctgggtgacagagcgagactcagtctcaataaataaataaataaataaattatttggattgattgttctgttattcctcctgtgaaagatcaggttcgtaagataactaatttttggtcatcagattaaaaatgtattcaaggaagggggggtaaagagttcaagagggatttcatactgcagctggaggcacttagtagtttctagcttagggtcaagaccaagtaagagccggccccatcgtcttctcgtagcagcagctgtgcctcatccatgcggaatcctctgggaacgcgcggggccgcgaggccgtgtgcacagacccgagtgaccgcgcagtctcatagcggctctccctaccaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggtaagcttcgggctgacctagggctccgcagagggcctggggcctttctccaaggccgtgtttcctctgcgtgtccggtctcggggcggggggctgctccagtctccctctgcctggcagaatgaggctgtccagggcggaatggaggcctttagtaaaaggggcatgggatttgcagcctgggctcaggattgaaggttggctttgcccctaactagctgagtgaccttgagcgagttgcttaagctctgatcctgtttgtgcatgcgcgtaatgaagatagcaacaccttaagcccagtggtgcttaaggcacgtgagggggtgggtatgaagggaagcaggccgttagttggcaaatgctagattgaaagaatccactgtacagcatatgctgaacatttgtcgtctttggagaggaaagaaaacgaacaggacttacagctccaatgccctcacagaaccccgcgggcatttgcggcgccttccctccgcctctctgcttcttgttccctcacccctgcttgccacggcgtctgttccctctcaactcgcctggcagatctcagcatgcccctgcttcctctaggtggctgctattgccagagcccactgagtagacgcggattacccgtttgtcagccccgggcatctgggctgttccagagttttctagtccaatgacccgtggggagcgtctcgaatgacgctgccctcgaagcagcccggctctcagccccgtcctgccctctccccaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccaggtggcccccggggcaggagggcggcaggtgggccccgggagaggcgggactggggactcacggcagggcttgtctccgcccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttt

SEQ ID NO: 36045 - DNA, 17951 bp, Homo sapiens
gctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacggtgagggcggatggcgggcgggcagggggcctcggtctgggctctcggaagcgcccccccccggctctcggcccctccctccaccccacaccagccgggagaaagcttcctgttctcttttgcagccgcgggtcgcctggggtgggcacatctgggggagtacggacgtggtgtgcatagctgggagtgggtgtatgtgtacgtacacaactggggtggaagtatctgtgtgcctacctggagatgaatgtggctgtgtgtgcccatctgtatatttttgttcctttccgggagtgggtgtacacgcatgtgcacacgtcttccgtgtacagtcctgcctgtgcacctctggatgtgactcgcttgtgtacatctagggtcattcatgcactggcactagtgactgtttgaatggacactgtaggtcgcataggaccctctttagacatcagtgtttcatggcagtgtgcacatgtatgtgggtgtctgtgtgtgtgcacagttggagcgcgtctcagtgtgcatttttgccaaggatgcatataccgcatgtgtctgacttgaatgggcttgtttatgtgtgttaggagaaggccctgacctttgctcctcccaggacactcactctccccaggctagggaaaacccggaacagagacttctacgtgggatggagaaagctgcctatctgaccttgacctctgacctccctcccattttccactgtgactttctgagtctgcctcagtctggttggaagatcccagctccaggctgcagacagagaagaggtccagatatggggttttgtggggagagtcctggccctaaagaatccaggccagctcccacccccagcccccagccctaggaagcttcaccattcccgcatcacaccctcccctcccctaggggtcccagtttccttcttggacaggctgtgagagaagcaatggctgggagccaggtgccctgactctacctggggctcagtgtcctcctctgtcactggcctgagagagctgcctggcctgtggggaaggcccgggctgtttgcccagacagcctggcgggtttggccatcagccacccctcccaccacactaggatcccctgcctggggctgccaccatcgacctgcctgaccacctgaatcctggtgcggttgtggccacttggtggctgggctgccctgagaaggtttccctggccccgcgaaggcaggggcctgggtcagggccagggctcccagatgggccagcctttctccaggaggagctggcgggcaggcttcatgactcagccccacaggagggaactgcctcctggccagcttcttccttcccctttgtctggtcatagctgctgcctcccagcctccagccctggtggaggagatcccaggaagttagccaccccataccccttccctgctgcctcactccctcctttcccatagtgagacaggcccaccgagggggtcactggggactgggctgcccctagccctccttccacctgtgagcagcccacttcttcccatttctggcctgggaagttggcagcagagatcaccctggaggaccaggtgccagccctgtcctgaccataggtgtggatctgctgaccgcagagtaggcaggaaagggacctgtaatgtgaggctcacttgagtcggagggagggtgttcatgaatcattgataatagaggctcaggtgtcccaggcctggcctctggattattgatggtggctgggcaggcattggggctggggtgggcagggatgtgcctttccctgtgggggtgtcagtttgccctggtaacactagaaggggcccgtcggcctgtcccttaggggagcttcttggccttccttctgggaaggtctgggcaggtagaaggggcagctcagcacagtcagcttgctgttattatcataataaaagattaattgttattaatagaggccaccatcgccaagccctttctcccatttacccctcaccacagccctgccaagtttggggctattatttccattttatacactgaagttcagagaggtcaggagtcacacagctgagggagaagtggagccccagaggccaggcttggggcctcagggacctgcttgggatctgccgatggaaagttctgtcctggcccagtgggatggtgtccacctgcctacagttccatgccatgtttctctgagccctaagggtctgctgagctcagttgggccccagcccacccagtggccttggagggtggtgcatagcctgaggtctcagattaacggtcactctgcaaagggggggcacctgaggacataaccagagtttgttttcctaaaggcccccccgcccctgagttgcccagtcctggccctataaatattctctgacctcaggcctccagctgtgttcctgacggaattcccctgacccttgggcagcctcaaggtcacactggcctagccctgctcacccagggacccaagcagggcccttccccacatgggccgtggtggtttccctgtccactagtagatccaccacttatggctccccagctctcaccatggtcctcacctctgccctggggtccttggtcactcactggctctcaccttccagctctacagcccaatgaccaagatggagtctcttttttttttttttttctgaggcggagtttcactcttgttgcccaggctggagtgcaatggtgtgatctcagctcactgtaacctccgcctcccgggttcaagcgattttcctgcctcagcctcccgagtagctgggattacaggtgcgtgctaccatgcctggctaatttttgtatttttagtagagatggggttttgccatgttggccaggctggtcttgaactcctgacctcaggtgatctgcccgccttggcctcccaaattgctgggattacaggtgagagccaccgcacctgaccaagatggagtctcttagtgagtttcggggagccattccttctcctggaagctgccccaactgcctgagggttaaggtcatgttgtccccccaccccccacagggctgtatctgggctggctgtggctcctcggggtctcagggttagacagcctggctggagggctgggactggggctgcacacatgggtgtcatgcgtgtccatgtgcttctgtgtacactttgatacatcctgttgcctgcacacacgtctcagccaagctctgcacttgcctgcctgtgtgcgtgttagcaagccggggactatatctctgtgtgtgtttgtgtatctaaacatgcgtgtccatttgtgtttgagcaactgagcatgtgttcatgtatgagggtgtttgaatttctgctcctctgtcacacatgcgtgttgtgtgttacattcacacatgctggattgagctgtgtgtgtgtgtgtgtgtgtgtgaatgggcatagtggtcattgcacagtgggggcatttgtctgtgttcttttttctgtgtatatgactgtgctgagtgtgtccaggccagcccagagctcggccatcctgcggggcagggggcagatggaggctattcactgtggctggcctggcttatgccagagcctgcccatcttctggtgggttgtcccatccctgcccaccccgccccatcaccagacctatcccagccagcaggccactcgcctgccacctctgctggctaaatttgggagcttgtgttcagtggctgtctcaggttcccagtcacatggggggctgtatttaacctggttcccagctcagccaccagaccctgtgggacagagcaggccccatactcgtctctgtccactctgcccactcatcccccaccatgtttcttgttcttatagccacggaagagctgaaggaattctttgccaaggcacgggctggctctgtgcggctcatcaaggttgtgattgaggacggtgagtgcccctcacaggccagggtataggcttgggggtggactctgctgcctctgtgggtgggggaaggaggatgttggcccctggcctgccgggacctcaatttcccactctggaaatgggtgtgaggccatcctgacaaaggagagcctcacagggcagcatcagaggtgggcgcaattgtcacctctgttatgcagagcaggaagccgaagctggggtcagcaaatagagccctgtcctggggtcctgccacctcccagaggctgcatggatattcagatgggcctggccaggatgccgagctgggctgggcagaggggcaggggataagtgaatccagcactgccccttgtggctggtgccacccgcctcatttgttggtggcctggcctggctcagctgctgtccgaggggagacctaaggagatcctgcacccttctcttggaagtgcccccatgatggggagaagggatgagtgtctggctcatctgagagtaggatgggagggttctaggcttggctgggctttggccttgcccctgaggacctgggagctgtatagagggcagtgctggggacactgggacttgagctgaggcctgaagtggggagggtttggggaggcagaggattaaactgaggaggattgggaggtcagaggccagagaacattttttcacctttcctccatgccaatggactgtccctttgggtgaggggtacagactttgggactggggtgggccaggctccccagaggtcctcccagctcttctcattagccattcagcagcaggcactttggatggctgcctgaatgggcctggtgctcagctggctttccacgcgttgtgttggctcaaagcaggatctgccattccaggttttagggccttggcagtgctttgcccagggagtccaaattctgatgccctcagagactgggcaggggtcactgtggcagaatattagtgatggcttcctggagtggcaggccacagccaccccacccttaaaaaggcagttgtactcattgaccccagtcctcggccctccctgttgcctcccagacaagatgtccctgcagatttttttttttttttttttttttgagacggagtttcgctctgtcacccaggctggagtgtagtggtgtgatctcagcttactgcaagctccgcctcccgggttcacgccattctcctgcctcagcctcccgagtagctgggactacaggcgaccaccactgcgcccggctaattttgtatttttagtagagacggggtttcaccatggtctcaatctcctgacttcgtgatccgcccacctcggcctcccaaagtgctgggattacgggcataagccaccgtgcccagccgtccctgaagattttaagcaggaggaatctctggattgacttttatctcagttctgcatgacagttgttggggtacctgggactgcccaggagggtccaggcccccgatgggcagccactgtccatctccaattgaggatggctccagtgtggccagagggcctgatttttctagagaggctgagaattctacttcttatgtaaaatttcccagtttgaaaatgttagcaacaaattaagcaatgttgacagtgctgtaggggccaacacaggccgtgactactcaaagtcactgtgactgtgatcctgtctgagttctgggtgggcaggtgaggaggccgaggcctcagagggcctggtctgttggggcgtccaggcatcggggcccctgcccagatcaggagagtctggtggactgacaccaggacccccagccaggctgactgcccctttgccccagttattgctccaggctagacctgtgtatacccaggctggtgtctggtgcccagatgaggtcccagtctacaagtgcagctggatgccccatttcagccaaggagctagcaggcctgtggggcctaggcacttagatggtggctgctttggatctgcgacattttctttctttttttgagacggagtttcgctcttgttgcccaggctggagtgcaatggcgccatctcctgctcaccacaacctccgcctcctgggttcaagcgattctcccacctcagcctcccgagcagctgggattacaggccactacacccagctaattttgtatttttagtagagacggggtttctccatgttggtcagggtggtctcgaactcccaacctcaggcgatccgcctgcctctgcctcccaaagtgctgggattataggcgtgagccaccgcgcccggcaaggatctgtgacattttcgaggggactgcagctggcaggtagccgcaggatgtctgtttatccagggtctggtaggagcccctgctcctcctttccagaggcttttacccctgtaggtccctgtggcctggggctgtgacctgcccctcagcacatttgtcctgaggggagtctgctgcggttcttctgctggagccccaggggaggaggcgagcaggaggcagtttcgtggggactgtgggctgagcagctgtgcggtggggatggggtccaagggagcacccaggggtgtggtgtccgtgaggggctgacggctgcgtgtctttgtgtggctgtttgtgttggtgatctgcgcacgtgtgtgtgtgtgggggggtgtgtgcacgcgctggggatgtgcaggggggcagcccccaggtggcagctttgtgccttcccttgctcactcattcagccacacagcctcacacttctgggacctgggggctccagggaaggtgaggggcagccggcggctctgagccagctgggcagccacggcgaggctggaggtctgcagcgggaggcgcagtgggagctgggagcggctgctcatccggcctctgcccccagagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgagtcctgggccagtgggaagtgaggaggggagctggggctgagccaggcaacaaggccttgccctgggggatccaagaggggacacaggcctgcccctggagggtgggggaagagctgtcaggccgtgccctagggagtctgagagagggtcaagtccctgtgcccgcagcctgggtacctcttgctctccaggcatcagcctggctccggaggctgtgatcaggctggacgagggctccccctgctggtgggggccacctgctgcgtcctggccccgggctggccctctgccaggtgtgccagcgcagtgagcccaccgagttcctccagaggcacctgtctgttccgggagaggcagccctgcccagaggcctcttacggtttggcccttgcccttcaggtgcggctgaagatgctgtacgcggccacgcgggccacagtgaaaaaggagtttggaggtggccacatcaaggatgagctcttcgggactgtgaaggtaatcctaagccaggacttaccgggacacaatcctgggcccacagagaggggtcactgtgcagggtcagagagcaagctagtgccagcttcgggaggaagatgggggcgctgggggagtccaagggctgcaagctggcgtgctccgtgggcctcctctagccaatccccaggtgcccatttatggctctgcattcacccccacccctgcaggatgacctctcttttgctgggtaccagaaacacctgtcgtcctgtgcggcacctgccccgctgacctcggctgagagagagctccagcagatccgcattaacgaggtgggtggggagcagaggccccagccttgagccctcagggtcatatcggcccagtggcagcctgtgctgcctgggagccacaccctgctttgggccggtgagggcctccctcaccattcccctacccacaggtgaagacagagatcagtgtggaaagcaagcaccagaccctgcagggcctcgccttccccctgcagcctgaggcccagcgggcactccagcagctcaagcagaaaatggtcaactacatccagatggtgggtgcctgctccctaccctggcacatgctgccaccacccctactcctgcccatgcacatgtgcagatgtacatggagtccccactccaccagcctgcagtctgtccccttcagctcgtccatgtgcttgtgggaacacatggtccaccccacccctccctgatccctacctattccgcctggggcgcagacactgtgtgcacatagatgtgttctggtcccttgtccccaggccctgctcatacacaggtacacctgtgagcacactgccccattccgccctccacccatacccctggggtcacactgacccctcagccccgaggcccttcctgtcagagatcccctctgttgtctccttgaccaccccgtttccctaggcagggtccttctgccctggctgttccggctgccgctttcaagcaaaacggctcctcccttccaagatgcttccgccagaggccttgcctctgaggatgggctggcccagtggcagtatctccctgaggttgtgaccctccacaccatcctgtcccaggagtcactaccgttgactacccttggtgggagttccttctctagcacaaccttcaaaggggcagagttggggctgggcccaggactggcctcttcagagggacccccatagagggatggccattgcaggggagtcttgggagagggaggtcacatcaggctcctgcccaccagctaatcctgtttgagggcttcctggggagaggggcctgggcccaccccgacctggtgctctcccatcttcccttggccctgggcagaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtaggtgagtggccatggcagggctcccaagcctgtggctgggtgggagcagggctggtctgcagtggggcaggcctgctctgggtgcgaaggtcagcaggtttctcaggcctcccaggctcacctcctgccccccaacagtgttcatctactccatgccggggtacaagtgcagcatcaaggagcgaatgctctactccagctgcaagagccgcctcctcgactccgtggagcaggacttccatctggagatcgccaagaaagtaggcgccctccccagggcctcacctccccaggccctatcactccaatctccatgtggggcgctggggtcctgagatgacggcagagcaggaatcgttgctgtcgtgttgatcatagggcatctgaggcccaaggagcaacacgcatggcccaaggctgcccagctgatcggtggctcagaaaagtccaagtcctggctaccatgtcatgtcctttccctgggcctggagacagggaggaggtgaccccagcgagcagagtccaaggcatgcagggcagcaggccctaagctcttgctttcctgggagtggcattccaggtggggaatcaaggggagacctcaggagaccccagggctaggatgtgagagtaaggggtgccccaggagtgggggctaccaggggtggtgtgtgtcagagcccctcccattggggtgaccactgccttgccccatgcagattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaagacttgtgcttggccctgagagaccgcctctggccctgggaattgggcagtcttgtgcatataactgtcctttcccaacaggggagaggggagtgccggcctgcgaggtggagccccagcactccacctccaggtgtgtgggagaggctgtgcctgtgagtgggcgtgcagcctcacgcgggtctcccagtcaacaggagccctgctggagaggcaggcgcgcctccactgtgacatgagggatctgcatatggtcatttgctgaggctgccgtaacaaattaccaccaacttagtggcttcgaagaaactcaaatgtattctcttacagttctggaggctggaagactgagatgggtctcacagggccaaagttgaggtgttggcagggctggctgtgtctgggcccctcagaagaacccatctcctggccttttctggctgtattccttggcttggggccccttcctccaccttcaaagccagaggtgacatctctgattctgctttcctcagcctctgggctcccatggccttttgtagtcgaatctccctctgtctccatttcataagggacattgtaattgcattcaccctccctgcccccaccacctacccctgtcaagatgggtaacttaatcacatctgcgaagtcgtttttgccacactgtggggtgttggggtcacgtgtttgcaggtttggggaattaggacaaggatctctgagagggactttatgcagcctcccacatgggataagggctcctcctcgaaggcttcccagcctccctgggctgaggccaggacaagtttttctgtggacatcgatatcggtgtctccaagctgagtgtgtccatgtgcgtgggtctgtacctgtgtgtgcagacccctctgtcagcttactggcctctctggttttctgcctccaaagaaggcagggccactgctgggtatgggggtctgggtccctggtccaagggactctgggaaagtctcaggcttggggctccacaggagcccgagctttggtgtatccctctgagaggtggatggagggaatgaatgcaggtgccttccaccccaggcaggcaggagtggaagcatggggttgatgcctgcagcccagctactgagtgggcactgctctccttcctggctcagggcaacattctatccctggcgcctttctgagcccctgctcaagcccctagaattgtagagaggagagccagactagctaagacccagaggaggcttgtccttgcccagccgaaacattggctcccaggtgggcaggaagacgatgccatcgccccctgctgctgagccagccagatgcctggcactatggagcctgcctgccatgataccacccagagtgggcctggggggagcaggctggcagatgtgcagccttgcctcctcccagcagcaacaattcattaattcattcattcagccttcactcagaaataccctctctgtgcctgcccagagctgactgctgggtgtacataattcagcagatatcaagcacttactatgtgctgggcactgtactggatcctggggatgcagataaaagatcactgcccttaagaagctgacattccagcaggggaataagacgatatacaataaaccatgaaagatcaatgatccggtgtgctagcagttaaaaaatgttaggacaaagagaaacatagaccaggcaaaggagctcaggagtgccagatctggggtgggaggtttgtaagaaggctggatggccctgttgagagggtgacatgggagcagagacataatggaggcaaaggaggggtcatatgagacttgggggagttttcaggcagagggaacagcacatcccaaggccctgaggcaggagaatgcccaggggctacacagtcaactgcaagcaggccagtgggcctggagagcactcaggggaacagcgggtggcaggtcccatagggccttgttggccatctgtggactgtggctttgactccagagtcagccagggaggggtctgagcagaggagggacctagtgtgacttaggtttgaacagttccctctaggggctgaatgtgaccagcccctggagggcagagagcagggcaggacagccagaagggaggtggcacctgcatgggtctaggagagaggatgggggctggtggacatggggacggtgggctgtgggcacacccttcagcatggtggacccagcagaacttgctgaggggcccggggtcacccaaggctttgggcccgaggaatctgagtctcctcacctagatcagaaggagagtgggaagaactgatggggaggactggctggcggccctgctgggccagcacacacctggcctctaggagccccatctggagtgacgtggtgtgtgctctgatggggccccaggggctctgggaatgtggaggaggaggtcttgtttccggaagatgttgcaaggctgtggtgaaggcaggtgcagcctagcctcctgctcaagctacaccctggccctccacgcatgaggccctgcagaactctggagatggtgcctacaagggcagaaaaggacaagtcggcagccgctgtcctgagggcaccagctgtggtgcaggagccaagacctgagggtggaagtgtcctcttagaatggggagtgcccagcaaggtgtacccgctactggtgctatccagaattcccatctctccctgctctctgcctgagctctgggccttagctcctccctgggcttggtagaggacaggtgtgaggccctcatgggatgtaggctgtctgagaggggagtggaaagaggaaggggtgaaggagctgtctgccatttgactatgcaaatggcctttgactcatgggaccctgtcctcctcactgggggcagggtggagtggagggggagctactaggctggtataaaaatcttacttcctctattctctgagccgctgctgcccctgtgggaagggacctcgagtgtgaagcatccttccctgtagctgctgtccagtctgcccgccagaccctctggagaagcccctgccccccagcatggtaggacaacagctctcagtcccctggggaaggggatatcctgggaaggggtggggaaagaagtgggcttggcagctgcaagcaacagtgacgggttgtcacccacatggccctggggacactcactgaatcctgaagacttcagagccgaagccctcttcttttttctttttttttttttttgagacggagtttcgctcttgttgcccaggctggagtgcagtggcttgatctcagctcactgcaatctccacctcccgggttcaagtgattctcctgcctcagcctcccaagtagctgggattatggcttgcgccaccatgcctggctaattttgtatttttagtagagccagggtttctccatgttggtcaggctggtcttgaactccagacctcaggtgatctgcccacttcggcttcccaaactgctgggattacaggtgtgagccaccgtgcccagccactgaagccctcttctgagcaatgagacccaaacccccagaggggacgaggagactgaggcactgatggagctggggctggagcctgggtttgggtctcactgggcctgtagcttggggctggctctgtctggcactttgcaggccacccctctctccatctgttctgacccataaggcaaaggctctcgggctaggtgaggcaggcagagagtgatggagctgtgcagtgccctctggccagggtccctgggaggcagccggcctgggccatagtgggagactctcacacctgcctgaatcttggccgaaggaaaaggaaggggttgtggggtggctggtggagggcagagagcggatttcagggcagctggaggggagggagccagctgccaccttgctcaggagcaggaagggaaagtcggggagagaccagggggggccgtgggccaccttgcctggcctggtatagccagggattggttaagtgaaagctgtagatcataagtctggattctaggtctcagtcctggttctgaagcctaattctgagtccaagactgggtctgagactgagttcaggttccccacaagccatgggggatgggaatggggcttggcagccaggaagaacttctgcaggtagggcttggagagaggggttggaagatgctagaagatgcccatgaagtggagtgggtggaggtagagctgggggccggccactcacacagccctcccacccccacagggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatag

SEQ ID NO: 36046 - DNA, 149881 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggtaagcgcggctctccagggcggcggccgggcgggcgctgaagcgagggctcgggcctccgggggccgctgctgggtcgggacaagggccgagggagcgcggccgcgcggaggctccgtggaggcccgtgggctgcgagaggccacccccagccccgccggggctgtgacaatgactgcccgcttttggagcgctccgatttccactcctgcttctccttctcctccggcggcggccgcgctttcagcatcttggtacccacctgttctcctagccaaccttcgcccccagtccgctccttcctttcctcctgcgacccgccctccgccctccgccgtgacccctcccttcctgctgccaccttcccgccagccacagggatctgattcctcccagggggatgtcctgcgcctcagggtccggtggtggcctgcggcatcccttgcggtgccagaagccgtgggacgaggtagggaaggggccaggggcatgttatgccggggactgggtggtcgggggcgtgttaggccggggactgggtgaccgggaactagatggccgggggcgtgttaggccggggactgggtggccggggtcatgttgggccaggcactaggtggctgggggcgtgttaggcaggggactgggtggccgggggcctgtcaggacggggcaggagtatgttagactgcggactagattgctggtggcatgttaggccagggactaggtggcccgggggtgtgtcgggccggggccaggggcatgttagtctcgggactaggtggccagaagcacactggctctgggcttcaacttgaagtccagaggtgtttggggctttgttacattcggtgggaaccagatctaaacacacaattttgagaatcaaagaattgcttggtgttactgattgggcaatgctaatctagaaaggttcttgacttatttatgtgaagatatggtcttgaaatatgtacatttaaattcttgtaagtcttaacttcttgtaagtcaggtaagtgctctatgtactttaactggacttagtttgtaactttcagaactcaaaggctattcactgtaataaaatagatgattcagtttccatcattcactttccccgacttcctggttgcatgtgagggtatgaatggataatcagttttggggccagactgccatgctgtgaatcctagctttggcatttccagttgtgtaatattgggccaggtacttaaactttctgttgtactatccccatctgtaaaatgagggtaataatagcttggcttatagtgctgttatgaagattaaataagttaacactataaagtgcttaaaacagaccctggcatgtagtaagtgcttagtaagatttacatattaattatgtaatgacacacattgtcttatggtataattcccatgattaaaagggcattgtttttaattgaaaataatttttaggggcatttagccataacataactttaattataaagaatcctatcaagtaaggcaatgaattgtggctttttttgcttttgcttatatttggttcctctgtttttcggaatggttgggttaagatccagtgtggcagtggccccaggagttcagctgtaaggccctttctaaaaaggttaagaagaggccaggcgcggtggctcacgcctgtaatcccaacactttgggaggccgaggtgggtggatcacttgaggccaggagttcaagaccagctggccaacatgatgaaaacttgtctctactaaaaatacaaaaaaattagctgggtgtggtagcacacgcttgtaatcccagctacttgggaggctgaggttgtagtgagttgagattgtgccactgcactccagcctgagtgacagagcaagactccatctcaaaaaataaataaataaataaataaataaataaataaataaaataaaaataaaaaggttgaaacgacaagagactgtgactgaaaacattggactaagtggattggctataacctgaagcaccaaggaaagattattcaggcaaattttaggaataaataattccaggaacagaaaatgcatctcatcctcacaataggttggggttaaaagacttttccagtgactcagtgcttgacagctagccagatgattccagtgttttgcaggggcaggtttgatgtgtttcaaggtgataaagtttgtagggctgaaattcttgttttgatccaggttatggtattgtatggaataaaccttcattagtagaagattcctttcagtctgtcatcttccggggattttaacttcttggtggtagggagcagtctcactggacagagagattatgacttgtttcctcggatgatggtttggagatactccatctctctgtgctttggcatgtgaaaactgttttgggaggattggttctgtgtgttacaggggtgaggttggagtgtcctgagtcgggagcactgtcacttcagtctaggctggcagttttacaaaaggggtccagtatagcacaggtttataaaggcaggggtgcagcctgggcacggtggctcaatcctgtaatctcagcactttgggaggctgaggtaggtggattacctgaggtcaggagttcaagacgagcctggccaacttggcaaaactccgtctctactaaaaaatacaaaaaattagccggggatggtggtgggcgcctgtaatcccagtgacttgggaggctgaggcacgagaatcgcttgaacccaggaggcagaggttgcagtgagccgagatgacaccactgcactccagcctgggcaacagagagagattctgtctcaaaaaaaaaaaaaaaaaagcaggggtggggaaagtaatggtgctctttggatgtgtttgcatatggtgggtggtgggagaggagggtgttcaggggtgggtacagaaaattcagagtctatggaaatatctagccattccccctcctcctttggaaattccttcctatttaggaaagataatagtcagaggccgtcacatataataactcaaaacttggatgctaaaccgtgtgcacctatggaactgggaaggatacagacatttgttcgttcaacaaatatttatgtttatattaaatatgttctattttcttttttctccttggagacagggtctccattgtcgcccagactggagtacagtgacgcagtcatggctcactgcagcctcaacctcccgggttcaagaaaccctcccacctcagcctcccaagtagctgggagtgtagtcgtgcaccaccacacctggctaatttttgggtttttttttgtttgtttgttcgtttttgagacggagtctcgcactttcatccaggctagactgcagtggcgcgatctcggttcactgcaagctccgcctcccaggttcatgccattctcctgcctcagcctcctgagtagctgggactacaggcacccaccaccatgcctggctaattttttgtgtttttagtagagatggggtttcactgtgttagccaggatggtctcgatctcctgatcttgtgattcgcccgcctccacctcccaaagtgctgggattacaggtgtgagccactgtgcctggcttaatttttatattttttagtagagacagggtctcgctatgttgcccaggctggtctcaaactgctgaactcaagtgattcttccgcctcagcctcccaaagtgctgggattacaggtgtgagccactgcgtctggcttaaatatatgctctggatttggtattagatgctaggaatactgagcagagatgaacaactgattacaggaaaaatcacaaccagtagaggagacagacttgcaaatacttaaccaattcataaaatgtggcaagtgctagaatgcagtgtatgaaaggtgatgtgggtgctcacagggaagatcctctctctgtaaagcactgcttagtaaggggcttttcccctttcttttctcattctttccctctcatttcttctattgtttattccacctcaagtgcttgcttttattcctcagagtttgatacagatgtgtgggagttcgcttagcttgtgtcgacacacttcacaagcatggaggagtttacgtgtctgagggcatccctcagccagtgcggggtgggctttggttgttgaatgatgtggcttccctccaaagggacagctctgaagtgtgttctccgtgcttctccagagggatcctagaaggactgggtattgtggcctagctcagtctggtaagcagctcaagtgtgcacccttctgactcctctccttacttccacactctggctttctggattcaccttttgcaagctacttgcacccaagttgttttctcttagtttggcagagcacaaaccaaggtcgttggtactagaagtggctctagaaagcaggctgtgagatagtattgtgaaaatggaatcactcaccctcagttggcaacaaggacctctttgctagtattaattgaggtgttggtaacccctggtactctctaacatcacagttgtagtaagactgtcaccacgagtggtttaggatgagactcaggtggaaggaaaagcattggctagtatggtagctctagcacttgagcagtgtatggacaatggtaatgataaggagagtggagttgactggctcttgttattttccttagaagccttggggtaagagaatgccatgcccagatcagccagacatgaactcagggttcattgtgaaagacagaaggctctatggccgcatctcctgcagctggagggtgggctctgttgaaggtcgggcccagaatttaattatacatgtggcagaattgcaaaggaagctgaatgcacagccttgacaggttgcctctgctaaagtcagggcaatggtagcaagatgtgagaccctgagacctggatggagatatttgggtggaggcaccgagaactttgaattcccagatttcctcagatcccttgggccagtagaggtatgcacctctctgatgcagaggacagcagtttcttcttgcctggacactgtgcagagctctcacttgaggcagatgcctcccatatgattcttgtgctcctcaagatctgccttccactcccctcagatctcagcattgcctgagcaggaaagcagttcttaaggagttgcaggacctggctaatatggaccagcagaaactgaggaaacacagtgggttgggggtggggtggggagaatcttaagggtgttggaccaaaggtgggggtattggtggactataaagctggagaggagagaacctgttgacaggtgagcattctctcatgattcaggatttggtgacctagcaaggacagctggagccagtcttggtatgcggctgggcaggctccttgaagcttggacacaacgacccataccagtggtttgcaaccagggctgattttgcctccccaagggatatttggcaatgtctggatatatttttagttgttacagctggaggttgcttctggcttctactgagtagggatgctattcagccacctccaatgtacagaatagctccccacaaaaaagagttatctggcctaaaatgtcatagtgctaaggttaagtcactttggactgcaataaatgcggtggaggcatcagaactattttggcagagtattgaggaaggaatcacctgcacctcctgcctgttttcctgggagggcctattcctttcactctgctaatgtggaatgcccagtgaggggacctgcatctttgagaagctcagtgttggctgtcttctgtaggacaagattgaccttaggagatgttactgtgaaactaggttcccaagtatcaatgaggatgataggattctgagatagtggaggccagttggtggcagttaatcatcagagacaaggtagacatagtgcccagaatgggcagcaaggctggactcacaactggggaatcttgacccactctgatgcgaatagaacatggtgtttctaagctgggcagctaaccatggtgctgcttgacttgtataatcagtaaaaaaaaaaaaaaaaaaaaattaagagctggcacgtggaagattgatgtcagctgctacaatggagaaaaatcactatctctccccttgtgttcagacatgagccatttcttagacccatatcccatggattgaaggggaggctggatctctttcgggaaagatcttgcaacattcctgcacgtataggcagacattctcccatccttcctcaagggaactgcagatctttatcagaatagctgtacagcaaagaaagtataatatttagacctttatagggctgttgaatatagggttcgggctgataacagtaccaggcaaccctcaaccaatagtggataggtgttgcagacagatgctctagtctcccatcctgcttagagaccagctgtattctaaatgagtcttcagaaggctcctggtagccttaggagcccctgttgcccactgcagtaaccagcctaagaacacactttttattggctttgccctgttgcctgtctccttgctccctcactgtggctttctgagatcacctcccaagtaagtagactacttgcactcctgtctttgtctctgtctctctctttttttttttttttttttttgcacggggtcgggggtatgaggggagtcaaactatgacaggtagcaagcaaaatatgatacttaagactaacatagtgagtgtcagctccctcttccttctgctgaggccacttgggactctggagtcagttcctgtggttccgtatcttctccaacaatacttggtggtgtttgactcttaatttgcctatgctgttgggtataggtctcattgtggtcttactttccatgaccattaaggagactaaacatctttttatatgtttatgtgccttttttgccttttctgtgaaattcctgtttaagtgtgttttctgttttttgtttgttttgttttctttttgtttgtttttttcttattgcttcgtacagtttattctggttgcaagtccctgttgcttatatgtgctggaaatatattcttcaggcttgcagcttgtctttttacttccttattgtgtttttgatggaaaattcttaatggtttctggtttttgtgttttggaaatcattctctgccagatgtcattgatattctctattgtgttctaaatattttatagtttttccttttacatttagttttaagatataccttgaatagatttttctcccctttggctgcttttaatattcttctttaactttctttttagcagtttggctttgatatatctaggtagcattttctttatatatatatatgttctgttctgagttgagcatcttgagtctgtgaattgatgtattttatcatttttggaaaaacttaaaaaaacacagttggattatcccattggcttctacattcagtctgttgcagtgtcatatgtcatgtagcctctggaaaatggaagtgaataaagcaaatgtcagtattaaactagtataagccctttgaaagggcctgggatgcctgaagcatacttcaagaaccagtgttctaagattttggtatgaagcatttgctagcctcctaaactgagctttgaagtgtttcctcttttttttctgaactctggaataatttgtggaaaattggaattattatttcttgaatatttggtagaacttggaaaattttctgggcctggaattttctttataggaagatttttaaacttttgattcagtgtctttaatgttatagagctactcagagttgctgtttctccttgagatgcttttggtaagtatattttaaaataatttttccatgttatctgagttttcaaatgtactggcataaattcattgataccatcttatcttttaaatatatgcagcatttagagttatgttccccttttcaggtatttatttgcacctttttccttgaattcttgattaatcttaccagaattttattagtctgtttttaaacaaacaacttttagccttgttgaccatttctattttgttttttaattaatctctgtgcttttatttattattttcttctgttatctttggttttactttgttgtgatatgtcttttttatagttaatctgcaactcataaagatttgtgaagctcatgtgtgaatacagtttttgttcccttaacctcaattttgtcatacatagaagctatttttcaagctatggaggacccattattgggtggtataattgatctagtaggttatggccagaattttttaaaaagcaatagaataacagagtagaaaaatggagggttcattgcgtgttctgtggctaacactgtgtactcacagtacatagcttaaatgttgttttttgaagctttatttaaaatatccatatacacacatatatatatctgtctatattgggtcacaatataacatatatttcttactgtcaattttagtttaaaaaaagttttgaaaaacactattaaagggtagtttgtctaatattaataaaggtttaaaaccagatggcacaaaatacttgaggagcttgtttttaaatgacatattctgtggccctattttaaacttactgataacagcctccagtggtggggccaaggaatctgttttaacaaactcttgtgcttcttacccttcaggtgttggggaaccactgattcaagtatacacatagaccttgagagcttcttgggaagttctaacatgggccagcggagggcagctccttgcctgcatttgtcccaaaacttcctgtcttcaaactccaggagggatatgcagaatggcaaggaagccataccatagggtgggcctgcagctggtaggggatgggagcaggcaggaatattctgcttactgttagaatgatagaaaaagtgaaatcgctgtcatgccacatttctgtcatagaacaattagaatatattgagtgactgatgtatatactccaaagatgataatcttttaagctcaaaatgtatgaattttcatgtattagtcaatgataggcaaattccttgttatgttccagtttctggtcttagagagatatgacttgaaatgattcatgaccatttagcatattttacccccaaaactgaaagtgattgcaacattcaagcttggcaatactcagctcgctaggcaggaagcagtttaccatgtgggcactgatggggagagctccatttatccgaagcaaaaatggttgataactctaagatggtctatgagcttttcagttacttcccattatattaatagctttcctggaagatccgtgagtagaatgataccattttgtttatttatttttattttattttattttttgagaaagagtcgtgctctattgcccaggctggagtgcagtggcacaatcttggttcactgcacctccgcctcccaggtttaagtgactgtcttgcctcagcctcccaagtagctgggattacaggtgtctgccatcatgcctggctaatttttgtatttttagtagagacagggtttcaccatgttggctaggctggtcttgaactcctgatctcaggtgatctgtctgccttggcctcccaaagtgctgggattataggcatgagccactgtgcccagctgtctttttgtggattggtattttgacatgcaggatgccaaaatagcttgttgcagtaacatggtaagtatgtggcagatgatgcagccacactcaaggctctgccctcccccgaaacagtatccgggaatcatataggagaggcttgtttggtaaggatcttaaaatgtggtctacatgggaactctacatttttagctgaggactacaaattttctttacatctcagtcaataatgcttattggctgttttatatatctatagctgtataacaaaccaccccaaaacttagaagctttaaacaacaacagtcatttatttgctgatgattgtggaatctatgcagagcttggtggggatggctcatctcttccctaatggttttgactgagatctccgtgtccactggggcaggttgccttccactgggagctcagcttccttagagcatggcggctggattcgaagagtgcaaaggcagactctatagggcctctcaagtcttgtgctcaaaaatcccaaaacatcacttcagccacattttcttggtcaaagcaaatcataaagctagcctagattcatggggaagggacatggattctacattttgtttggagaagtaccatgcaaattcagggatggaaagaactgttggtgttcgtctttgtaaatgaatctaccacattggcccttttcctccctttctcccttctctctctttctcttccttttcctccctccctttgtctctcctaccccattcctttcttcatttcttccatttatctaaatgcaactatcaccttcattataaatcatcactatatgttttatttgaagatgaaagattaattttttttcttattgatatccttttgtacttaatcgatactttcctagtggtgtttttacattctgccttttgttatagctttgttttctctccctcattagagtagggtctttgctttcatctttgttttcttcacagtacatgatgggtgctcaataatggtttgaatgaataagtgaacgaaaacagatttttttttttatgacacagagtcttgctctgtcacttgggctggagtgcagtggcacgatctcggctcaccgcaacctccacctcctggattcaagcaattctcctgcctcagcctcccaactagctgggattacaggtgcatgccaccacacctggctaatttttgtatttttagtagagacgggttttgccatgttggccatgctggtcttgaattcctgacctcaggtgatccacccatcttggcctcccaaggtgctgggattatagacgtgagccaccgcacatggctgaaaacagattttggaatgatgaagcttcagtttgtccagttaaatcattattttatgttaagcaagtgttttgaaataaaataactgtcttttgctattccacttttgatttttctgccttggtcagagccctccttcccagagtcccacatttgccagcttctgctttaagtaaatgtatattgatagggtatagtaatattttatattatgaattaatatttatgttaaatatatgcagtattaaatattaaatacattatatactatttattcatatatctagatatatatttctaaatgtttataagaagtgtccaaagtccctttttgttatttcaccacaccacttaagggaaagaaataggtacattaaaagtagaggctgggcgcggtggcttatgcctatgatcctagcattttgggaggccgaggcaggctgatagattgagctcaggagttcaagaccagcctgggcaacatggcaagactccttctctactaaaaatgcaaaaaattagctgggcgtggtggtcacagttacttgggaggccaaagtgggaggattgcttgagcctggggaggtgaaggttgcagtgagctgagattgcaccactgcactccagcctgagtgacagagtgaaaccctgtctcaaaacaaaacaaaacaaaaaaaaaggttgaatagtcttttcaagtgtcatttgccatcctaaatacttggtttttcttatttctctccctggtgaccaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtatctcacactcatacagcccagcccccaggagatacttgagtggccctcagggaactaaagggaagggaaggatgggaatgcttctgctcttgagttggtttcccgatgctgtcttcttgcaggacggggtgtgttggagggactgacttgcagcatgaggcctgtgtggcagcatctgcctgtgtgcccgtgaagagtagtctgccatctccggcactactgctgtgggttcccagcctcttagagtttccaaactaagcgtggctcttcttcatttattcttccttttaaatctaaatatgctaccacctcctcgtagcacttacataatacacattcactgtaagaaatctgaaaatacaggtaagcaaaaagaagaatctaagattcattctgaaatccttcctctaagagataaacattattaatattttgatgttactaaaaatacacatacacatctgtatataaatgttttgttccaaatgggatcacacagtacatactcttttgctttttcccttaatatatcatgaatatatttccaaattatgacataattttatgttcttttactatataactttaagggttgcatagtattccattttgcagatgttctaccatatatttaaccaggcttctctaatgtattttgtgtttctttaaccaaatggtgaacatttgggtagttttcaacttttcattattagaagcaggtctgtatgggacaagcttgaagtacacgtgcgttcatttttccctgtcatggagccagacttgtgtctgatgtgctgttgggatttccaggagtttgctttgcatacctgagaagcggccctatttgggcttggggatccttgatagttgttgtctagtaactgactcttgtcttttcatagttgacacattaattctcctacattttaaatttcttgacaggtgggatcgaggtacgaatcacctgttgttcaacatgttgcctggaggtcccccagattataacacagccctggatgtccccagagacaggtaggaggcatatttggggctgtccttatgatgggttcaagatcattttgttcatgtgaaattatattcctaaatctaccacatactttgtaatcagaattgtttattaaactagaaaattgtcataagtattttcctcctgaagatttagaagtgcttaaatcttttatggaaaaccagttagggcttatgtcctggcatagcctctaaaactgttttcccactctggattgtgcacttctgagtgtaacacatccagcccccaaaagtgtgacaggcttgtgctagctctctctgaattcgggagcatttgccacaagtagatgcacagcttactgagagaaggtagcgtggatatgtaaaagcgatacccaaagcctataatgtagagggtaatgggggcacgctgattctcatttactttctgttgtttcaatcagtagggttctttctgtccgttcctccctccctccctgcctgcctgccttcattattcgcccctcttgcctttcgttccttccagaaaaaccttccaaataggcagatgtggtatggggtggccatgactgcctgagagtgactttgagttcactcactgtatttatctgccctttcatcactgactgaaagattttggtatgagctttcttggaaagctctggtatgaggtgctacttaagggacctctcttagtgctgggttcaaggctttgaggaaagtagaaagttggggcgcaatatataagcgtcgcgggcaatgctcaaggtatagaattgttaacagttcacctaaacttgtttatcaccagtcttattacagttggtgtttaactcttaaactcattgttaactgaaaaggtaacagcctgaggtattagcctgagaacagcctgaggctagttctcaacttgttagaggctaacattatcatttatgaaaatcgacacttagtattccttttccccagaagattaaatctaaaccttctttgcattaagtgattatctaaagtcagttttgagtttctgtctggaaatataattataactacacaagacaaacactccaggaccacccttcagctttggtgtagagaccgttttggacgatagagggcagtccgggtgcacaaatgctgtaggaagtggctgaacacagggtaattccggatttggctctcagccccagagaaggtgtgcctgttcctgagtgggctactgttttatggatttggttgttctggggaagtgaaataactttggagaacagagaagggaaggaaaagagctgttaggaatgcagagtctccatctccagttctggattttttttcagaagggcttctttctgtttgggtcatttcactttttgctgacattttggtatatgcatctgcatgggagttggattttatttttatcaagtgcacatgttaaatgcgatttcatttgtctgcaggaaggtgtcaagtagacaggagaaagtgtgagtacatgccagtgtttaggtgttaggatcaggaaggttaaatagtttttcctatgcatgtatttttgtaagtgattatagccaatcctatagcaggtaatgaatcaccatctagtcctttatctttgcatgtgggaaatttcattttgaaacttaggtggccttcttgttggggtaaggaatagtagatttgtttgttaatttttcttatccttcatccttgctcctggattcaaaggaggcaagaactgtgaatgcagaatggttttacaggagctgcatgtcagattgtttggaaattagaaaacagatgggctagattagactgctttaagatctcctaaagttcaaaagcataggtgtgattacttaaaaattattttacttaaggaaatacagtacaaggacctggactgaagggaaatgtctgctcagtgaattttttttaatgctgcttaaatgtttttatttctctttcaattaaaaaaaaatccatacacatgatacatatatactttgtgcaagggtcgaacagcatgcaagtgtataaagagtaaaacgtaaaaacctgctttgattccctcctctgttttcactcccttcctgaaagatacttatattaaaatatgatgtgtttttctagtcttttttctatggatttagacacaagcacacatacaaaccaattttattttaacttgagtaggagcatatttcatgacttatacatcttttaatgacttaactgatgttagttttctcagatgtgttctgtaataccgttactaccttggatttcttatcctttctttgcaaatatctctcacacatttctacttttatgtgggtgtttatttatttacttaaacttgttatggaaaatttcacacctatataaagaagcgagactagtacagtgaacaccacatatcctctgtccagcttcgatcattatcttgaggcccgtcttgtttcatccttactctcatctacctccacctccgctagattatctagaaacaaatgccagacatcagatccttgcatctgtaaatattgtgtgaatctctgcatgatacagccttttcaaaaaatgtaactaactataatactattatcatacctaagaaaattaacaataatttttccatatcaccaaatagtcactaaatatctagcctttgctcatgtttacctgtctcacaaatattgttttacagtttgtttgactcagtgaacaaataaggatgaccgatagaatcggtctgcttttttgggttttgttttgtgcaaaacctgaagctttatatttgaggaatttgcaggcctgattccatgcatggtttaaaggaaagcaaaggacaaacttgcagcctcactgtgtttaggcactgcgaatacttagatagcaggaggagaactgtgagaaaacatgcagaacactgggttagggagggtggagaatacaaggccgtggagaggaaggctcagtgtcagaggagacgtcccagaatcaggcagccctgcaaagtgctaaaaatgctggagagcgcctccagtgattataatacttggcctgacctgagtcagatcatcatattaatacttctttagctgcaggttttcttttcagtctcttgcagctttggaactaatctctgatttggggatacataatgggaaaacagaatgtgctgttcagaaattcacttttcagtcaatgtaaaccatgtgttctgtaaagcaagggatgcttacaatattttctccattataatgtaatggagaccttggcagaagaagatacagtgccttagagtgcatgccagtagcagggctggcatgaggccagtttgactaattgcagtcgtggctctttttgagatgacaaacagactgcatgtggatgatcttcagcgtaaggcatgcttctgattgctgctttcctactgccagtgctgaacattcaccttaacccccctggaacagaataacaagtttggggccccggggacagaataacagtaaaggttgatgtgatatacaactgcttcctttctctgcacatacacacccacttctcctctggggctgtgagtgtaatagcctaatcacccacgaccctggcttacctggactgcctggtgcctgaatattgcatccatgtctgcttctctgcacataggccatggggcccatagagtctgcttgccatcatggtcatggaacctgcccaagttcatgttggatggtttcagtgctgcatgataatcaggaaaaataagaccgtatgttggtactaaggatagttattacattttacagagtagaccggcagctggagaagtttttagcctgcaggttacctcactcaccagttcttggtttcataaagcttaaacaaacagagtgggatttccaggggtggtttgaaaatctttgaacctaaactggtcatgttagaagggaatgtaggttgtcatcagggcagggaggggattggtagcaatcaatattgcaaaaaatgtggtttctcagttgagacatcttggctcagactttgtagtgtgtgttgccctagaaagtgatttcgatgggtttggggtcctgggagagaataacagtaaaagttggtgtgatatacacctgcttcctttctctgatgaagtgtcattgtactacttgctggatccagttaaaacaatgtggtcactgttttctaattaaggagagtaacggctagtacaagcaaactgcaagagaagcactgagggtttaattctaggttctgcttcctgtatagggaattgggttaataagactaagtagctggaatggacagtgagagccggtggaggctacatgattgacatgtaactctgagatgatggtggaaagaactgcttgaggcagggattggagagaggctggggtgtaagcgatgtgaaatgtgatactttctggccaccactgctttccaggaccattgtgttctgagattctagccagtggttggtaaatgacttccccaaccagtcttcccatgcagaactgttactcctgttattgtaaatgtgtttatttataaagtatgactagggagaggtgaatgggatctgagggaggtagcagagaggctgtccgtaaggtgtcctctggactatgatgtgtttcaaaaactgggaagtaaggaaagggtatttaggaccccgggggaaggctggtgattcaaggatagaacgcagctgatggccccgagatgcgtgtataaggcattgtctttatagaaaactgactctgtaaacgttagctggttttgataataaagactcagtaattcctgttcctctccacagtgtgtatcagaataaagtcctttctttctcatcgtttaacaaaatactttgctttcagggccctgttggctggtggcggcttttctacgtggacttaccggcaaggctacgatgtcagcattcctgtctatagtccactgtcagctgaggtggatcttccagagaaaggaccagggtaaggtacattcatcccagccaggtgtgcctttactgaatctgtgagatgttgatgaggtttagtgtggtgggcatcaaagcaaccaatacatcagttacagggtagggtccttgaggcactgaggcacccatctttcccacctccatgcagtctcattcatcttgcagttttctctgtctccttaaattcacagtgctgtctaccaagttttctaagccaggaatccatgtggtatccttaactccgttctctcctttgtttcctatatcaaagtaggaagtcgtattgattctgcatcctaaatacttcctaggtctgtctgctccccgaatcctcctcctctaccctagaccaggttactgtcatctctccattggattgctgaaacggcttcctatgtggtttccctgcctctggtcttgctcccctcgagtttgatccttggcttcacattgcccttaggataagattcacgttagtccttagcccacagtccctaaaacatctttcaaggctctctttcatctgaccactatctccatctttagctttgtgtctgagaactttttacttctttcagttcctagaacaagctgtgctctctcagtttttctgggcagcagacacattctctactgtctgcagaccttcttcctcgtcttcattagtctaacatcctgcttgtgccttaggtttcagcttgaaaccaccttctgggatggggtggagggggtaccttcttggcctctgccctggctcctctgctttatgctcccatagcagcctgcacgtctcttagagtgatgcccatcgctgcacacatgatgcccatcgtgatgacttgctcaaagcctgtcttgtttggattttggattttgtacgtgcagtgaagctgaggttaggtttttgtttttgctttgttttgcttttttaagtgacagagtcttgctatgttgcccaggctagattcaaattgttgggctcaagtgaccctcctgcctcagcctcccaagtaacaggaactgtaggcccatgccactgcatccagctgtttttttaaactaccatatcttcagtgtctggcatttcttggctcatattttagtatgtgagggagtaaatgaaaagggctgacaacatgaatgtgcagcatggatgtaacctttttttttctgtagtctatgtaaaaattgtgctatttcctggtgagaatctcagtgagctttaaacaaacatgataataaaagcatcctttacttgtgtggaagtgctcagaagcagaggtgaccaatagataaattttgacactaaaaatgttgtatttggtttgagaaatgggtctcatggaaatagtttgcctggagaccattagaaccattctttaaatatttcagacatctccttagaaacctttgtggactctgagaagtaagagaacttttctcaggagaagacatctctctcctgtttgtgttctaccatgtggcccgggaccaaattctgaaacttacattagccattcacttagcaaattttgttatgtagacgatgtgtaaagcccaggtgagcttgagacatttttgttcctacccttaggcaaatgcggagcaagactgagtggttcatgaagttgttgcttaggacatcttcctggatttttctccctttgtggactcccagagttgacttattttattttatgtttaaaattgagattaatttatataccataaaatttactcttttaatgtgtataatttaacggtttttagtatattcacaaaattgtgcaactatcatcaggcctactacctaattctagaacattttcatgactccacaaataaacctaatatccaatagcagtcagtcctcacctctgtccccagcaagaatccttaatctgctttttctctctatgggtttgcctattctggacatttcctatcaacataattgtacaataaatggtcttttgtacctgtcttctttcacttagcataatgtttccaaggcttattcatgtaatagcatggaatcagtacttcctttgttttttggctgaatatttcatcatatgaatataccacattttattcatctcttcatcagttgatggaaatttggattatttccacctgttagctcttatgaataatgctgctatgaacatttgtatacaagtttgtatgtaaagctggtttcagttctcttgacctaggagcagaactgctgggtcatacggtagctctatgtttaactttttgaggaactgccaaactcttttccaaagcggctgcaccatttcacattcccaccagccatgtatgagggtttcgatttccccatatcctcactaacccttgttattgcctgtgttttttattctagccatcctagtggatgtgaagtcatatcttcattgtggttttggtttgcatttccccactgactaataattttgagtatcttttcatgtgcttattggccatttatataacttctttggagaaatgtctattcagatcatttgcccattttaaaattgaattgtccttttatcgtagagctataagaattctttatctataacagatgttagaacctcttcagatccatgatttgcaaatcctttctcccattctatagactgcttttcactttctttttttttttttttttgagacggagttttgctcttgttgcccaagctggagtgcaatggcgtgatctcggctcaccaaaacctccgcctcccagattcaagcgattctcctgcctcaacctcccaagtagctgggattacaggcgtgtgccaccacgcccagctaattttgtattttttgcagagacggggtttctccatgtttgtcaggctggtttcaaactcctgacctcaggtgatccacccaccttggcctcccaaagtgctgggattacaggtgtgagccaccgcacccggcctcacattcttgatagtgtcctttgatgcacaaaagttcctcattttgatgaagtcaatttatctatttttcctttggttacttgcagttttggtgtcatttttaagaaaccattgcctaatccaaggccatgaagatttacccttacgttttcttctaagagttttacagttttggctcttacatttagatttatggttcattttggttaatttttgtatgtggtataaggtgggggtccaacttcattcttttgcttgtgtatgtctagttgtctgaacaccactggttgaaaaaacaagtcttcttctattgaatggtcttggtacccttgttaaaaatcaactggccatagatatatgggtttatttttggattgtcaattcgaatctgttggtctatatgtctattatgccagtactacattgtcttggttaccttagctttgtattaagttttgaaataaatgtaagttctccaactttgttcttcctttttcttgttttaagagacgaggtctcgctctgtcaccctggagtgctggatcgaatgggtgggatcataactcactgcagccttgaacccctgggctcaggtgatcctcctgcctcagcctcccaagtagctaggactataggtacatgccaccacgcttggctaattttttatagagatgggttcttgtgatactgcccaggctgtgttcttctttttcagagttttcctgactattcaggtcctttgcattttaattaactatttttgttataagtaaatataaatgaaaaacagtctaaactctttgtgcttatgcaactacaaaactgaaacaaatttacaaggttaaatataagcacatctacaaaactaataacattcagattaacataattgaatatgatagctgatgctgtttctttgaaatgagattgcatctttaaggtgaatatggagttaattacgggtttgctgggtttgatgtgcctatactgttgtatgttgggtgaaaatgtacttttttttttaaccatgttttctatttgaaacattagaagcttccctttagatagcatattgtgacatcatttatcttcatatggtacagatgcatgattcatattttttccaatattttattatgaaaatttccaaacagcaaagtttaaaaaattttacactgaacataatgtatacccacagcctagattctatctgcatttttactctactgctttatatgatttacatttttagtgtttctctcatctcattagtccactaaatagaaacttggaagttgaatattttttagcagtattcatcattaaatatgagcaaaactatccccatactaattttttggattatcatcacaatggaaatacacaaataattcttctagtgaattcacggacagaagaaactgatataattcagtgccctatttcgaggttagattttcataaattcagaaaggatgagatcatctacataagccccgctggtaccctttggggtggtacaagtttctgttatgtgcctagggtcttaatttggcatatttatgtagcacgagatagaaataactataagtagggaaaaaagttacttctctgctgcttctgtgagcatttacttaaatctgttctgtgatttaaaaagtttttattcatttctttttctctttttttcctcctaaagttgttctggaaattatttaattcaattcagtttagttcagttcacttcaagtcaaacctttattgaaagcctgtttggaccaagtattgggctagactgctgtctctcatcaggagaaagggaatgattatgtcccccaggggacatttggctatttatatatatatatatatatatatatatatatatatatatatatatacacatacacacacacacacacacatttttgactgtcatgactgtggggatgtgtgtcagagggtcctgaagaccacttccagttactatgatttgccaggagggctccatgactcagcatataattgtactaacgtctgtgacttattacggcaaaaggatgcacagcacagtcagagaggtagaagacgcatggggtgaatctggagaaaccaggcacaagccttcaagtgccctcttccagtgcggtgcacaagatgttctcagttccctcagcagcaagctgtgacaacacttgtgaaatgctgtcaaccaagggagctcgtcagagacttagcacccaggacctttcttaggagctgattgcataggctgtctctgcctggcacgtgccaaacttccagactcccagaaggaaagcatgtgttcagcataaaccacatttgtttgtgcagtttggatacagtgagccactcttatcagttccagggatgatgggaaccctctccaaatccaagtctccagatgacagccaaagaccaaacttataagcaagcctttctaaggagaacactcaggcctgctatgttaattcttctctgcatagggcagggcagcccccaacatcaagaaatactgggtgcaaatgtcagcagcgctggggttgagaaaccctgggtgaggcagagagtgacatgtgaggactggtctgctaggactgctcagctgctgtgggcctctgtcttcagtgcacttttcttgagaccacttgaaccaaactctctctttattgtttaatccctctcatataatctagctctcttatattggtttaggactcttaatccccttcaggtttaatccagggaagaaaactgaaaataaaagctttaagtgaaaataaaacaaaggagaaaaaccactccaaacagtaaaactcattttcaaataattagtttcagagatttagatacatcaatatataattagtttcagagattatatattggtggtattttcctagtaatttagtgtctctaatttttgtgtataactcagctggaattaatatctttaactagatcctttgaaaaggtgtcagtttctaaagttctgtggttcaataacccgataggagtgtccagtttatcttcagggtagcaccgaaaggtaaggctgcgctgagcatgtacctccctctgctggctggtagatggatttctgcaacctggcttgggcccatgctgtccatttcggtgccagcttgcagtctggtcatgcacttgtggtgttaacttttatataagaacatctcctaccaccacccctccctgcccccgaaaaccaagacaaaaaaaaattaaaaagtaaagacaggttcagactcatcatcctgccagggacgtgggagaaggcagggtgggccatctcatggcagtgttttgggtttgttgatccttgtgagagttgctgtttaagggaattcccacatctcttgcgggctatacagaatagtgagagctttgcttttatttttgttttaaatctctgtcagcatttgttcaatgggaagtggatgattgttgctattgatagctgcttctcacagctgttttggcctcagctggaattcttgtcattttccttctaaaatgaactaaattgggagtttacaactgttactattgagggagacttcaagttctcagcatggttttgcttaaacttagatatcagcactgctgggaggagacatgaaagctatagctagtcattttagtctttaaaagaaaaacaaatccaccttaaaatttagttggtttaaaactaaaatgagcatactccttcaaccatctgccaggtcagggacagccagcatgcaagcaagggacacatttttagacttgttcacatctacacttgttcacattgggtggggaagaaggcgcacgtggaatgttcaagccctagtggggtgggagcttctgcttaagagaagagtagtaaggtagcctggtgctaccacatttatgttgaaaatggagtagcagtagagcggggatccagtgatcctggtaactgaatgtctaaaatagaactttatttctcatcagtgaaatctaacccagagtctttcttaagagttttctttgagcaccacacatcaacatctgtatttatttctgtatctgtacagacagatgtctatctatttgtgcatattgaaaaccatgcattcatctcagtatctccagttccatccaacactgcaggggcattctggttttctctctttccatatttgtaactcccttctctgactcctagaaatctggctctctttatcctcaacatctttacttatttgatcaaccctcttatattcatcaaacttctgttgcccccctgcccccacactgcacagaggccttccccacccctcctcatccctgctcagactctgaccccctacattgtgctgccctgcaccctcccagcacagatgcctttctcacacttcttgggttctagcactggggtgatgctatcattaccatcattctccccacaacttgggcacccttctcagcctgcccaggctctaacactctcttctgagctgcccagatgccctcctaacctcacttggtctccagcatccccataacccttcccccagcacagaagccttcctttcacttctggggctctgataccctgcgccaggctaccttactactcttctcttaagcagaagctcccaccccactagggcttgaacattccacgtgcgccttcttccccacccgaccatgcagaaatgccctctgggactccaatactctatgcccttctgcctggacatcctctttactcctcttggatgcccacctgtttattctttttctggagagggtagaacactagttttgtgctgtcagctctacttaaagagaaaggctccagaaacatccatgagatccttcaaagagccagcgtcttattgtttggaaagacctttaaagaccatttagctcttaacttgatgcatgacttttcagtaactttttactgaaaaagtttctgatttatactgaaaaatcaccaacttacaagacagtccatttcattattgaatagctttaattattaaggaagtttccctgcttgtcttgtgggtttgactgtaaattttcctcttgcttaaacaggtacgtttgattatagaagtaatttgagcaaagatggtgtttagtctgagatgaactgcgggtgctccctgtatgtgatctcgccatcactaagtcatcctctgaaaattaatacttttacaaaagaaaaatgattgaggctcaaggcttggagtagaactcaaaagcctgttttagtgtctagaaagaatacttttggctataaatattgaacatattgctcaataaattgtaatttaggaggaaatgggccaggaaaaaggaaccagtctgtacagctgatccaaaccatctccctgctgggttgctgttgtatatctttcttatctccacttaccgtcatcctggcctctggctctcacctaccttgtggcgtagctccattaagtagaactttctgcagtaaggacgtggtcaacgtttgtgctgtcaggcagccccagccacatatggctatttgagcactggaaatgggcctagtgtgactgacaaactgaacttttaattttatttacttttaattagtttaatttaaatggcctcacgtggctagttgctattagtgaagttctagggagtctgctggttcctttttttcttaattgtgatgtgttaagtgccttttgctcttagttaggccaaaaccagaattgatcctgaggacgtaaaagcagtctggctgtggtataggttgctcttttctctgggtttgtatgactagtctagctggctaggcaggtgttcaccttcactcattgctttatgtgatttggacctgaagcttaatcctctataaaaggagatgaccttctcagttagagtataattattgagtgagatgctccccggctagaacttccaaacaagtctgagtaactaaggaaaagtaacaattaccattctctcttcaaagccaaaaacaaacaaacaaaaaatggatgggttcacaaactctaggttgcgtggtggcgttgcctgtgagagatacgtagccctagtattttccctgggctgtaccagtttgagctggatttcagtgtgtgctgcttctaggcttaatgagtgtttcatttcttcctggaacatgctttctgtgattcttctctttgacactgattccttgtggtccctcagcctaaacaggttgagtatcccttatccaaaatgctcaggaccagaagtgttttggactcctgattttttcagattttggagtatttgcgttatactcttggttgagcattccaaatccagaaatctaaaatatttcaatgagcatttcttttgagcatcatgttggcatccagaaagctttggattttggagcattttggacttcagattttcagatttgatatgctcaacctgtataggttttatgttctgtaccctctctgtcttgtttgagtcttgtcttccaggagggaattacttcccatctggtctctccaaaatcttccccttgacttcagacttactaactttgtgtttccatatctgtctcttgtggagatctgcatggcactagacccttggagatctttcttccctctgtcttgtttgagtcttgtcttccaggagggaattacttcccatctggtctctccaaaatcttccccttgacttcagacttactaactttgtgtttccatatctgtctcttgtggagatctgcatggcactagacccttggagatctttcttccctctgttttcttttacacatccttgccatccagatgttaagactggagattctatgctttgatgaagatcgttttttctacttcttgttttcaactaccaattcggtctccctcccatttatgtggccttgatgatggggactttccctatagcctctccattgcacagggatgctgttagacagccaggagcagccctttccagagcccttcagttgcctgccagtgcttcccatcaagcttccctctttccccatttgaagaatgcagccagcttccagtcgctttcagatcagggactcagatgtaactaagacaacacttcgatgttccttccaaattatcagtttctctcctacacacacacacacacacacacacacacacacacacacaatttatagcatgcgctctcagcttagcatattataagcatttcctcacgatatcaagaactgttcccaaataagatgtgttatgattgcataatatttcagtgtgtgaatgaatcatatcttactttctcacaatatataatattttaaatatttactaatactacagaagataattttaaaaatcagtggaggtgaagactggtaaggaaacacttactgtcataagtttaatatcaaagtttgtcttaccttgactaacataccagctgcaattttccaatcacctgtttttttcccttgtagtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggtgagtgtcattcattacctctcgcaaaggctcaggagagtttgcttacatgggttaaaattgagcccagcgaacctgagttgttttcagcatgcaactagaattacccaaggggaagaaaacatagcattgctctttactggacatgtagaccttcaggtacttggatgtctggtgtcttgtgttcgtgcaaagctgcttggcctatgagagtctatactcctttcagatattcattatacttcaaaaagacaagtctcatagattcgcagacaagccacatggacaaagcaggcaaatgtatcttgcttttacccccatattcataaggcagtccagagaaattttcttctttgaggtggcaacttgcatcccttgaccatgctggcctacagagccacagtgaactttccctgggagtggaggggtttaggggttgttttgattgttttgctatttggagttcttgccacctttagcatctcctgtcagtagcatgtcctttatttacatagtgggaatggctgtacttccataaccatagggaaagcggtctctttggggatgttttatatgtaggatatttgacattccaagggtatgggggctaggaaatgagaaattgagctttgttcacttaaatacttaaaatggacacaggttagctcaaggagaaacacaaaggagctggtgtgatttttttttttttaatctccagagagcttgcccatactgggattgtaaaaatacattcaaaaagtgctgcactcctcctggaatgtctggctggtaacagtggtgatgagggcaggagtatttatagtaacctttgtctagacaggaaaaatggttatcagcacgtgtgtccacatctggatgctgactcttgaggtcaggggagctttccacctgcacctccgggtaccacgatgacttctcttcctctcctcttgctgcttttctcatttatccccagaggtgtttggaatatcgaattcctttatttctttttctgaactttccttttctctagctttaaagattagtttttggtttttttaaaaaatctttttcctccttcttaagaggcaaaatctgggagaaacagaatgttaggtagttaaggtttctgtattttggtttacctattgcagctgttttttctgtggtacatctctccttttcccaagtattccccacattgagggggtttgagggagtgaatgaggaagaaatttttcattagattttttttatagaacatattagtcttaatatcttttcaaaggcattgaattcatgaaatgagtatcttctatataaaaagcacactgttagatgctatggggggtagaaacatgaaaagagatttgataccttccctttagggggtcttgtagaaagcctgaaattcccagacaaaataattccattacaaggtaggctgaggtaagtactgtaagagatgtcagacagtgtgccgtggtgtgtttacatagtacactagggcctaaagagacccatttgcaggaagtcacgttgttagctgtctaagggaagactttgacattgaccttgaacattttcagaaggccaacagtggtggcattgaagcaatactgaagagtagaaatattaatacaaaacattgcagccatttaaacttttcaagttttacaggtgtgagctgttgtcttttggcatttttgtgtcaagatgcctcagtattgcttggcgtcaacccttgtagaaactttgtggtctgtagggatcaaagttagtggatcagcaaaactagtttgtaatctcttgcctctttgtgttcctgcaggaggctactttctgtgtggttcttcgtggagctcggctgggccaggcagtattgagcgatgtgttacaagctggctgtgtcccggttgtcattgcagactcctatattttgcctttctctgaagttcttgactggaagaggtgggtagtacctcctagtaaactctacattagtggttctgcgtatattacaaataaaatctcctcaggtcattgtaatgtataccctggttcaagaactactacagatagtttttctctattttccattaggagagttagtacactggtctagagcagttcacaaaccaaggccagtttgcaggctggctgtttttgtaagtcaagttttattgaaacacagccgtgtcccttcctttacgtatagtctggctgttattgtgtcacattggtagagttaagtaattgcaacagaaattggatgacatacagggcttaaaatatcactatctggcctttcatcacaggggtccccaactcccgggctgtggcctgtttggagccgggctgcacagcaggaggtgaccagcgggccagtgaacattaccatctgagcctcgcctcctgtcagatcagtggtggcattaaattatcatagaagcgtggaccctactgtgaattgtgcatacaagggatctaggttgcgctctccttatgagaatttaactaatgcctgatgatctgaggtggaacagtttcatccccaaacgattccctgccaaacccagtctgtggaaaaattgtcttccacaaaaccagtccttggtgctgaaaaggttggggactgttgcttttcagaaaatggttaccaacctctagcctagaccggtgttcaactctgactacagagtagactcacctggagagcttaaaaaaaatgccttgcctaattcttggggattctgaatgttaaagctcccaggtgattctgatttgtagtcagagttgagaaccactggtctagagtctattgaatttgcataatgttgtagatggtggtggagagcctcatgtagatgaaagcttagagacattcccagtgtacagatggacccagttccattctactgggtgttcaccatttatattgcaataaacagaatagccctctattctcatgcttcactttcccaagattttgcagggtgaaggttgttgaaaattaattccattcatatctatctctcagtcttttccttgcctcaaatgcttactggttttttcctctcccaacttttttggtatttctgtccaaatctgatcaccacaggtatttgaacaacttgaaaagctctagttcattcattcattcatttattcattcatctcacattgattggaaaccctcttgtgagtaacatagagtctctgtttccaaggaggctagaatctagtgagagaagacaaaccgatgataatgttttgtggtaaatgtcatagcagctgtatgcacaggggaccatggaaacccaaaagagaggagggagcctaactcagcttgaaagaggagagcatgtagttattcttcatgccttagagaagcgatgagccacttccagcatttatctcccaatgaaagcatccattaagtaccttttatttaccagatgctgtcttaagtatagggagacaaatacaatcaaggccaaaccttttctcagggacactcatagtgtagtggtggaagacagaggagtaaatcagcagttaccaaatcctgtgatgagacagctgtgactggatgggatgccaggaggagggggagacacacaccatcattggcagtgggattggtgagggcttcacagaggcggtaactctaagctgagtccaaaagggtatttctatgagaatctagatctgcttgggtagtgctaattatggatttaaagtcagaaggcctaggttgagataaccagctctctcactggctggctttttgatcttggcaaatgacttaatcttttttgagtctcagttctcccatctgtatagtggaaatcatttacttacttaacaaatgtttatcaagtgctaactgtgcaaggcagtaatataccaggtgctgaggatacgctggtgagtggagccaggcacactttccgtcctaatggactagcctagttggcagaagtgaggtttagagtttaatcattaatttatacaaatgtaattacaaactctgccaaatgtcgtgaaggaaaagtgattgttgagtcctctctttctcttacccaccacatctaatctgttagcaaaccctgtgggctctaccctctcatccccatcatcaagtcttccctcatctgcatctcttgcctggcttttgcagtgttctccagttgttctctctgctcctgtccttgctttcctgtagtttattctaacactttagatagaatgatcctgttggaacatggttaggttatatcatgcttttgcccaaaaccctctcatggcttgccatctcagaaaaaaagcacaagtctttcagtggcctacaaggtcctatactctttgctgtgactctgtctgtcccatttcttctttcctggtgttattctctgccttctttactctgctccagccacaatagcctccttgctgttcctggaacttgcccaccatactgcttcttcagggctgtttgcttgttagactttttgcctggaatgctgtttcccaggcattcttctggcctgcttactctcttgccttccttgtctaattaattcactgttgggttagcacataatagggcttccataaatatatgccagataaatgaatagatttgcatagatagctaaaggagaaaagtatttgttaacttagaaacggaataaaggaagagtgtactaggtgggtgggatttcacatgcaaaggccctctggtagggcagagcatggtgtgttcaagtgactgaaataataccagtgtggctagagcacactagtggagtggaggcagggtgaaagattaatggagtagggagtgggaggtaaaaaaatggagctgtaagagaactcctttgagaagttcagccagtgaagaagggaggggaaagagataatacttaccggaagggatgtggggctgaaggaggtttgggatgttgtttctgcttgtgaaatgaaacaagactgtgtgtagaaatgctttctgtgaagggctgtgtgtatgtaaactgttttgctgttgtctccagagcatctgtggttgtaccagaagaaaagatgtcagatgtgtacagtattttgcagagcatcccccaaagacagattgaagaaatgcagagacaggtaagaggccaagtcttggggaggtgacatgggtggtaccgaaatggtggccttgactggatacagagggacaggagctgaatgcctgagtggggtttacttcctccactagatcaactagccaaactgaaacgataggaaattaatgttaggtgagttgcatcaaataaggtttgaaataataactctcagagaactgtgcagaggtaagcctactgcaattttagggtcttaccatagcagatgcaaagctgaagctctttggagggtttgtagtcacagcaggtgatagtcgtagtgactaagacagccatggaagctggaccatttcagggcaatacttctgtgtagctattgaccatgatactattgctgcacaaactagcccagcttcccagttcagtcatcctttgtaattcgggaatccttccctctcttctggaacatttgccattttcctgcctctctttccaaatttctcttctaccttctgacaccccattccctaggctgatctctgactgtctcatactccacttgatgtcccactgagtcctgcttccgtttctttgtcctgaaggacatttaattgggtttaaatatcaagcaaggtgaaaaagttaagaagactatcccaaaaatttttaatggacttttaaaaaggtttaatctttgtcaaaatcaccgatgtgggagaagagcaggaaaagaggcttggcggattctcagcagtacgtgcgtaagtgtcccatgccaccccctgctgttagttcggcaccctcagcctcaggcagagagcctgcatttggccatgtcccaagaacaggccacaggcttctgtctggatggggacagcgcatctgcctggctgtgtggggaggggatctgaggttctgactgttacttaaagtttcactttgacctcctgcttgaaccccactcttcccctgacttggggctctgcagtgtgactcaggtttttctcagctgatttaggaggcagctctcttgagtctatagcatcagttaccacttcttcctttacttttcagcttccacattctgatgctgttatcttgtctttcattctctttttcttaggggatacataccttaatttagaaaattccccttaattgtcattttagagttttaggagagtgaggttagtggatgtgttcagtccaccctctttattatgatagtgaacttcttatcgacacagattaagtctgtaggttcttacctcagattgcctggcttgggtatcagctctgtgggttacaaactctgtacccttaggtaaggatctgccttctctgggcctcagtgacctcatctgtgcaatattttggcattctggtttgaacgcaaatcgcaggttagttttagcttccctgcagtttatttatagcatcctcctgttcgttttaagtttctgggtttcccaattgttatttaaccactgatttcatctaagttttagtgaatcagaaaatcagtccagagatctctagattttttatctaaacctgtggttcctaaaacttgtgtagaagaaaatgccccttgaggagtcataatgtttgtgcattttgtgttaccttttctttccccgccgaggggtctcactctgtagtgcaggctggagtgcagtggcatgatcttggctcactgcaacctctgccgccagggttctagtgattctcctgccttagcctcccgagtagctgggactacaggcacgcgccaccatgcccggctaattttggtactttcagtagagacaggatttcaccatgttggccaggctggtcgaactcttgaccccaagtgatccgcccgcctcggcttcccaaaatgctgggattataggcgtgagccaccacacctggcccactttgtgttactttttatggaatcttgatttattagtaaaactaaatatagaattataggctaaagcagagactattttatactagaatctagtctagaaagggtaagaaaaaactggggaggttaaaatgcacaaattctatccagtttcttctccacccctccaccctgaagctgtgaaagagaatcatttggtttttggagtggcgtctactgccagctcacagaggactgttgcccataggagggtggtgtgggaaccacaggtctgagataagcttggtcattttcagtgttggctcagaatcatagaacagttgagaaggaatgaatgctggtcatttaaaacagcgtacttttgggttatttgggttcaaagagacacactgagtcaaaagacttgggtttgatccctggctctgtccgtttgattgcatgaccatggtaagtccccaagctccctaggcttccatttcctcatttatgaaatgaaggggttggctaaataatctctcatgttccatgtggctgttaaaaaactctatgaaatgcttatccctaccaagaacattactctccttgacaacattaataatttagtggtcatctcttctccccttgaacagctctagtcacaagggccacttgcctcctctagtggtgaacagtccactatgccagcttaaaaagaaaggtggtcttggcactttcccggccccctttctaactcccttttccgctttctgacggcctctttccctgtgctgctttcggaccatctaaagctctccactgcggcaactcactagtcccactcccctttctctgagtaatccatgttcccaaaatgacctcttttcttttcctaaccccacatttctagagtgggctgatctcaattagatatgagattatctggttaaagtaatttccagttaggtataaaggatgactaggtttcttcaactactactagattccaatagcacccctcccctcagttgtgatcaccaaaaatgtctctagaacattgcttgccaattgtcccctttggggttgggggtggagggcaagcaaaattgctttaactgagaaccactgttctctatagatagttaatgtctcatctctctaaaattagagttctttggttctataacaaaatatactgtttccaaaacattcttgtcattttgctttctgtttaccttctattgatttaacctgaccttggcaggagtaattaaaaaaatggtaaaacacctgattctgaaaagttcttataccttagtgaattctctttagggaggtcagaggtgggtctttttgcaagacaggcatccacttttaggggaaagcctattgtatcagtagttgataccttggagcccctagatgatgtatcagaatgaactgagggtgaggaacagagtctgatttgcttgctgagaaactccagactagcttaatggagctgcattggacagttgtagccagcagaggtctccatccacttttaattaactcattttccctctgagtatttaaatctttccaagaaatcctaaatgccatgagccactctggtgcttcacactgacatcttcctgatagctgctctctagagaccatttctttcagatgaagaagaagaaagaaaatcctgcttagcacaggattttactctccctagatgcaatagagctaaagtttctgatttggccccagaaatgtggggtagggtcttggtgaggaaggtattggagcaacattttgcagcttagagtttaggatcagaaaggctacaatctgacagatgtctaaagtggtgaaagtccttgttgtgacgggaatttgtgtgtaccaagggagaaagtcatactacctgacaaagaaaggaaattaaattcccttagatgtgatagtagcagccaaaaagttaactacaaggctagagcctaatgtaagtaacagctatagttagactaagacttttgaaaaaaagtacaacctgtgtctctggtatctattcctgaaggccaccagtgagcagtgctgccacacgtggcattgggcagactactgggggcttatagggctttttgtggggaagttaaaaaacagttccttaagtcagtagaagacagtagttgtaacagtataaagctgacttctcagttggccttttattgtcctgtgagctaatgattaactagttaatttattgaatccctaatgttttttggtggggggagagattataggagataataaaaaaaatctttgatccccattcacaaagggcttgtgttggggatatatgggtataagcataaagaaagttgagaagatgatgccgatatttctaggtacattatgggtcattaagggtctgaaatggaagggagaaagttggggctaaagctgtcaggatgaatttcttggagatgtagaatctgaggtaggccttgagatgggagttccatcagccatctttcttatgttggaaggcaggcagaagtatgcagctaaatatttttctgtagtcaaatggaacattcatattcccagtctcccctgaatcacaaagaaaaagtacacaatctgggatctcagaaggctggatagacactagactgtatcgttagaaatgtttgtatggatagggaggaaggtgtaaatggatccccagtttatctgttgagtagaatttccaaacattcttttattggtcagtggctccaccagcagtgacctctaacctcagccacactaggaggtggaagtcaggagcctgacttgcctttgaactcttctttgtactcaattgactagaagcctttgaggtggcagaaacattcagcatcttcttttctctctagcctttaacacttggggtacattaaaataccagtttcttttcagtctattacactgatccatctcaatgtgccttcatatttttctattaagcaaaccaaatattggtgctgcagagaagtacttgaagatgtagtgggctgattaggaaaaagacaaaacaattttatttaagaaaataaaacctctagactatagttgggcctagtagtgatcaagaagagagtagaagaggctacagaacagtaaatgtgtgcatacaccgaagttcctgtactttataggagagcccctatcaggggcctcttattttatcctacttgcatacaatttcaacacatttgaattatttggtttccatagccgtagtagtttggaagagacacatttaaagtgaagaaagactactaacagtgaaggtatctgagatgggttatctgctaatctggtatgaataaagaggatggaaatactttttttttttttttttttgagacagaggctcgttgtgtcacccaggctggagtgcagtggtgcgatctcagctcactgcaacctctgcctcctgggttcaagtgattctcgtgcctcagcctcccaagaagttgggattataggcatacgccaccacacccagctaattttggtatttttagtagagatggggttttgccatgttgcccaggctggtctcgaactcctgacctcaagcaatcagccctcctcagcctcccaaagtgctgggattacaggcatgagccactgcactgggtggaaaagctatttttaataaaaaagaatgctcagcatattgaatgtaaggatagccagcttttcaggtttcactttatcctggatatatcattataagatggcagaattcctcagttcagagaagtacatctttatttttcgtatttggaatttctgacatccaaataagtcttatcatcaatttgaacatcaaatgtagtttctgtttcttcccacaaaactgttattaatgtggcatcttaaaattgaggaaatacagaaattactattcatggtgatgcccctgaatctttaagctaagtttaattttgtttagcatatatgtttttaagatattggatcttgtgtaatatgttttataaagttttctgtttaagatgtttgtttttatttttaaaaagtgttatttgcttaaaagtgtaaaccctcagatgtctagaaaccttagcaacccagactgatgtactgagggttccctgtgctgctggccagtctgttatgtccatgacagttacatagctgtctgtgtcaatttctccctcctttcccacccccagtgtacaccagtttacaaagcagactcaacagagtagtaagctaggccattagaagagtaatctgaatttttttatgtgaagaaactaaggataaagagacgtaaagtaatcctcccaagaccacacagcatgtgagggacagacaagcagcacactctgttctgctgcctacaacttcattcaaaccacagagctgtgtggcctggattgagggtaaaaatcaggatgagcttcctaacaattcaagctaagtgcttattgaatagtcttccttgaaaaagtggttgcttgagacatttaggactggacacagccctggaaatatattatgaggaatgtggaaaaggtttcactctaatttccagtatcagtgttataatgtctaccattcttatccaccctgcaccgccactgtgaaattgaggattttaagaagtatacataaactggactcttggggctttttaaaaaatgccaaatattccctgcccctcctcctcccctctccagtcctgacatgccactccaagctgtgtttcgtggtctctgcttttgtacttgcccttaaacagttactggctgcttcccttaaacagtgcacattgacctgatccctggagttcttcctgtgaagtagacaaccatggttctaatacaaagggaggctctttggccaatgggagagccttggtaatgggtgtaatcattttgtgggatattttaaatttcacagtttttttttttcagtagcactctatattctgtttgaattttcctagtatgtatatccctattgtgaaggaaagtggtcaacatgtgttgtttaaagcagcataaaataaggtctcatttaattggaattcttaaagaagaccatttttatgtgtttaactatttttttcaactttgttattaagaagcttgttggaaaaagacttttaccaagtatctgatgatgggaagccaagaaaagcattttaatagaactgtctcagatttacaatgcactagggcctgtaaataaattttcctgtctttaaggtttggactgatttgcagttgttttgtatagcttctgagatctaaatcctcacagtccagatggagagaccataaagttactttccctggcagccttggtctgtcttgtctgtgggcaaatacaattgagtagtatgtggatcttagtctgtataggtcacccgttttactgtgatgccagttttaattggtttggtgacttttccaagagcagctcaccaaagcattctttaaatttaggagaattagggtccctaatttcataatgcaaatctaaattctcacagtctagatggagagaccataaagctactttccctggtagccttggtctgtcttgtctgtaggcaaatacagttgagtagtatgtggaatttagactgtgtagtatagtcactcatcttattgtgataccagttttaattggtttggtgacttttctaagagtagctcacctaagcattctttaaatttaggagaattagggtccttaatttcataatgcaatcagttaaataaatatggattaaggacttgctttgttcctagtattgtactggcatgttgagggagattttaaaaagggtgggcacagatcctgtctttaagaaaggccctcaggttgctggaaagagaactttcagtaatacataaattataaggccaggagtgctgtgtactcagttatgctaaggagagccaggaatgacctcaagatcagagtggatcagaaggtgaaaggaatcttcacaactgggtagcctcagatagagagggtgaacatcagggcactgacttccaccaggaggttctgtggagagactagtaggtaagaggagcatctggtggcacaggcacgggaggcaggggagagctttgaataccagcaacagagaacttggttgagaactgaagggaaggacggtaactaacaagcggaaggtaatgaaaagatttgtgaggcaaggagaaagcagtgaacataattgaagagatttaggaaagaaatcaaagagctggaagggaccttagaaattattcaaccctttccttgtattttacaagtgacaagtaagccctagagttgcagtaatcttgagaatgaattgttaggcctagtctgcagctggaacctaggtctcctgactcccagtctgatgatttgtttttttttcatggtgtactgcagtattttccaaaccgaaggtaatgattcattagcagatcatgaagtcaattcagtgggtcacgactggcattttttttttaatgaaatataataggaaactattagagagctttatacagagtaagggtaaatatttcctgtagcttttgttccagtagtgagttgttgcataaaatgtatttgtgtatttcttactgtgggtcccagtccagaaagtttgaggaaagttggtactggaaagcccagtgggcctgtgagttggagagacttgaatttgagtcctgctctgccgggtgtgtaccagttttgtagcttctgttttcttacctataacgtggagctaataatagtatggagtagttgtattgattaaatgagatgattgactcaaagcatgtagattctggccccccactctatgctggccgtcatttgggacaactcctcctggggcagcatttaagtattagaaggagcctccaaggaatgcagagtggtcttaaagaaccacagtaagttacaactactgatgtattatgcatttgcttctgggcttggaaactcgaaagagaatttattcctgtgggttctggtgtacattttacatcttggcatggaagaggcttacttctctctctctcctttttttttttttgcgtgtgtgtgtgaggatcagaatgacttgtagggagataaaaatcagtgactctttagctgacctttttttttttttaattcattggcacatttggataaagtattattgctttctttcccctttccaatggaaaaaaaaatggtactgagccttttcccccttctaatcttttctttgcctgatcataattttatccatttttttaattaaaaaaacttgtagaggaaagttagaatcagaatagatgtttgagtggtaaacagctgaggagctacagtctagtaagtataagctaaaaataaaggacatttttatgtgaatttaggaggactggtcacataccttttagaaatagctgttcacatcctgcagaaaggagaatgagttctgatatctgattttcatggtgccctctgcctcttcacttttcctcttctccccattttgctgcctctgcctcccttcccccatttctttctagccagctccatcccctattggaaatcccgctggaaaggggagacgagcttcatctcccacatgatttgggccaggggctaaagcactcccataaatctgcagctcattttaatgccacgttaaaacagtgtgagcggctggtttccgtggcccctgcccttttctttatgggcttctttggctcttctttataaagaggccctgtggagtcattttaaagtccttatcagtttgctgacagctatatgggcctttctgctgagtccaggagctcaggcaggcgtgtgaaacttctgatattaaaattgaagaaaaatgccaggcagaagggattgggtggtggggcagtggtgcagaggtgaaagactagcaagataattaacctttgcaggtccggaacctcgccgttggccactggtaggggcagggcaggaagggttaggcaaaagagggttttccaagggcttttatttttatcccaagattagaaatgccattccactggcagtttgtgctttcacgcttcagcaagtgagttgggcaacttgaagggttagggtggccaggtttgcaatgaattttttcctaaaggcagtctgactggctggacctctgcttgcgtgtctttgccagctccagcctgctgtctctgcctccgcagcatcactgttatcgaatttaaagggactttcatcagtctgctttgctgacccttttagaacagactgttaaccctcaataatcctcccagagagtttcatggaaacaccaggccctccataaatgtcagcctgcgatgcttggccctttttaccctctctgttatagagaagtagactagaggctgctcctgcctctatcctaccacttttctttctttctttgctggaaaactgcagcagacagctgaggggaaggaaaaaccattacctggatcaaggccagtggtttgatgggagcttcaaaatctttggcatctcctgcccagaatgtttttccaggcattttaaaaagagcatccttactctccttctcctttaaaccttccaactttgacttccaaagggggatggatgggtagaataagcccttagaatgtactttatatcttcctgctcttcttctaactaaagcttttaggaagaggttagtagtgataagcaaaatccaatgggcatatatatttctaactactctgtatacagctttttggcacaaacatgttatttttcctttttcaagtggacatgagcagttttgcaagtgtgttccatttaaaatagtcatttaacttgaggttgaggcaaaagcaagaatttttatagtaagttagtcaaacatatatagctgttgatcttggattgtcattgaacaaataataaaatatactgattcattttattactcgtgtagctgttgtggggaagagtacagtcatccctcagtatctgtgggggattggttccaggacctcctgcagataccagaactcaaggatgctcaagtctctgctacaaaatggcatagtatttgcatatgacctatgtatatcctcccttatactttaaattacccctagattaattatacttcctaatacaatgtaaatgctgtgcagatagttattatactgtattgtttagggaataagtgaaaggaagaaaattttatgtatgttcagtacaggcacagttttttttccgaatatttttgatctgtgattggttgaatccatggatgtggaaccacagatacagaaccgcaaatacaagggaccaactgtaattgtacaaaaaccaaatgagcagcaaaacaaagcaaaatgccccaaactccaaagtggtagaatcacttttccatacttttctgatgactaagttgatatcatctaattagttaagtttaatttaggacagtgaactgggtgttattgcttatactatactcttaacaaactaaacaacttttaagtatgttgaaagttgtcagtaaatttatgatcatgaacaatcttcattacatagccttttgaaggtggcgggtaaaatggtcacactttcctccttgggcatttgttggagaatagtctctaaagttaaccatcggtttaatcccttgtcatgaatccccaatatgggatattgctttaggaaatagcctccctaataaaagtgttaaatgttaatttgcagcctatgtaagaaatctctgattacttggggctggtttcccacagggtgggactatttgacaaatatttctgagaaataatgatcattacaggaagcgaagtgcaggtttatgaattcatgccgtacctacttagacaaatatctaggtttacaatacaataacttgtaaagtatcaagtgtcaatgtgtttggtagagaactcagtgttttcaaaccttcaaataagggttaaactgattaataaaataagtcattttgtttatttgcctgaatttagtatgtagatggctaacatgctacaaatattggcaacaacagaaacataggatttctgtctctatttataaatattaaaataacttactatatacttacatatattctgtctccttaagcattgcagaggctgagagaatttggagttgcctaattatttttggcatggcataatttatagttttataatagcacaattcatcttataattctgtgctactgttcttgggaatgtttagacaacagtcacatatatttatttctttatcttcactcagagtacaagatagctccacttaagccatttctggcaatatagttatttttctaccggtaacttaaaggctaatttgttatatttcagtgggtagttactgcccattttgataaggagtttaatagcaggaaaacagtttgcttgttccttcagattccaatactttcttatgaagagggacaagtggtttttttccaaatgtttgaagtctatctatactgaacttttttaaagtttcaggttaatttgatcaggatttaatgatcttatacatgtattatttatattttaggaagacctttgagtttttcctttggttttaagctgcagactatggttgagggcagcagtgtggtattctggcatttgatgggaatgaggagacctacaggccagtgatacactgaagggtctgagtaacatgctcatgactgtgaagcagtgcatagggaatattagacctgatcctgctcccttcagcttagaataactccaaatcatgattcctcccgaatctctttgcctagcaagctataaatgaattcacatatgatatatcagatatataatctttggaaatactttcatttatttacttaaattttttgaaatagagtcttactctgtcgcctaggctggagtgcagtggcgcaatctgggctcactgcaacttctgcctcccaggttcgagcgattctcctgcctcagccttccgaatagctgggattacaggtgtgcaccaccacacctggctaatttttgtatttttagtagagacagggtttcactatgttgaccaggcaggtcttgaactcctgacttcaggtgatccacctgccttggcctcccagagtgctgggattacaggcatgagccatcacacctggccttggaaatacttccagattagaaactatagaagagaaggagttcaactgtctaatcttctccagtagcaacttttaactgtgagatgtgagagggatatgattccctgggggaattttcaaacttcacatatcactcctactcctcccactcttgtaggctttctgggctgggggcttgggacatgaatctgtcttgagagtccctgccataacaaaccacagttactcctactcataggtgtttgtcgtccttcagatgagaaggggcaaggagaaaaagtgagagccactgacatagcaagtgtagctccctcttttcaagagtctcaatttgggaaacatacacaggggtcttccctcggaatcaccagcagagcttgtccctataacccttaatcagaagatggggctttctaccagcaagcagttcatagaggactcatgtgcctctggtcaggtgcagcagtgatagatggtattggacctacacgattctcaatgtcatttttccaggaatgtgtagtaataatagtggacagggctgctgtgctacctgactgctgagttagtattcatggccaaaaggaaaacctgccagagagtgtctccttggtgttctccggaatcattgctatgtgggaaagaaaatagagtagagaacgtcacgctaacatggctgtcatgatagcagcattggggataaagtgagcttttgatttctcccgtcttactcccttcatgtgttgtgtttgtgtgtgtgttttaattaaaaggagcaggtctttcaagtgtgcctggttggagtgaggcttgttttagatttgctttctctaatcaaacaaacttacgctttctttctcctggttttagcatagcaaacatggaaaatctcgccccaggcagattcctttatagctagttgacccaagttgtgctcttatttatttatttttgatgacacatcttgattaaaggtttccaattcacctttcagctcttcatggaaccagccaggagagagaactggtcagctgctaatcaccaaatgaactccctgatctggcctagggaacagtgggattcacaggcatgggtgacttagaaaaccgggcccagcagaaatgaatctctagtctctttgctgagaaggcttgaccaaacacagttttattggtcagtggctcctgctttagtaacctttcaccccaatggctcttggaggtgcaagccactggccggccttgcctttgaactcctcatggctcctgccacctcaaaggctcccagtcagaggcttgtgttttgctagggacctcacctcacagcagggtttcagcagttgggaaaaccgatccacccttagaacattgacatatttgaaggtgatacccctgagacttgaaacctagggctttctatttcaggagctgtctgtcacatgccaagaaacatgactcaggcttccccttttcccttcttgaccccttcttgtttcctggaggacaggaggtcataacatgggagcgttccctcagagtattcatgaagtcctctcttactgtcaagctctttcaccccttattcttctaacgttccccaagtagcatttattttgaaagtttttttttaatagggcaaaagcatgcaaatcacaagcatctttggtgtctgggaacatagtggtgaagatggtgtagtggaagtgtcatgaggctgtgtgttcagtcctaaagcattcagatcacagaagtcctagttgtgagagagcccggctgtagttttctttgccttcttgattccattccatcttcagaaaaaaactagatcttgcaagaagacatagaaatagcatggattgtcctcccgcatctgcttgggttcttgcctgaggagcagaagtgaaaactgttggtatttagaagcaaatccagggagctgtcgatattagatgacttcagtatagcttctttggcaagaaatcaaacatctcattctaaaaacattgagtagaaaatgcctcttttactcatgatgcctttagcatagaaaaggagcaaataatatccattgaagtctttgcttttctacaattcaaatagaatattattgatgatattataatactacttttagcagaaaggacaaaggtctctttctgccttagagcaaagtttaagttttcagaagagttatcagaagagttaggcctgtttctaccattgtcttgttctatggtcatgggtattttcatgagtaggatcatgagctcacatttcacaagttgcaaagggaagggccaaattaacatttgtgttaactactgtgtctggtactgtactgggagcttcctcatgaaaacttgatgaggtagctattattcttatttttataaaggaggaaaatgaactttagaggctgagtagatggcctgaggttataaaacttaagtgacagattcaagattgggaagaattttggcatatgactaaaaactatgaactttatttataaagctctcttttgtccttgtttagagtactcttgaactattataatcatctaaaatatttgtaaaatgcctactttgggtaatatactatacacaattcagagctgtacaagccatggttcttgttctcaagtggccaacatttttgaaggaagaggtatgtgatgtccattagtgtctatattagtttgctagagctgccataacaaaataccacagacggggtggcttaaacaacagaaatctatttctcacagttctggaggctggaagcccaagatcaacgagttggcagggagggtttcttctgaggcttctctgcttgtctcgcagatggctgccctcttgcctcctcttcacgtgtcgtccctctgtattcacgcacctctggtgtcactctgtgtgtccaaattcctcttctttaaggacaccagattggatcagggcccaccctaacagcctcattttcacttaatcacctctttgaaaaggccctttctctaaatacagttacattttgagatgctaggggtgagggtgtcaacatgtgaatttggggtagacaattcagctcagccccaggtctgtataaagtataagactcaaagtcagtagctgtcatttagtggctcagttgagaaagggttttgcttctgactggagtgcacctctgtggtgttttctcctaactccattctcaacaccttatcaagtataagcagtagtcatggtgtaaggccagacgggataggagccagtgaagaggggcgctttcactaccacctcattccgttgcaagttgaaacactgagaaccggcctgttgggctcaactcagaatttgtgaggcgactctgccctggatacctcatccacaaggtgggacttctactcatggttccctaatcaccacagggtaagttagattcttaaagtagtttattaagcctaataaatgctcagttttgttttgttttgtggtatcaatggaaagattcttggagaagacttttttcttcattgaaattttgcatatcacagtttatgttttaattccagaaggggaaggttgaaggttcaggattctacactagattgagagctttggtcctttaacaaatgcttgagaattttaaaaagatttaataatacagaaaacctcttataataaaagcaattcttcattcttacgcttacatcactcaagatggttgatttgggggatggggaggacagaaggtggcagaggaaacagatttatgaaagtaacatatctctacccctaaagagagattgttaatttatccttgtaacattgcatgcctgccttttgttgcctcacctagatgcatcagctagatcaacccgccccagcacatacttgtacaccctagctctctgaatcagccaggttgatggagtgttaatgtggtagtaaactgtaataaagaagaaatcttttcagcaattttttaaaaaccttttttaaaattatagaattgtagtctccttggcccagataaagtcatggccttccctacctcatttgtgtttttcagagcattggattctccttgactagtaggcagggcacaaagtgtttagaagattaaggagacactatcttacagaagataaactcagaagcctgagtaaataaatttcttctaatgttttccctattgattcattgattcactagtaaagcagagtttactaataacacacttctttaatagcaagccatattatatgcattaattattaatgggctaggcctgggcaggaagatacctggttttttgttgttgttgttttgagacagagtcctgctctgtcacccaggttggagtgcagtggcgtgatctctgctcactgcaagctccgcctcccgggttcacgccattctcctgcctcagcctcccgtgtagctgggactacaggcgcctgccaccacccccagctaatttttttttttttaattgagcattttcccccttgtactccacattgtctttttttttttttttgtagcaaatttgttgacataattgggacatttaacattctatatttttggacctgagagaggaggtttatttttatccagcagcaagctactattttaggtgctgtgggatcctccctatattcaaggaagtaactctcaagggaattgtgagctgagcatcacgcttggagcaaggcacgttggagtactaatagtggcatgagaggtagtgggacggccagcagtcatgtgcatctgtttccctcctgtccttttcaagattcttagtgcatgactttggatgagttatttagctttaaatgtctccatttcatcatctgtttgtttttatattctctagtaaggactaactcccaactgtgttacaataaaagaaatcaaggtagaaagagatcaggagtgaatgtgggtactatgttacctagacaactactccctaaatgttgttgaggaaacttcttggttattgttattctaaggagggtcttccaacatcactcaagatggacacataacagtccttgccactgtgttgggtcagaggttaaatttctctcttaaattagccaagagcacataggactgtggctgagaaagggagacttctggaaaagttgaactttatggagcattaggagtcttgaagtcactgattgattcctttaggaatctgtgcagcaccatagcccagcacatgctccagtgttacccaaggtaaatcaggaagtctagaaaaaagcaggaccagtaaacccccatgaacctgtcagtggctcaattttctcatcataaaatagggataattgggttgtgaggattaaataaattaatacaggtaaaatacttaaaatagcgcccaatacataataactgcctaatttaatcaacagatatttattgagcacctgctttgttcgggtatagttctgagtgctatagatgccacagttaacagacacaaatctctgcctgcttggaagctacattcctctggtgggaacaggtgttagatgatgctgatagtgatgatggtgagcatcgtcattatctgaggtcacagatgttggaagcagaatgaactgtgagcattaagttcacttttcaccctttctccaggggtatttgtcttttacactgaggtaaatacatttttttgggaaattcctgtgttgaagattgtttctaggttgcttgtcctgcctttttgtaatgttttccttctaattgcaagtttacttgtcttattccaaactccatggcatgacttagagaaagaaaagagtttggggttgggtgcagtagctcaggcctgtaatcccagcactttgggaggtggaggcaacaggatcacttgggcccaggagctcaaaaccagcctgggcaacacagcaaggccccatctctacagaaaatgaaaaacttagctgggtgtggtggtgcatgcctgtagtctcagctactcgagaggctgaggtgggaagattgcttgaacctgggagatgtaggctgtagtgatctgtgatcatgccactgcacttcaggcagggtgacagagcaagactctgtcttaaaaacagttggagtttggaatccccatttttcatttgcctctctttgtcccatgttctatttcttttttctgtatcctttctctgatgataactaggtttttaaactctttataggaatcaaccatgtaatccaatgccatataagcttgtaaagagcttgtaaatacgtattggaccttgaaaataaaaccttgtctaaaaactcttgtgaacttacatgagtacactattttgatatcagaaagtattgtcctggacttcatcatttagacctcttccctacatttttgtcattaacgaatatatgctttagccattttctctggtggaacttaactgcatgttaattctttaattaccccccacaaatataaatactgagactggagatgaaaggaagtaatatgcttcgaaatggatgacatgtgcttatatatgggcctttgggaatgttccaggccactgtgtttgagattaggatttgagtgctggtccatgtattttcttgtttttctaacctttgagtgactcatagttttggatgtaataatagatttagaactccccaaaattaaactacacaaagaggaaattgttgtatattcaactttttatatgtggatggggctgctgctgatgttgagagttcttcagaaattctttggaacatgctagggaaacatggcctggaagattgtgtagagccttttttttcctcagcaccagggaaatgggattaaactggaggaggttaagagatggttaacaaaaatgctaggagtggagaaagttagatttaaacaagcaagatctttgcagctaaccaaggggtaaggtcatgagcaagttgtcaaaatcctgagaagggcgagagagagagaaataaggtccatttagtatggcacagagtttcataattgtgtttgttaatattaaaactttttttttccttttcactacatatgtgccaactgggtggagactatttttaagaagacaaaaccacaataatgaacaacccatcgtggattctacattcttacatatttttagaaggatggaaatgtgggataaggtaaaaagaaaattgagattaaatcctaggagaaattaattcctagcaagaattattgggctgtataggagatcctgggaagaaagcaatatgtgttcactaaggtgtgatacactagatcttgcactgggcagtggctacatttaaaatggttctcagctgttcctctggaacaacacagcttaaaatagagtctctactagtcaaagcacgtgtagtcttgccttactgttgctgagaaaattgtgatgttaaggatggagttctctctccttaatccatttataattttgggggacacatgggccttactctagaggaaattcaggatcctagtataaagaagctgtaagaatccacagacctattatacaacagctgtagtatttatgggctggtttcttgagtccttgcccataggtgaggactagtaaattttgcttaacattgtgtgccaaccatcagagagtttttgatctgtctgggaagataagcttttcccccgtagaattacaatggggcagaaaatagatgctgattgttttgaaaaattgtcagatgaattagaaaagaattaaggctagtttcaaggaagagatgaacattaaagtacagataggattttttaaattaataaactttagatttttaggagagttttaggttcacagcaaaattgagcagaaactacaaagagttcccatatatcccccatcctcatagttgtccaacataccccactatttactgaacaccatagtggtacatttcttacagttcatgaatctacactggcacatcattatcacatgaagtccataatttacattagggttcactcttgatattttacattgtatgggtttggacaaacatgtatctaccattgtaatatacagaatagttccattgccctaaaaatcctctgtgctctgcctattaattgctcccttctcccaactctcggaaaccattgatctttttactgtctctgtggttttgcctttttttgaagtcatatagttgaaattatatagtatgtagccccttcagtttggcttcttttacttagtaatatgcatttaagtttcctccatgtgtcttcatggcttggtagctcatttcttttcagtgctaaataatattccattgtctggatgtaccacagtttattcacctactgaagggcatcttgattccttctatgttttgtatatgaataaagctgctgtaaacatctgtgtgcaggttttcgagtagatgtaagttttcagtgcatttgggtaaccttcagggagcacagttgctggcttgcatggcaagaatacgtttagttttgtaggaacctaccaaactatcttccaaagtggctgtaccactttgctttcccacctggaatgaatgacagttcctgttgccctacatcttcaccaacatttggtgttctcagtgctttggattttggccattctaatagatatgtatttgtatcttattgctgttttaatttataattccttaatgatatgtgatattgaacatcttttcatatgcttacttgccatctatgtatgttctttggtaaggtgtctgttcaggtcttttgccattttttaatctgattgttcactttcttattgtagagttttacgagtattttgtttattttggagaacagtcccttattagtcgtgtcctttgcaaatgttttctcccagcctgtggcttattttctcattctcttgacattatttgttgcacatcaggagtgtttaatattaatgaagtccagcttatctattatttatttcatgggttatatctttggtattgtacctaaaaagtcattgccataccaaggccatctaggttttctcctaagttatcatctaggagttttatagggttgttgttgttgttgttgttgtttttgagacagtatcatttcatcacccaggctggagtgcagtggtgtgttctcagctcactgcagcctcctccttctgggttcaagcagttctcatgcctcagcttcccaagtagctgggactacaggtgcacaccaccacacccggctaatctttgtatttttagtagagacgggttttcatcatgttggccaggctggtcttgaactcctgacctcaggtgatctgccctcctcgccttcccaaagtgctgagattacgggcatgagccactgcaccctgctggagtttataattttacattttatatttaggtcagtgatccattgtgagtaaattttttttgaaggatgtaaaatctgtctagatttttttgtatgtagatgtccagttgtttcagcaccatttgtggaaagactgtcttttcttcatatgtattgtttttgctcctttgtcaaagatcattcaggtatatttatgtaggtctgtgtctgggctctctattctgttccgttgatctgtctattctttcaccaatatcacactgtcttgatgactgtagctttattttaagttttggagtttggtagtctcagtcttctgactttgttcttcaatattgagttgcctattctggatctttacctctctatacaaatttagaatcagtttgttgatagccacaaaataacttgctgagatttttactgaaattttgttgaatctataattcaagttgggaagaaccgacatcttgacaatattgagtcctcccagctaggaatatagaatagctctccatttatttaagttatttgatatctttcatcagagttttatatttttactcttatagatcttatacatattttgttagatttatacttatttcattgttttcagtgctaatgtaaatggtgatgggttttaaatttcaaattccacttattcattgctagtgtatatgaaagggattgatttttgtatattaaacttatatcctgccatcttgcagtaactgcttattagttccattttgttgttgttgttgattttgttggattctctatataaacaatcatgttatctgtgaacaaagacagttttatttcttttttcccaatatatataccttgtattttttttttcttgacttactgcattggctaggactttcagtatggtgttgaaaaggagtgtgagaggggacatctttgccttgttgctggtctgagtagaaaagctttgaatttttcatcattatgatataagcagtaggtttttttgtagatattctttatcaactagaggaaatttccttctattcctagtttgctgagagtttttatcatgaataagtattggatttggtcaaaggctttttctgtatctattggtgtgctcttggatttttttctctttagcttgttgatgtggtggattacattaattgatctgtgaaagctgaaccagccttgcatacctgggataaatctcacttgatcatggtgtttaattctttttacacaatgttggatttgaatactggttgttgttgtttttttttagaattttttgcttctattttcatgagagatattggtctgtagttttctgttttttttttaattaaaaaattttatgggtacatagtaggtatatatatttatagggtacctgagataattttgatacaggcatacaatgggtaattatcacattagggaaaattgggtatctatcccctcaagcatttatcatttctttgtgttacagacgttccaactatagtcttttagtcattttgagatgtacaataaattattgttgactatagtcactctgttgcactatcaaatactatatcttatttattctatctaactatatttttgtacccattaaccatccctacttaccactccccacccttcccagcctctggtgatcatcattctaccttctatctctttgagttcagttgttttaatttttagctcctacaaatgagtgagaacatgccaaagttgtctttctgcacctggcttatttcacttaacataatgacctccatttccatccatgttgcaaatgacaggatctcattctttttaacaattgagtagttctccattgtgtataagtaccacattttctttattcattcatttgttgatggacacttaggttgcttccaaatcttggctgttgtgaatagtgctattataagcatgggagtatagatacctcttcgatatactgatttcctttcttttgatatatatacctagcattgggattgctggatcatagtttagttctatttttagttttttgaggagcctctgtactgttctccatagatgctgtacctgtttacattcccaccaacactgtatgagggttccattttctctacatcctcaccagcattcattattgcctgtcttttggttaaaagccattttaactaggaggagatgatatcttattagagttttgatttgcatttctctaatgatcaatgatgttgagcaccttttcaggtcttgtaacaacatgacttaattttgcccatttttaaattagattttttttttgctattaagttgtttgagctccttatatattctggttattaatcccttgtcagatggattgtttgcagatattttctcccattcttttggttgtctcttcattttgttgattgtttcctttgctatgcagaagctttttaactctgtgatcccatttgcccatttgattgcctgtgctttgggggtattactcaagaaatctttgcctagaccaatgtcctggacagtttccctagtgttttctttgaatagtttcatggtttgagatcttagtctaagtctttaatccattttgatttgatttttgtacatggtgagagataggtacctagtttccttcttcttcattccgtgttattgataagttaaggacttattcctgccattttgttatttgtttcctggttcttttgtgatcttcttatttttccttgcttctgtcctgtcttcctttttgtgaaggtgattttctctggtagtatgatttaatttcttgctttctatttttttgtgtgtatctgttgcaggattttttttatagtttaaggttaccatgaggcttacaaataacattttataatccattattttaaactgatgacaacttaacactgattgcaaaaacaagctaacaagcaaagagaaaactaatgaaaacttacacttcaacttcactcctccctaccttttaacattttgtttttatttatattttatgatactgcctatgtcttgaaaagttgttgtagctatttttgttaggttcatcttttaatctttctacccaagatatgaatagtttacacaccataattacagtgttataatattctgtgtgtgtctgtggacttgctattaccggtgggttttgtaccttcagacgatttcttattgcttgttaacatccttttctttcggattgaataactctttagtatttcttataagacaggtctagtgttgatgaaatccctcagcctttgtttgtccgggaaagtattcctcctttatgtttgaagaacatttttgccagatatactctaaaagcttttttccttcagcacttcaaatatgtcatgtcactttcttctagcctgtaaggtttccactgaaaagtctgctgccagatgtatttgagctcctttatatgttatttgtttcttttctcttgctgcttttaggatccttccttttttcttgacctttggaagtgtgattattaaatgacttgagatagtcttctttggggttcaatctgcttggtgttctataaccttctaatacttgaatattgatatcttgctgcaggtttggaaagttctctattattatccctttgaataaactttctacctcaatctctctttccacctcttctttaaggccaataactcttagattcgcccttttgaagctactttatagatcttgtaggcatgcttcattctttcttattctgttttcttttgtctcctctctctatgttttcaagctcactaattctttcttttgcttgataaattctgctgttgagagattgatgtattcttcagtttgtgaatggaaatttttagctccagaatttctgcttgattttcaaaaattatttcaatctcctttgttaaatttatctgttagaattctgaattccttctctctgttgtcttgaatttcctcaagcttcctcaaaagagctaatttgaattctctgtctgaaaggtcacatgtctctgtcactccaggattggtcactgatgacttatttagttcatttggctaggtcatgttttcctgaatgttcttgatgcttgtggatgtttgtcaatgtctaggcattgaagagttaggtatttattgtagtctctgcagtctgggcttgtttgtacccatccttcttaggaaggctttctacgtattcaaaggaaattgagtgttgtgatctaaatcttggtcactgcagccgttctgcattgggggcagcactccaagcccagtactgtgagtcttatggactcacgaaggtacagccttggtggtcacggataagatctggaagaattcgctgggtactaggcaaagtctcttgttctcttttcttactttctccctaacaaatggagtctctgtctctgtgatgagctgcctagaactggggaatgggtgacacaggcagtcctgtggtcaccgctgcttggactgtgctggatcagatccaaagtgagcacagcactggatctttcccagggcctgcagtgaccgctgcctggctgcttctgatgttcacttaggctccaggggctcttcagtcagcaggtggcaaatccattctggcttatgtcctctgcaggacagcaggcctcacccctggcccaagtcatgaccagaaatgccatctgggagccagggcttggagttgggaaccttaggaatctacttggttctctattctacgtggctgagctggcatccaagctgcaagtccttcccacttttccctctcctttccacatgtagaagaagtctctcttcatggccaccactgcccttggcccatggcaagtacagcctggccactggctgatgttcagtcaaggctcaagggctcttcagtcggcttgtggtgaatgctctcaggcctgggtcgctcccttcggggcagcagtctcccctctggcccagggtgagtctagaaacgccatccaggaaccaaggcctgggataagaccccaaagtctacttggtactctaccctgctatggccaagctggtccccaaactgcaaaacaaagcccccttttctctctccttcccctgagcaggaggagtctctcccagtggccaccacagctgtgaatgtgctgggtcatacctgaagccagcacagccataagtcttacccagggcccacagtgagaactgcctgtgtaccactgatgtttattcagggcccagtgctcttaaggcagcagactgaatcctaccagcactgggcccttctcttcaagggagcaagtttccttctggcccagtgtgtgtctagaactagggcctggaatgagggtttcaggactctgcctgctgccctattctgctgtggttgagctagtatccaagttggaagatgaagtcctctttattgttccctctcctctcctcaagtggaaggaaaaggtctttcctggagctgtgagctgcactgcctgaggttgggggagcagtgacacaagcacccactttactgtaccagcagctggtgtatatatgtaggccacatgcaccccgagtctgctggttctgagcccagacttgcccaggaattgccatccttgtggcctggactgcctttcaagtttatttaggaccccagagtactttagccattaacccaatacattgttgctgtgatcatctggaacaaactgttattttttctgtaaatgggatggcaaagcctggatgacagcgtatcagtttatagcatggtttatgaatattttaagcccactatcgagacctgctgctcaaagaaagattccttccaaaatagtaagaattgaaaatttttaatttttaataaattaatttaattttaattaaattaattaattttaataaattgatttttattaaaaattaataaattgattttaataatatttaaattaatttaattttaataaaaagaaagaattttatttgacctttgctttttctctaatgctctttctttccttatgtagatctgaattcctgacctatatcattttccttctctctgaagaacatttaacatttcttgcaaggcaaggctactgacaaatttcctcaattttttttctgagaaaatctttatttctccttcacttgggggataattttgcagggtacagaattcttaagtgtgtggtttttttctctcaacactttaaatatttcactccacttccttctattgcatggtttttaggagaagtcagatgaaattcttatccttgctcctctgtaggtaaggtgttttcccctacccctggcatctatagagattttttttctttatgtttgattttctgaagtttgcataccatatgctaggtgtggtttttgggttttttgggttttcttttcttaacatttttagggtttttgctttcgttctttttttttttttcttcatttattctgtttattgttctctgagcttcctggatctgtagtttggtatcttgatattattttggtaaaatcctcagtcattattgcttcagatattgcttctgttcttttctctgtttcttctcttctggtattttcattacatgtatttatatcttttgtagttgttctacagttgttggagatcctgttttgttttcttcagtctttttttttctgtgcttttcaggtttggaagttactgttaaaatatcctcaagttcagagattatttcctcagttatatccagtttaataattagcccatcttcattttcattacagtgtgtttgatctctatcatttcttttttattctttcttagaattttcatctctctgtttacattattcatctgttcttgcatgttgtctgccttttccattagaacctttagcatattaatcataattgttttaaatttctggtctggtaatttcagcatctctgccatgtctcattctggtttgatgcttactcagtctcttcaaactgtgtttttgcttttcaatatgccttgtaattttttgttgaagtactgggtgaaaggaactctgggaaataggccttcaatggtatggtggtattgtgtggggggaaggactggactgtgaacttcacaaatgcttctcagtttttccccaaccttgcttaggtgggacaggatggctacaggggactagagttgggtatttcctcacttttatgtggaaggttagagccagctggagttggttatttcctttcttgcaaataggataggctctgataaaaccctaacaggttaggctcttgtaaaatagtttctcctcagggcaaatcttgttaagaacaaaatgctctggtatatttcagaatggttactttcccttcccctttctagaagcaccaaggggttgttctctagtattctctgtgagaacctggttgaacaaattctggtggtaaaactctggaagtgtggggatgcccccatctctctccctgactgggtttccctggagtttttaaactctcagacttgtccacactgagcctccagcaatttgtcaattacagttaaggttttcctaccctggcactggttcctggagaggtttgtgctccagtaagttgtgattctctctattcacctgcccatctgttcagtttccaaggcagctgtttgtgatgtgacctcatttgcttgataaattggagaaaaggtgttgatttcatttcagccttttacttgtgttaggacagaatggtgacttctaagcttattaagtgccatactggaaaccagaaacccccagacaggattttagtagatggaagaacatgaagatggcattccagaaaaagggaataccatgaacaaagtaatgatcatgtgtttgtgggccagtggagaaagtgacttgcctagactagcagaagcatggtgaaaatagtgggtgagaagtttagatatgttaagtgcaacggattttgaaggatattgaatggattttggatgaagaataatctggactgtgagaagctggggtaatgggaagagctctgctactgattgtgtgtgtgtaaactctcatggggtattgctgggatataagggtctgggtatttgttttagttatttacttaacaaattattttgtagctggctaatttactgaacttgcttattagttctgataggtttttagctgattctttagggtttccttcttagccaatctatggaaagctcttggatttattttcacatttgtatcctttttctgttttcttattcattaattacttctactgatcttcttggatttgtttcattttccacattaagttggatgcttactttatttttgtatgataatttggcatatacatcaaaataaaattaaagtgtgggactagaagcagttggaattttggaaatatctgaagtctcagtagatttcatctctaagattttaaatataaaaagtggctatatacttttaaataggtgagatatgttagcaggcttcaacttaacatttaaggcaaatgtcagattttttattgctgtgaacttattactgaggaaagaaaacatttaaatatttttctccagccacaaatccccataagtttaaagattttgacagaatgccatactttatgtatgttaaaaaattgtaagccaggatcaatggcatgcacctctagccacagctgctcaggaggccaagacaggaggttcacctgagcctgggagtttgaagctgtagtgtgcaatgatcgtgcctgtgaatagctactatactccagtctgggcaatggagcaagaccctggctcttaaaaaaaaaaaagtaatattcagtgaatacaatttcatagtttttaatcctttcaaagtacattaaaaatagtgtgctaaattctttgatacttcttcctccaggaggtgaagcttcattactctccctttcagtatggactgaacatagtgacttgcttctagggagcatagactatgggatgggaacagtagtaatttagcagtgggaaaacctggcagacctcaccttaactatgtgagcaaggttaacgttacttttaataagtcatattggtagcatatgtcccctgatggagtgtgaagggaagggtacatcatctctgtagtattctccaaaatctataacctcaatctaataagtagaaaacatcggataaacccaaattgagggacattctatatgaaagtcctgaccagtactgtcaactatgtcaatgtcatgaaagacaaggaaagactgagaaactgtccctgattagaggagactgagctgacatgacaagtaaatgcactatggtgtcctggattagatcctggaacagaaaaaggactttaggagaaaactgggaatctggagaagaaaaaaagtatgttgtttagttaatagaattgtaccaatgttaacctcttggttttgataattgtaccatggtgatgtaagatgttaacattaggagaagctggatgaggggcattccagatatttgagaactctctggctactattgcaactgttcactaagtctaaaagtattacaaaataaaaagttataaaagcaattaccagctgggctcagtggctcatgcctgtaatcccaggactttggggggccgaggcaggcaggtcacctgaggtcaggtgttcaagaccagcctgaccaacatggcaaaactgcatctctactaaaaatacaaaaattagccaggcatggtggcagacgtctgtaatcccagctactcgggaggctgaggtaggagaatcgcttgaacccagtaggctgaggttgcagtgagccgagatcgcaccactgccctccagcctgggggacagggtgagactccatctcaaaaaaaaaaaaaaaaaaaaagcagttaccactttgcatagcaaagcaatagacaaatactgaaacctaccaaaaacttataaaatgaattctgctgcagttaggtgaaccattgtgtgtggctttctataaactttcagcaagtgccatatgggtgggttcctaaattactgtctttatgtaactgataggtgaagatggtggggctgggaaaatgtactggattaatagaaacatgtttccaggagttgcatgtggagaaggcaaataaaacagcttcatgaataaggaagtgaaaaaaagccgtctcatgttttatgcggcaaggtgttttacatacaactaaattaacaaaataaatattttaagtaaagaaaatgattagtatgtggataaatcccaggtatattaacctttttgcttcaaaatccctttttatgttaaagaaagtaagttctattaattgctgtttgttggatccccaagttaaagggatatcagatatttgtgaacttcctctgctcttctggagaaactggtaacatgggcatagtaaatgtcttcaaaaacctccagtccacaagaagtgcctttaaagggttttgctgatatttttttccctcgaattttaagttagttgtcaggtaactcttatatttatgaaaatggagtatgtaaaagaataaacaaaaaaatcttgcttacagtaattctaaactaaaagtaaggatgcttgggttataatttggccttattattgagctttttgagctgtcagatgaagattattagagcctatctctgggaccttcagactgttatgaggttgtccaagaaggacaccagactccctgctcttgtgctgtcaaaaggaccagtgagcaccaaagagcctgttggacacagggctttggaaagttgggaatgctcgttgctactattttgttaaagccaacaaatgaaaaggaataattagcctttggcatatgtatttggaaaggcttagaatctctttggaagttttcaggcttatcttcagacacagctttgaaaaataaatccgtgatgcatggaaatattttccagctgttcacctgaaataaatggttctgtcaatgttagtgtgttaagagtaagtttcctgtagctcggatctcttgaatctcctcatttgctaagagggagaagatttgcctttttaacagtgcagctgtttcttaaacttcttgagggagcaagtgaatgctttatttaatctgtcttggttctcttgggttttggggtctgtgttttgctgttttctcattaattttggaaaattcttagctctttttcctttaaatacatctgctgccttgttctccacttccccctctctcctcttctgagactatagttacactatattagagtgtttgatatcgtcctacagttctagagtactctgttttagatttttccctcccactcttttttctttttgtgtttcagtttggataatttctattgttctgtcttcaagctctctctttcttttcttggctctgtctagtgtgctaagactgtcaaaggaattcttcatctataatactggtttttcacttctagcatttttatttgactgttttttatattatccatctttctaccaaaaattcccatatgttcctgcgagttgtccacctttttcactagatcctttaatatattaattatagttaaagtccttgtctaatagttccttcatcttggtcatctttgagttaggttctgttgacagctttattttatgtcagtgggctgttttctcttatttcaaaaaactgagaggttaagtaacttaaaattgctcaagatgctctataactgttgttctttccactatgccacactggcttctcttaaatacttattattgctaatcccattgcctttgcattactgaaaattaagaaattaatcacatttaatttatgtataaactgagatagcagtttcaatttggagttccattttgcccatgatggttttaagctggcccagtccctgccctagagaagctttataattctcatgtttgaaaatatcctaggaattatatagttcttatgctgtgaaatctgtgtgttttataaacaaaatcactgtggaatctgattaaccaagaaagtttaaatgctttgttcaaggttatattggtgtgacctattcacctgtaacctaactcttcaactgtgtaccttccacagtttagagtgactggggaatttgcatagctgctgaagaatctctcattcacacttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacacttttaagatagatataaatgtggaccatgttttaggggagaaaaagccataataagcacttatttgcatttgctctctggatgagaatagtggtgctttcgtacattgccagcgtagctgaagactccttcctctctgtggacaagcaggctatactaagccctggaggggctataaattataataccttctgaacatttcaaggtattacagaagacctgcagaaacaattaagcctgagaagttcacttatccccaggctgaggcacttgagctatgattattggcaaaacttgcttcctttctgagtgaattgcaatttggtggacagggtgagatgatttgagacatcttaaattagaagttcagttgtgcatttgtgcctttggctggtgtcctgggtggatttcttaccaattattgttttctataaatcccaaaagctgccgtctccactgtgattatatgtgagcataaggctttggaatgcttaagttggaatgtggtttaatttgaatatgacttaaaagaatatatgatgatagacccagttgggtagaaaaggagataaatattcaggatatatatgtgtttatgtttggcctgatgctttgtaaatttttacacctttcagtttcttgaaaaagggtgattttctaaaacttgctatgtgctggtgctcttaatgctctggaatggggtagaaaaaaggtctgaatttagttaggagtcatggatttggattgtgattctgctccttaatatctttgtatcttagtttcctcatttataaaatgaaactgtcccaaataagtgacaagctggttgtgaagagcagatgaaataatgaatataaaagtgctctgcagcaggtagaacactaacatttgcaaggatgctgatttttaaaataccagtatctatttccaaggaactcacagtctagctggagagaaaaaagtaatcctctgaaacaacagaaaaacaattatagaacagtatataacaactaatgtgtatggcaaaggctgtaagggctaagggatttcatagtaaggggagattggtgataacagaaagtgatcagtaaaggtttcatagggaagatgggttatttcaggtctcataaaatgtaaacattttggctggatgataggagagaaagcagtaacatgaatttaagcaggattgagattgtagtgaatagggcatatctaagaagcagtagcagggaggcagccagctgtgtacccagatgaccaacttctggacaacttgagaaagtcagatacccttgaaagctaaatctgtatttcagcttttctttgagtaggagacattctcattgtgcatgctttgctttcttcttattagttagtggagatgatattagttacataactcaagttaccctaggcttttaactcatggatagaacacttgcccaggaaacagaagcagagtaagcacatctagactagaaagtatctttttccttcacccttttgggttactttacaatttccccatgttaaattttcacatgttcactcccttgcataaatccaaatagcctctggttttgagtggaatcatagatctgaatgaagctggagagatcatatagactagcatcctgcttttgttaggaactgagtttaacttctgctcggataagaaactgccttctttcaaaagactatattggaccaggaaagaatagctgatactggagcaaccctcctgccaaaagaagaaaaaattataaaagtttatttaaaacaactgcttacaggcattgtagaaccactaacacagtatttgagggaataccattcctgagaggaagaaagcacttggaattgagctacatagtcactctggcatcttctctgacggtacttgccaattctctatccaagagtatggggtcccagcagaaagcagcagtcctacaggacttagaggttggagttagggcctattaaagtatttgggatctgaaacacaaaatcccaggagaaagaaaaccacaaggaagaaagtgaaaaatgtgctcgtaatcttcccttagagtgtttgccaactcctaaggtacacatgatcagagcaagactccaagaatcctagtaaaaagcagcagttgggaatgtagtgagcaatgcagatatttcagcagccatatacagtgctggtgagaggttggtattcaaggcctgccaaggtagaggggccctggcaaatacaaataacccaggctttaattggaggcctcagaaagaccacactttaagcataagggaaagctgaaataagctagccctgacatagggctctgacaggacctctgacaggattaaagtggcctgactgtactcttacacctgccaaaagaataagttacagtcttaggaggaagataatctgaatcatccagaacctctacaggttttaaacagaatgtctgccatccaataaaaaattaagaagtgtgctaaaattgagaccaaatgaccaaaatgaagagaaaaacgacagtagaaagatatctacaggtgactcagatattggagtttatcagtcaaaaactgattatgttcaagaaagtagaagaaaagaaggagactttcttttttttattattattatactttaagttttagggtacatgtgcacagtgtgcaggttagttacatatgtatacgtgtgccatgctggtgcgctgcacccactaactcgtcctctagcattaggtatatctcccaatgctatccctcccccctccccactcccccgaccccacaacagtccccagagtgtgatgttccccttccttagtccaagtgttctcgtagttcaattcccacctatgagtgagaatatgcggtgtttggtttttttttcttgcgatagtttactgagaatgatggtttccagtttcaacaaagatatgaaatctacttttgacaagatcaaatggaaattctggaactgaaaaatataggaatgaaattaagaatttaatacatgggtttaatagcagtttaaacaccaaagaaaaagggctagaagattattgaaccagaagaaaagttagtagaaaacacccagattgaagcacagagagaaaaaatactgaaaagagaataagagatacatgagatatattgaaaacattatgaaatatatttcacatatatttatatttggagtctcagaagaggagagtgcaacagaaataatatttaagaaatattgtccgaaagttttctaaaatcagtggaaagcatcaaaccacaaattgaagaagcgctacaatcctcagtgggataaatacaaagggccacacctaggcatgtcatagttgaattactgtaagccaaagacagagaaagcttaaatgcagtcagaaataaaaagcatattgtcttcaaaggtgcaccagtaagattgtcagctgatttattaatgaaaaattggatgaagccagaacacagtagaagtatatcttgaatgttctgaaagaaaattgctaacctagaattctctacctatcaaaagtatccttcaaaaattatttgggtaaaaagaagctttcaaacaaataaaagagtcacccacgaattctacagtgaaataaataacaaaataaattcttcaattagcaggaagatgatatgtgatggaagttcagatatgcattaagaaaagaaagggtaaatatacggtgaaaatttactttaaaaaataatgatgtccccagacgcggtggctcttgcttgtaatcccagcactttgggaggtcaaggcaggcggatcacaagatcaggagtttgagaccagtctgaccaacatggtgaaaccccatctctactaaaaatacaaaaattagccaggcgtggtggtgcgtgcctgtaatcccagctactcaggaggctgaggcaggagaatcgtttgaacctgggaggtggaggttgcagtgagctgagatcgcgccactgcactccagcctgggtgacagagtgagactctgtctcaaaaataaataaataaataaataataaaaataaataaatataaaacatgtcttgtgggatttaaaatatgtagatgaaaaatatttgacaataatagcacagcagataggagagagctgataaattataaaatcgttagtttgagacgtaatataataaagcaatgatgtttactgtagttgctaggaaagctactcaaacaataacaaaagactaaataactagcaacctaacgaagaacaaaaatgtggaataataataaaaattttttgatcaattctaaaggtgagaaaaaactaaagtaacaaagaagagataaataggaaacaaatagaataatcatacatttactcagccttatcagtaatgtaaattaagtataaatcgactatatttgtaattaggaaccaaatatttttggatgagataatatattaaaacccagtaacagattgattatcccttatccaaaatgcttgggagcagaagtatttcagatttcagatttttttttagattttagggaatctgaaatgctccaatgagtatttcctttgagcatcatgtcagcactcaaaaagttttggattttggagcattttagctttgattttttggatttaggatgctcaacctgtatatgcttttcgcaatagacaagctttgagggtacaaatttgaaatgtatatttataaacttgaaatacttacatatatatgtatataaatatacacacacaccccacacaatccataggcacacatgcaggcagacaaaaaccaataaggatatagaatatttaaacaaaattatacccatcaactgcagaatatacattttttaagtgtacatagattatttataaaaataaacaatgtgctggaccataaatcaagtttaaataaattgcaaagtattgaaatcacatgcgttctctgaccacagcgcagtcaaagtgcagtcaaagtagaaatcagtaacagaaagataaatagaaaaaataaaaatatttggaaattaaacaatatacaaaggaaattagaacattgtttgcctaaatgatgatgaaaatgatatgtaaatgtgcaggaagcacttaaatagcacatagcgggaaatttataactttaaatgcctatattaaaaataaagaaaggttgaaatcatgatctaaactttaattttaggaagttaaaagcaaaattaattaaactcctccaaaatagaaggaaataataaaatcagaacaaaaactagcaaaatagaaagaattatgttgtggaaaatcaacaaaatcaaaagtcgatttttaaaaaaagattaacaaaattgataaagctctactaagactgatcaagtacaaagagaaaacacaacagtatcaggaatgaaaagagatgtattacaatagattctacaggtgttaaatggatgtgaatgcacagctttatttcaataaatttaacaattagttggaatgaacatatcccttgaaaaacactgtttatgaaactgatatacacacagaaaaacatgcataatcctatggctatgaaagaaaattcatccataatttaaaacgttcacattcacacacacacacacacacacacacacacacacacacacacacacaccaatccacccacccatacccttgcccagatggcttctttgaggaattcctctaaaacctttcagggaagaaataacgctgatcttgcataaaagttctcgaagaacagaaaaagagagaatggtttccacctcattttataaggccagcataaccttgataccataacctgacttagatattataagtgttgagcaaaacaaatcagacacagaagagtaaatactgtttgattccattaatatgaaattcaagagcagacaccacaattgtaatcagcataatggttattcttagagggatgagatactgactgggaaatagcatgagggaatcttttggaatgctggaatgttctatatctttatctggatactaattgtaagagtatgtacatatgtataaattcattgagctgtacacaagatttgtgcactttatgttatataagacaaaatactataaactctgccataacacatggctattctcatcatcacataatttatcttctatcttaattgaatccaatgtgcatttcacttgctaacattttattttgactgcatttgataaatgccaacttctgatggcagctggcttgaacagcagggagcatatgccctaggcacccccatccctacaactttgggaataaaggaattagcctaacctggagttgactatgatagagtatctagttttcccactctgtctcgcttgctcacttaaaacagcattattttctttataggcccggtggttctgggaagcgtacttccagtcaattaaagccattgccctggccaccctgcagattatcaatgaccggatctatccatatgctgccatctcctatgaagaatggaatgaccctcctgctgtggtaagtgaattccagtgctagccacatgaggcatggtccagctgtcagggtgggtggaaggaaaaatgtactacaattgtaaaggttatttaaattctagctttctaagatgagagtgtgctttttatacttggggcctgataagggcagcataattttgaaacactgacaaaagtaaaaaatacggaagcagcagcttccagtgtgttttaagtgcttagaaagactgtctatttattgcagagataagtaaggaggcatgggtcttgttggaaatcaaagacatcccggtgacttttgcaattgtaatgcttagagcttttgaaaaacttctgtaagcaacgtaataataatagcttgtattttgagtgcttactctgccagggactgtgctaagtgctttacgtgtattacctcaattaatatttccaacactctgtgaggaaaataataagcagaagtgatctagaggcattacggattgctatagtcatttgctcaagattgtggcagaggcttctagctacttccagcaaagagatggagcagtcagaagctgctcttgggccttcctccttgtgtgaaggaatcacaaggcacatgtgtccttgtagaaactgtggcagtggcttctaggcacagcttctttctcactgaaaatgcctgaagttttggagctggaaattactacttcctagctgctctgaagtgaacctggctgtccagctcacagacgtcaaggcattcctgtaagagaactagactgttctccattcttcattctaattgtctctctctttctgacctctcagccctccttgtctcctgattctaccttttctttttttttttttttttgagatggagtttcgctcttgttgcccaggcttgagtgcagtggcgcaatcttggctcactgcaacctccgcctcccaggttcaagtgattctcctgcctcagcctccccagtagctgggattacaggcatccgccaccaagcccagctaatttttttatttttagtagagacagggttggccaggctggtctcgaacgcctgacctcaggtgatccacctgccttgtcctcccaaagtgctgggattacaggcatgagccattgtgccaggccccgattctaccttttctaaatagtgctgtatatggctacctggttaatcttcatataggaccatccttttctctttcctttcctgcccaccttcttccttctttcatccagcctttttgaaatggttactgggttttaggcactctgagaggtgttgagaatacagaaaaaagaagacagttcctgccttcaaagaagctctccgctgatttgggaagctagcaagtaatgctgtgaatgtagaggtcctgtagtggagtagagtggtgtactgagtgctgtggatgcaaaggggacaggcatctctcctcactgggacacctcctgaagagggagtgcctgagaggaagtcagtatgtgcgtatggtaaaaacaacagcaaacatctttttgttttgcttgaggtgaagtttgcttctatctccccgactccattaccaaaggtaacatctcagaatgtaagcataattttgtagttttaaaacatatatgggattatactaaacatgtttttctgccttttttattttagcactagatcatagacttatttttgttttattccatataggtctccttcagttttttaggatggctgtattagtattcaattgtttgggtatatcgtatgtaataggtctattattgataggtatttagactgctttctttttttttcttctttctttctttttttttttttttttttttttgagatggagtctcgctctgtcgcccaggctggagtgcagtagcgcaatgccggctcactgcaagttccgccttctgggttcacaccattctcctgcctcagcctcccgagtagctgggactacaggcgcccgccaccacgtccggctaattttttgtgtttttagtggagacggggtttcactgtgttagccaggatggtctcatctcctgatcttgtgatccgcctgcctcggcctcccaaagtgctgggattacaggtgtgagccaccgcgcccggcctttttttcttctttctaacagtaacaaggggcatactttcatatgtttacacataaatatgtggacatatctacagaattaattccaactaagaaattgcttgaagaaaatacacattttaaatgttgatagatattaacaaattgccctttcaaaagactatattaatgtatagtttcacaaataacatttgggtgttctagttctccatgtcttcagcaatgctgggtacttgaacttttgctcatctcataggtgagaaatgatcttcatgtgtatttttcaagggaaagactgatatctttgtcgagttttctcagataattctatttgtatttttattgttatcacattgcacttttagattgttttagacatttatttgttcagttggtatttattgaatgcctgccttgttccaggcagggtgcttggtactttgaatgaacaaggcagagaaggagccatgcctttgggaaacttgcattgcaatggatctttctatctagaagaaagatttgtctttctggtagaatttacattttatatatatatatatatttgtgtacatatatatattcctttacaagtcttggtaaatatttcttagatttaaaattttttcttatactctaataaaagaatactttctgatcttatagttcttaactggttaccatttgtgtacagacacattttgacttttgtaaattaattttgcaactattctgttactgacctctacagttgtttactttttttagttgattctcttatatttttagatatacaattatatctacaaatgctaattttgcttcctttttccagtatttgaaacttttattttttcttttatctaattgcattggctagtacttccagaacaatgttaaatcatgatttgaatgttaaaagaaaagggtaggtattatctagtcagagaaaggaagaaaaattccatccagaaggaacaacaaattcaaagatacagagggacaggggagcttggtagtttaaggaacttcagagagttcagtgtggcaacagtgaaggaagcttgggagggagaggcagaggatgaagcctggagagggtccagatcacaaaacaccgtgtatcttacataaggcattggagtgttatctgtgagaaacaagtgatcactgaagccttttaaacaagggagtaatgtgataagattgcattttgggtcagtctcatcttagtgtggagaatggatgatgcatggcagtgggaccagactggaggcagtagactgtttgagaaatgcagatgaaaattaatagaggacacatttgagtggtatctggaaaaatggactgttctaattggtaagtgagggagaagttcagaagactgaggtatactgtacggtttatccagatagggaatttggttgcatgaggagtcatgggtgaggatggtattggcgtccaaactcagtctaacagcaaggccctccacaatctacctttctttttttttcttttttttctttttcttttttttttttcctgttctctttcaaagagttctagatttctggcagcacaactcaatccttcctctgtgtgcccctgcttttcatcctctgtgcctttgtggctgctagccttttccttggcacacctttcttccccatcatctgcagatttatacaggcttcagcagctggctggtaaactttctccaggaggttttctcaaccccttcagcaggaagtaactcttagagcatgttatctgtgtttcttttccatcacttaacatgtatagaagtagaatttcctgtaaagttttaagcaccttaaggtcatttctgaccttggtgcttctcataatacctaggacaacttaattcagacaggaagatcttgacatataaaggaaagaaagagggatggagagagggagaaagggaaggaaggaggaagattggcagactaggagttgagccatctaagacacatcctgctggaaaggtagggaaagtggtagattgtttctcatctgtaaagtggttgtaatgagactaacccaatgacttatctaagatcattggcaagttggcaagtaattggcaagttgtgtgaacaagtgataactcaggtcttctacgtgcagattatcttgaattgcctatggaattataggggagcccttgagcctcctctgggctgaaatgttactactgttccaagcaaatggtacaagcttgagatgaaaaatattacatctgttcctctgcaggagaattcatactggtgcaggcgaattcataaagaattctgtctggtcatgacccagacagaaagtacagcaatagtgggactttatcctatacttttatctaaagctctaagagatgtttaataagaataaagggttggaatttagttcttttttataagaatataggtaggctaggaaaaatagaatatgaaattttgcagttttgaaatagatatgttttaattcaggacagaatggtcaaagtgctaaactcttaacaatttgagaggtaacataagcataaaaagcataaatcaaggtatataactggaaaatatattctctatatatttttaactctttcttaaataatcctttttaggatactttggtatttatcacatttctagctcaggtgacaagagccctgatttaaagcagtgggttatacatttctccatcttcagtgaaagcaactgatgggaggcctgaatagcgatggtttatttatagtttacttctcctcttccctcagaaatatttaacctactctagatgagattactatgagcccaacctgcaggggagtctcttctctagattccatcaaatttatgatgtctgacattccgaggtgggagtaggtgtggatcttggtcagtaaatcaaggggtggtctggggttttcagagatacactcttagggtctccagccatgcacagagcttgctcagactggagaaggagaggtgagagttcagagtcatattttggctagatgcagctgccttagtttaatgtaaaaaaaaaaaaaaaaaggcctacgtgtgtcgatgattatgacagtgagaggtggccttgcagagtattcatgtcactagatgctttgtcactcttatctgtaaaactagggtgatgacattatccacgttgcaccacaccctcagaacctgaaaaagtttgacacagtaaaacttggaaataatgttaaagtaatacacctgtctaaactggagagattgaccttttgttttgaaaggaattctttttgaaaggaatttatcaccaagttaaggttctttattaggggaagtgtgcatgtttttatattaattttcttagctgttcatgttaaggctgcctatatttttatgccttttcagtctcttcatgcttttatttttctctcctttttgcaaatatcagcaaagctttgtcatctccctaaatatcctatattacttctaacttttatgtcatttctggtcttgcctcttggcagaccttcatccgcacatctggggctagcctctatagctagggttctccttggacaccctcctcattttacttctgtttctctgccagatgtgaacatatgtaggaggacagagacagagacaagtgagcttcaaacagtgaattcatgtgtcaccaaagctatgtcctctcagtgacagctttttaaaaactaaatgtaatatagtctgaaaattatgtagagtggagtgttttcccatgttatttttctatgatgtgatttaaaagattatactgcatcttatcaatgttataattttatttacatttttgatagatggttttttttccaagtttgctatcataggtaacactaataaagataccccagatttttttcctttctgcatttactttaccagatttaaaacagaaagagaagagagtaggggttcttatggccattgacaaaaattgatgagaaaaatggggaagcatcttaaaatgaattattatacccagaataagaatgaggttgaaaaacaagagctttttctatgaaatctagccagagtggcaacttcactgcaatcaaagcctcagatgaggattagatacttccctggacttcctctaagcctcagtctagctctagtttttgaagatagaaagggcaagggatcagccagatgagagtattgcataagagcacttgattggcaagaatcacccagggggatcagaaatcacagctgtgggcaaaatgtggtagagtgtgccatggggcagtggttctcaatctttagtaggcatcagaatacagagtgctgccactccaccctgagattcagattgggtaggtctggggtaggaacctagaattcgcatttctagcaagttctcaagtgttggatattgatgctgctggtccagggaccatattttgatgtgggatttcattcactgtgagtgtcctaactcactccctggagaaggctcttcctttctcctcatccatttcctcctcttaaccctgcggggcttggattagaggcatccagaggctgggttcagactaaatctgtctcagctacatgaaaaactcagggctgcctatacttagatgtccagacggtggccctcactcacaaaggttgtggttgtacaagcagctgaaaatatcactcagctataaacactaacaagcaataaatcactctgcaagctgaagaagcactagctcggatgtatgaagcagaactctaagttgaaaagataccaggttaacagtctgtgtaactcaactcagcaccctgtaagttgtggaatgtttctctggaatttgaaagcctaccctgccccccaggaggccttcttggcttattctctccatcttcctcctactgcctagatatgattaaaaaaaaaaaatgtatggaatttagaaattttagcttgaatttaaggtaagtttaagctttttgaagtctattgtttttataggtatcacatttataggatcacatttgcacaagtgatccagtatgctaccctaaattccagacctttccttgagtagtaccttttacttctttggaagtgagctagaaagtctcaggatgtcagcagccagggaataaggaaagctgaactgggtctgcagatggagagatgcagaaagacacagagagcttgatctggggccccaagcaaagaacttggccaattctgatggtcagatagaaaatggtaaagaaaatgaaaatcacaagccagatccagatggggaggatagataaagaatatgaaaagacggactcgaggatattgctaagatgatcttgtcaatcagaagagcatactagagcttttgtagcagagataaactaatgtgcctgtgtaacacacatctgcgtggcagccccagtggtggtgctggatgaatgaatctacacacattgtttccttagatgcagtcctgccttcattgcttacttagagttcacttttatggctctagctttcatgaatcaaaacctgactgcttccttacatcacacagcttgtgggagggcagtgagtagaatagtttttcagagtccgtgggagcttgatctggcagcagattaattaagaacatactgaatgttttggcaaagtaatctttcatgtaccaactatcacttatattagcacatcaaattccctttccccttttttcaggggccattgtaattctcccttgaggtctgcttaaatgattcaataatagaacttaccagggaaatgtgataattaagtattataacctcaagataatgaattttgtttccgtttctaatattctgtcctttttatgtgtctcccaattgattaatatttgagtataattttctaataaatgggtcattacagctgcagattaggaaactttacacactgcttcaatgagaggttgattcttgacttttgtgtctcccaattgattaatgtgtctcccaattgattaattttttatgtgtctcccaattgattaatatttgagtgtaaatttctaataaatgggtcattacagctgcaggttagaaaactttacacattgcttcaaccagaggttgattcttgacttttggctctcccttttttttccctcagctatatttcttggttttgtgttttagaaaatagtgcggcttaaaaattcaagtaaaagaaaccatagaatgaaaattagggcctgttttcaaggagtaactgcttttaactctaacttttctctgatactttcttcctatttccccattaatgctgtttttaaatttcttactcagaaacctctttttacttcaagttagcactttttctcctgttgtttctacttcccctatacactcctcctgttccatcttaccgttatgactgtgtcatcatttttcattaaagtggtatttattatatgcattattagagctgtataaatgttgttttcaactgaacaaagttgtaaacaaggattttgttttctttcttgtacagctttctattttccagagagctaataaatgcctgttgttttttcccgcagttttccatgttcctatcactaatttaattttcctggattcccaaacaaaataataaaatgatcaagcacaagtgaagtccaggatttttgtttctttctggagtcatctctcctgtagcccctctcttcggttccagtctgcagtgattgctctccaggtctcctgtgcagtggtcatcctgattctcagttcactgtgacactctgaattccctttgtgtctctgctctgttggattttttatttccatattgtaacatctttctctgttttggtttttttccaaaagcttcttaagaaatggatgaagggagatacattttctgtcaccttacatgtcctaaagttattctggctgggcgcggtggctcacacctgtaatcccagcactgtgggaggccgaggcgggcggatcacctgaggtcaggagttcaagaccagcctggccaacatggcgaaaccccatctctacaaaaatacaaaaattagctgggcatgatggtgtgtgcctgtaaccccagctactcgggaggctgaggtgggagaatcacttgaagccaggaggcggaggttgcagggagccgagttcgcaccattgcactccagcctgggcaacagagtaagactccgtctcaaaaaaaaaaaaagttttttattctgttacacttgtgattaataattgggctagtgtagaattctggttgaggtgggttttcttatgaattttgaaaggattgctccattatcttctaagtttttcattttaatctcaaaaagtgagatgtcattcttattcctggtccttttgtgtgacctttgtaacctttttttccttcctggcaaattctgtgttctaaaattttatgatgatacgccctgacgtgggtgttttctgctagctggatactgatttggacccttttaaactggaaatccatgtgcttcagttgtgagaaatttttgtattttatttctttgattattttatttttctgttttctcttttctttatgggacgtctgttacatagatgacgaatgtgctagactgattgctgtttttcgtaccttaccatctttcggtcttcttctaattttttggatattttctcagttttgtattctgacctttcttttgatttttaatattttgtttacttttaaaatctgagagtttttttcctggacttctagttaatcttataacttcctaattttgttttaaagttggagtattttctctctgaagatattatttgtggtttttagtttttagttttcttcagctccttttattgtttggtttctttgaattcctttttcagtttttgtttgctatttttcttattggaagctttcttcaaatacctgatgattattggcagtctgctcttatttgagagtgaagcactgaaagctgattggaagctctgtatacatgaataaggcttgtcaagcaatgggctccacttaggttaagaggatggggacctgattgcctaagtattggcatccatgggttatttctcttggactggctcattgatcagagaataatctttctgttttgggggttggggaaaggatggataataattctgggctgcaggtattttgggagccgaatagaggaaggagtcgggttctcatccttcatcctacagattattatttaatctgttatatttagtatggtgcctcaccctgctttctgtgcctggggtctctgagtccggaatctccctcaatcattttttctagaatataaacctcccttctcctgtcaaggttgaggggtggggtaacagggagatggttggcctgtgagtgctaagtttaagggatcttgagaccaactgttccttatttctgtttccagagccccttcttccaggataccaagtatctccaatttctgagttttattatcattatccttggaagctttagctttttttttgctttgccatgtaggttattgtccacctatctatattttgtttatttaaattgatctaaaaactatattttctaaattttaactttttacgttgacatatttcagaattaaatttctaaaaatagtacactctttacccagatttcttaaatgtttctgtgtactcttcacccagattcttcagctgtttatcttttatcacagttgctttattcctttttctctgggtacatgtgtatgtgtattttttcccctgaattttttggaagttgcagatataatgcacctttatctctaaatacttcttatacaaaatcacaataaagtgattgaaatcgtcaagacataaacattggtgcaatattattatttaatctgtagatcttatttcgatttcatcagttatcctaataatgtccattagaacaaaagaaaatccaagaccatgcattgcattcatgtctctttagcctcctttttaagtctagaacaatttctcagtctttctttttcttacctgaaattgacatttttgaagagcacatgtatttctgtaagacgtcctttgatttgggtttattattttgtaagttattttgtaagatatcctttgatttgggtttgtctgatgcttttgcatgatgagattcaaattatgcattttgacaggagtgtcatataagtaatgtgttctcaatgtatcatattggagaacacatgatgtcaatttgtcctattactggtgatgataacttggatcacaggtttctgggagtttctccaatgtcatgccaagttactacttttccttttattatgtgtcttgtggggtactactttgagactatgtgaatatcctgttactcctcaaagtttcacccactagaattttagcatccattggtgattcttgcctgaatcagttgttatagtggttgccaaatagtgattttccagttcttattctctatcttctcaaataagttactaatttttttgagggtgatttgtctttttaaacctgaagattgttgagtttaaaggttcttctttaatccatttttggaaagttttcattctctctttgaatattacatatctgcaattctcactaatctttccttctagaattctattaaatctttgttaggccttttattctgtccttaccttatgtctctcagctttgttttgtttcgttcatcaggttttccacatttttctctctctgtgctgcatgctagataactttttcacatctattttcctattttcttcatctttgactaatgtgttttttacccattcatcatgatttaaatttcagtggttatttgtagaagttctatttgattatttttcaaatctgtctgcctggccttcttcatagcatctttttttctcacatttttaattccttcttttatatctttaatcatttgagacacttactttatattcttcatccaattttctgaattcctgtgaggtctgatcttgtcatttgtctactgtccactgctcttgttgcattgtttccttagatgttttataattttggaatgtgagttcatctcacatgtgaggttttctgtggaaattctcccatcctgggataaggaggtattttccagagaatttgtttttgtttattttgcttcttcaacattaatgtctcactggaggtttctgaaccactcagataattcattgaaaccccaaacctgcatgagccccagcctctgttaaaagctcccaagggaaacagagctgacttggttacgaagcagtaagctctttctctttctgcaagttggtgaaaacatgctgttccagggaattttattttttcatgtatcatgatatttacgctgggaagccttgttttcccatgttatagagcattcttggtttaataaaactagctaaaaattacattttttcttaaagtaagtgctctttccacgtgagaactacttttttttgtttggtttgaaggtaagaaagggaggaggaacttttctctttatataattacattgagggccgggcgcggtggctcacgcctataatcccagcactttgggaggccgaggggggtggatcacgaggtcaggagatggagaccatcctggctaacaaggtgaaaccccatctctactaaaaatacaagaaattagctgggcgtggtggcgggcgcctgtggtcctagctactcgggaggctgaggcaggagaatggcatgaacccgggaggtggagcttgcagtgagccgagatggtgccactgcactccagcctgggcgacagagcaagactccgtctcaaaataataataataataataattacattcagcctgtgatgaagcatttgattattagacagcaatgtcactgatcagttttttaagttgtcagcaattaattgtaaacactagtgtagtactcttcattatggtaaatacagttgtcttaagatgaatggctcatattttggtacagtgcttgatgttcaaaacaaaatgttgcaaaacaataagcaaacataaattgaaagaaaaaattccccaggaggattccccctcacccacatcaccaagctcaggttgagaaagaaaagtgacttttgttgcttctgtgtactagtgagagactttttctggcccactctttcactgattgtataggccttcaagggatctggtttaatgtacaagtctcacttctaacttccttacttcctgtgcccaaaaccaagtctcctgttccagcatgagcgttaaaaccaactacattgccaacccctgcaacaagcttggccctctgcggtgccacagtgccaactagctcctgggcgttcagctttcatttgcagttttttcttcatttttggtccctagggacttatcttttccagtgacctcagctgtatatttaaaataatttttgttctattttatactacatttctatgttttatagcaagaggattttgaaaaaggaaggcttcatctgttttaccttccaaaaatttgttgaactctggtccattcttgtttccaataaaaggtttttttttgcccttgtgggttcatgcctttttttcaggaagaagcagagatggagcacagcagacaaaacatatgctttattggaattccagagaaattaatatttaagaaatcactttattgtggagtctcttctttccactctgtatcaactttcattttggtgttaggctcctaacagctcaaactatacagaaactgtggttttcttggttataactgtgttggtgttttgagcttggatgccataagctgtaatttaatcactccccaaagttcttatttaccaagccaatgaagtcttcccctataccatagatgacctctctaatatggtcaggggctaccaacaatcatttttatgcccagatcagagaatgagctactctttcaaactgtcagagcatttcaagtatgggagaatcagttgaaactgtaaatttgttttacctctcataagatgtagtagtataagccatcatgaacattgttggacactttgtctttggtttatagattggctttctttgtttgaatcagataagtcactagttttttcactgaagcatttaagtattttcagtgtatttatgaagtagcaggtccaaggatgatgattgaagaccttgttctaaataatctaaatcttttgtactgtaaaacagctgaactgttatttttaacatatcaaattataaaccaataaaatcaatggtatgttatctttgccagtatcttaagcaatcatactatagatatatttagtgaaatttattacttgcagactgctgtaactcatgaattattaaaagtatcagcatatggaaccctctcttccctcattccaaattcttttaatatggcttatgttgaaccatttaaatggtttctgtccatcccactaatggaagctgcagccagatgagggttcttataaatgattggctttctttccaagcaagaggaggatgaaatgtcaactttttcctctactacctgaaaagcaatcagtggcaacctttcttgctctccttgacagtagtttggctttatggaagaagggtgggcatttagccaaatgtgaatttcagtgctatatgaagaaaaaaattgacgtagctaaaactcagataataacaggaattttcaagaggcattcaaatgggtttaacctgtgagccttccagtaaactaactgtagcccagaaattcctaaactgcacgtttcaatcccttttttcttgaggatgatctgagtgacttgaggttacttaccaaatctctctttgcaacaatttgcccatctgtaggactgaaattagggataatgatagcttcagaagaatagtgtaacaattagcaactgattattttctgatcatatgattatctgattatgtctgattataattaaggccattgcaaaggacatttggaatcaaacctgagctcaaaaccatttattagcttgaccttgtacaaaatttccttccttccttccttccttccttccttccttccttccttccttccttccttccttccttccctccttccctcctccctccctccgtccctccctccctcccttctgcagcggcacaatcatagctccctacagccttgacctcctgggctcaagtgatcctcccacctcagcctcctgagtagctgggattataggtgtgcaccacatgccgtgctacttttaaaaaatcttatttttgtagagtgcaatggcatgatcacagctcactgcagcctcaaactcctgggctccaccaatcctcctgcttcagcctcctaagtaactaggaccataggcttgcaccactatatccagctaattttttttttttgtagtgacagggtcttactatgtttcccaggctgatgttgaactcctggcctccagctcttgaactcctggcctcgagcaatcctcccaccctggcaagtttcttatctctttgaatttcattattcttatctgtaaaatgaggatacttatttcagagaactattctaagaaattaatgatatacatggaagcattttgtaagtggtgtggagctatgagaagtgaagtgttgataattataaggttgatagtataatgctgtatcacatggaaacataaattttagaattgggtgggactctggagaggaaaattaaaaatacaggagggtattttttgtgcccagataggtcttattatgtattttctcttgtttattccttacaacaaaaggtagcattccgttagctctattcttacagatgaaggaagtgagacatatttatattcaaggcccatccactgatcacctctttttttaaatgaggaaatggaggtccaaaaaagtatgttgattcatctaatgcagagattctgtgcccatcattccatctattatactgctttcttttcatataattgttttcatcttgtacccaaatttggcccccaagttaaacagggaacacaatgacacataagtacagtggcagtgtaaatataaaaaagacttctgtccctggctttctgataggttagatatgctaagtgacctccttaagtgaacaactaaaatattgaatgaagtattataaagcaattttaacctattgctgagctggcaggaaagtaaggtatttgctaatccccaaatcaaagtgaaacttggtatcctgggaggtgagtgggagccaaaatcagcttttgccatggagacttttgtagaccttgatgatctggagctttgacctggtaactctgtgaagtaagggacagggattaggatttaaatcctgtggcccatccaactctcacaagaacttcttggatgaagctaggaaactaaaagattatgtcttcagtgaaagagtaaagaaggagtaaacctgtctgtattgacccttgtgattaagaactgcaatcacaagccacccccacatggattcatactacagttatcatccaaataagccttatgaagggaatttagttgaaagtggctttgtattgataggaaccagcagaagcagacacaaaccctgtcataaggaccatattttcagtccaggtctcaaataattcttataaattaagtgtctgaggacaattagcagctcacaaccataaagctataggcaatattgtgagcgagaactaccagaaacagacatgcaagggcttgcaattattagattagattattagagtcaatgaaattgttcagaatgcagcccaaagagacaaagaggtggaaaatatgaagaagtgaagtaatatagagaacagagagagaaggtccaacatacgtctaagctgagttccagaagaagaggtggggaatggaaagaagccctattgaaaggatcagagctgagaattttccacaattgttgaatgacacaggccgcagatccaggaagactagcagaccacaagcaggataagtaaaagtaaatttacagcctggtaatcataatgagactgcagtaaaccaaagaaaaagcaaagatcttaaaagcagctgtaggaaaaagagaatagcagtagacatatttggcctgctcttgtgaccctgagttagtctctggctcagtttcttcagatatcagtcatggtacttgttagttcagtacccccaaatgtgatgccaccatttagaaaactcacttatgagcaaattgctgtaaataggtttcaggagctttaagttgataattaactatcttacttagttgaagccttaagaggatttctagcctttgattttctccatttttcacatgtctgtttaatggttggtcagtgagatttggccttcagtgttattcttgtttttcagaacagtcagttattgtattagtctgttctcacatcactgtagagaattacctgagactggataatttagaaagaaaagaggtttaattggctcttgtttctgcaggctgtacaggcttctgcttctggggaagccacaggaaacttacaatcatggcggaaggcaaaagggaagctggcatgtcttacatagctggagcaggaggaagagagaagggggaggtactacacacttctaaacaaccagatcttgggagaactcactcactgtcatgagaacagcaagggggaaacccacccccatgattcatttatatcccaccaggcccctcctccaacattggggattacaattcaatgtgagatttgagcaggaacacaaatccaaaccatatcagttattatttgagagtgaaatgaaatagacatgtgcatcaggtaaacttcagacttgtccccaaaacttttctctcttgagctaagagatgctacttgaagacattgttaggtctcagtaattctctagttttgcaagtcagcatgtgcctggctggtggagtgctgtgctgtgggtatttggggctgtagaggtttaatggttaaggcaacatggaccacattactgattgcccctttcaaatctcccagtaaccattaacataaatatcatctcaccattttggacaagggacaccacccttatgcacgttagtaatatgatgctaatgcttaactctttcattgccctgcttcaaaggccttgtcctatatccattgatagggagtctctttgaacctaaaggagaaatgaaagggttaactccttttggttttgccctttgaccacttctggatgagaggcatgatgaaatacttttcaaagtcttcagtggaaacacatcatgcataattggagcaaaaaagaataaatcaaagctttttttccccttttagtctggtaattcataattgaaaccacattgaggtaagggttgataacttcaaaacaaccaagaaaactgccctttctatcaaggtaggaataggtaaggcttctcattactaggtgctgaaaagcttctgtatagcaggcctgtcctcttctcttcctttcttctctgtcttctcatttttctgtttaggcaaaatacgttcatttaaatcagatataggttgactcaaatatctgctgaattctcttattttcacatgaagttatacatagtgacaaaaaatctctgatgtgatgaggaatagtaattaaaatttggatcatcctgtattgcagcttgatttcttcagtgctacagtttggtttggtttaggctgaaagagtcttttagttggtaatgaaatgtggttttccttgctcttgatttcacaatccgagtagcatcagcaagaacgcttcagaatggctagcaaaggccacccgtttaccacctttctctgctttctgtatggtaaccctagaatggttttggttaggctcacacagctaccatgacctttcaactacaagaaagcaaatcaggattgcaggaagggctcaggcaacttcctgtgtttgggaatgccaaaggcacaactagttgcttgagtttgaatctctttcctgaaggggaaacccctttgaactggtagctgactttaagcttagtctcccaaggcctttccttcaaggcatcctgaaacctgagcccacacatccctctcactagtgtctgcacactactagttcttacaccagggctttgcagaataaaagaacttttctgcagctggcattgtgacctgacagttctcgtggctgttagggattacttttatgcaattgcaatttaacaatgtgagatttcttattggcgcttctgtactgaatttggaggagtgagaagtaaacggtgggagaatgggcaagaggtgagcaaggcattttggccaaaggccagcacattgtcagaataatacacacttattcttttggtatctcctcctacctttgagtgaacaggttcatccagtgtatttgaaaattgcattgacagccaaggttttgaaggcatagctgcgatagatgagctttgcctcttctccagctctgttgctggatgcctggttttatgccctatcttgccatcatggagatttaatcaggtagcagagttaattgccagcattgtttgccttttccctggcagaagccagtcttgagtaaattatggaggtttaaatttgcttgatttcatgcagaaagtggggtcaagaggtcccagactgtagacactctccttggtcagccagcagggggtcagttcttaaaggtatttcagaggtgactaaatgctgtttttgaaatgttcctccccaggaagctttttttctctggaggttagtttgctgaccttaccctagtggggtggagtgtctgtgtgaaggtaacaccccaattaaagctgcctttctccacgctgtcactgagctccaaaggcaaataggattatgcttgaggaagggaaaagcaattgacacagaagcttagttgtagatcagcatttcctatttatgactctttgaaatagagcataacggtagccatgtcaatttgtcactaaaacaatgaccaggaaaagaaaatttcaaaagaaacgaaaaagctagctgtgtaacttaaaaaatatatattatttaaggcttttcacaatagagctctaacctgccattacctgagttcctctcatttctgctgtctgacctttctcctcccagcaagctgtgaggtgccctgttggatggctcactgtcttgtcagcaaatctttgcacatgccgctcagcttgcccctaggcttctttggccagccctctcctgcttcttcttaaaggcactgctcagacctcctcatctccaggtagggagaggtgattgtgtagatctcggtgtttccacctatggagtacctttcattctttgtttactacttgttagtttacattgtaatttgtgtttttactgtgctgtcttccccactaggttatgtgtgttttgagaggaaggaaagtgttcatctttgcatctttaacactataccaggcttatagtgtatgttcaggaaatgttgactgaatgaatgagtaccagaaataaagctagtgggaatgattgctgaatcaccaataccagtgttttagtaggcaagatgaatacaaatcgagaagagtggaagtattttgtttgctttaaactctaattcataggatcctgtgttgagccctctgctaaatgtttatgtacataatctcgtttaatcatcattgccctaggaggtagatactatcatgatccctgttttacagatgaggaaactgatactcaaagaactgtacatgtcacaagactagtacatggcaaggcccagattaaagccctctgttaaatatctctataaaatcctacacttcttcagaacacagcacagtaagattcttggtaagtatgtataaaatgagttaactaggttcggagtcatttcaaaactcataattttagtcatttaaatgtacatcagctattcatatctatacataagggggactgataaaacaggcctgagtcatttggctttaacttacttctttaaaaaacaagttttgattgaacaactaggcattgttctaaatagtgggtgttctggctcctgccttcgtggagctttcaggatagccaaaacataatgaatagaaaggaaaagagaaaatcatggaaataaaaacagtatatttggacaggaagaagtagaggtagagaatccaggtaaaccaggaccttgaaacatgataaggtaaagagagggagaaataaggacttcatttgggattcttgtactgcaattcatttggaattcttgtgctgcaagagatctcaagactgcttaggctacctcctatccacttttgagacacatggaacgtaaagcctggagaaattataactcacacaagatcaaccattggctacaatttattgaatgcttctacatgacagtaccttacatatattacctcatttatgctaagtaatactacctagaaagatggtaatagttatatgatgatttttatagacagagaaactgaggtacaagagagattaagtactttgcccaggctatgcagctggcaagtgaaagaacctggattccgattaagaacttgtgattccaaaactgacttcaaacatgctaactcaattttgaagccatttgcattaaccctggtggtgtgttctacagtaaataattgagcctgtgtttgagtagatgtatgcttagaagcttacatactgcctcctgtgttcatctccacttctggattttaagggacggtattggcaagatccagttctccttatgctcctttccatgctgtccataccccccatgctgccttccctgcttctccagtactcaagccctatttgggatgcaagtgggcagtggggaaaaacaacattaagaaaagttactgtccacttcccagccaaccattccttcctgtccttcctcctcccctaccgattcacttcccaagtggagctggcatgtgggatgagacccgatctgttgtcttgccagcgactctggttccatgtccctggcagctccttgaaatcagagctgcgatgcctttcagggctgcctcagtttaaatgccaaggcattcgttttgtgagcctaagctttgcatctcttagggaattttcctctcttcttaatgtcataaagacatttaagtgtgttggcattctcccctcttctcccaaagaacagacctcattctgttggagttttaatagtttttccttctgttttagtggtgtatttacctttttaaatttatgtgcacactttgtgtcagtgttatatattcggtgtgtttttattccatagactttctgaaatcatagtgtttggggtgggttcttgcttattggcccagattttattaacaaggatcaagaacttttaggatttttgtcttagaaaagagctagaagtagcaaactctggagttccccacacttgaattttccaaagtctataaaatggtaatgcatacccagtttgggtatgtatgtaggagggcatagggaagggctgtgaaccattaccgtctggtgttctgaaatcagattgcttgagttgtatctcagttccatcacttacaggttatatagccttgaacatcatttgctatttctagttctacagtttcctcatctgtaaagtgagaacaataaccgtatctatcttgggggttgttgtgaatatctaatgaggtaatacatgtaaagcacagtattttgcacttagtaagtactcagtaaatcttgactgtttcaatatcacacattaaatcattttatacacttttttaaaggaatctttttgtttcttttccacttaaaatggtgtttttcaagcaggcattagtgagtattgtgtcaagagggttaggtgagtgggttggggatagtgatggcacatagaccatgaacggtccctggggattaattatgacttaaatatagggctactttctgacttcagtttccataaaggtcaggaagagatgaagaataaaatttggggtagaaaactcaaaaaggtttctagaagtacaatgagttgctaaggtacaaatactaaaatccaggcaccttcctaagactacagcttaatatcaaagtgtgatgtcatggaaacagaagatcaacattgaaaagatggcctttcctggccgggcgcggtggctcacacctgtaatcccagcactttgggaggttgaggcaggtggatcacctgaggtcgggagttcgagaccaatcttaccaacatggagaaacccggtctctactaaaaatacaaaattagcccagtgtggtggtgcatgcctgtaatcccagctacttgggaggctgagacaggagaatcttttgaacccgggagacggaggttgaggtgagccgagattgcaccattgcactccagcctgggcaacgagtgaaactctgtctcaaaaaaaaaaagaaaaagaaaagatggcgtttcctattgtgtctcttggttgtgaaatctaattatagcatgttgtggacattttggctttaatatcctgattacattaggaccctaggaatcccattcagcttctttgagtttccatcccatatgtattccatgggtttgtgtgcatttctcatcccacactgttacatctggcagacagctgttgtcacaaagttggtgatgggtgtccatcagtgatatggatgagattgatagggaaccttggcaatcccagagtataaaagactagggaagtatgcagcagccataatagcagataggacatttcattctcagccaccttctggcaaagatggaattcagtcctgggctttttgcatgataacatatgaatatgaatgtaattaatgccaccgaattacacatttaacaatggttaaaatggcaaatttaatattatatatattttaccacaatttttaaaagtgaacaatgtaatataccaaaaccattatatgctttaagtgggtagattgtatggtatatgaatcatatcctaataaagctggtaaaatatataagaacatttaaataatcttaattattatcagtgcaaaaatatttttgcttacattgctgtattaaaagtacttaatattttaatggtagcaaagagattgactttctttcatcactttttaaactttattttaaaaacatttcacatttaactgataacttttgagaattgtacattgaactcacatgttcctcacctattttcacacattgtgaacattttctctttattctctgtgttcagaaatatgcactttgatatggcagtggtttttgtttttttatttttgtctttttaaaaaattcactgtgctgcttctgttaatcctttgcaatctgaaaattcatgcctcttatatcttaacgtactgagaacttctttaatttctttgatagatttacttctcccatagtctgtgttttcttttctggaatctcctattaaatagatgttggaccttctagattttctcattttctctgtccttatttttcatctctgcctttttgttcaccagtctggaatattttgtcatctttatcttgcaatcctgaccttttttcccccgactgacaggaccaaccaggtagcaatcctgccctcaaaaaataatttaaactattatatttttaatgttgaagagttgtttctgttctttggtagagcttttaaaataaaaatagcaatttattcttgtttcatggatgaagaatcttatctgccagtggctacaatttgttgttgatgctgtttgaatttccttctgctgcttctgttgtttctgttacttctaagttcctttttttctttattcatttggtttctgacattcatgctgaagatgctcttgaaatgcctgtgattctagaatctgctcatgattgagagggaagcgctgaaaagctgatcggaagttctttgtgtgaaggccagcttgttgcctggaggacttcactgtaagatgttggggtgccgagctaaccacatggctaccaatgctttgggaactaaaggggaaagaaggctgtagggcccaccattcagaatgtagatttttagcctgtattttcctctcctctgtgcctgtatttccctgtctagagcttcagtttccttggagaggaaacctcccttctctagctggggtgagggaagagtcgtttttctggctgagtaggatcaagggagggtttgtgaatctgggcctctaactgctccttaaacagatttttaacagtcttcctgttttcaaccttaccgcttctcttacctcacaaggtatctgtgagtttcattcctgaaccctgtgaattcccaggttggcttgcttgccatcgctgcctcccctcctggtaggtgcccaggtctccactctcactcctcctctgctaccccttctctagccctttccagctttcaaaaatatcgtaataggcccatcagctgttgtctcttctcccatctctttgtccttgtagatttatattcttttatattcatcaactgcctttttattgggtttggggagagaatggagataaacgcatgctttaatctgtcatgtttaactagaattcttttctcagctgcaaaagttctcagctccttttccagtgatatcagaaccaaacttaattagtccatgcaaattttgaggaggggaagactttgagcagttgcttagctctgggatctgtcctggtaaaagccaccaagcctgccatgtttgggtttgctgacgatattgggtcagccatattgttacagctgcttttctgacccgtgttaatctgtcctcttgtagaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaaggtaagaagccttagtgcctctctcagctggatcaattttggatggccaaattattcacatcctttgttttaaataaattttcctgctttgtcaatagcaataccatttctgagacagcatgcctccatttttctcagtcatctcattcttgttctagggtggcccatttaactccaagccctggcatactctgtagccacaagtgtttgagggcttaggaatcaacaggatcaaaggctatcagccttaggaaaacagatctcagcttccctcagccatctcagctgatttgtttacatgaaaactcagtttaaaaggcattagttttctcctttcttatctctgctctgatgctgtactttctcaaaaaaaaaaaagggatggcctcacttctgattggaaaagtcagcagcaaagcataccctgtccagacttcaagtcaggtccttaaagagagcaatcactagaagttcccattggttcttccttaatcactttgttccttgccttggccacccctgtaatctgctggctggcagctagggttgaggactatttgattcattggatttgtttttaattcgggacgcacagagtatgttccacctgcatttggtttctcattcagtctgtgtattactgatcctaatcccagggacttcaaagctcctgccatttatagcctattaaagccaggaagtttctgatggattagagcaaggaatgaatgagtttgaagttagtaatgtgcaccactgtcaccgataaggtctagtttattgcctgacagtagtatctgcactttttatggctagtctcttttaattggatatactgaagtcgggaaagtcaaccttgaaaattgccagtagtagatctatagtctaggctggaagaagtccatatttctggctctgttaggcaaatcagaatttgccttgagaaaattctttagtttctcctttacttcatgggatgtttgttctctgagagaatcatatgctttctttttagatttagggagccacagtttgagtaaataaaacagctattttaaatgaaggtcctgtattattccctgatttttaaaaattaactttctatgccaagatttgttttctctttctcaacactataacatggccagttttctggatttttgttttgtttgatacttaataagggagaaggaaagggaggggtaaaagaaaaaggaagatgtgggcatcatttaagaagggaggatgagaatacagaaaggaaggaaaagagagacaattataaggaactatgtaaagaaggaaattgttgacttggatttcttcataccaattgcctttctccagagtgaagtgaattggatggtattgcattgctaattagtcccttcgtttataaaggatgggctatgtttgcagaaggaaggctgggcctctcattgggtctggagtggcctgttgtgtcttgcagtagtcacaggcctgtatttgctcctgcatggaaaggccaccagctttcagagagactctcagcctgctcctgcaatcctgcctgaaaggcagagttgcaaattctagtgctaaatgcaaaagaggcttctccttattactcctggttagccactttaggcataaggtgagttatttattgtgaatttgtgtcacttctttggggaaggtatcattgcaaactgtgagaaaggatacatttttttttccttcttgatctaagcctctacactggcacaactaaaggcagtagcaggagcccagattttggagttgggtgttcagttttaatttttggtaagaccctgctaaaatgtagtggttaattttatgaccaagactttagtttatttttaaaagattttgactctagggaggaaaaagagcccttaactgatgaggccctaattttgacatgtgtagtgactggactggctttttactaacagtggtttttaggtcagggctctggctctggcgatgtggttgtttggggagaacatgaaccatgtttaatcttctgtggggtgtttgttcagttggtaaatgaggctgtcagctctggtccgcatgccagcaaatgcatctgatttttcacgtacagcattagtaacatatatattataaaaaaaaaaaaaagcaagtccaagtctttgaaatattagaggcaaaagtgatgtttttcgctttctctacatttactaaaataaatattgtggttaccatgtctgctgctgggaggatttgtgtaggcagaaatctaccccccttcccacttttttttttttttcattctccaacccaaccaaatacttttttcttttggttacacttaagtccaaatttctgggttttaagtttaagtaaatacttagactaggcaattgaaatttccagtgagctttcatcacattgattttgagctttgtcagaagaaaaggcaggctactgcctttcttcctttaactgactttagttttaaatttgaattaacatcaggagccccccagcttcagactgtggtttgcatagtccttagcaggcagggtggggttggctgagcatgtcagcaacccaggatggtcaacaggggagtaaaaccagcagccaccttccttttgagccgagttctaggactgcggggagttgggtcatgagaccagctgtacaccagcaactcaggcaattctgaagtgggcttaaggtttgtatggaaataatctgataatttattttgtgaatctgtggttgtatttatgatagtgattggcaggatggacttggggtcatcttcagtcaacctgaccatttttgtagtacctttgccaagttggagaaaaatgtctttgctcacatttctcttggcatccaacatggagaaaaccgttaatcaatatacttaaaaaaagaaatccttaacacaaggagttctttttctcctttgagctggactaaagctcatactgtgaagttatcaggtcacctggctcagctgtttgtttttcataaattctgcaacgcatttgaaaaatcgtatttttcaggctactttgtatgaatggaaggtgacatttctatttcgtctgttataggttcacaggatgagacataagatacaagggcatgctgtttcatttagaatttaaaggagtaaggaagaaagaccccatttaggctaagcaatagaagttgggcctgaagatttctagctatgacacagtttctgtctgcattctaggggtcaccccatattcttctgtttagacctcttcatgttatcagtagagaagtgaagttcataggacttcacaagaatccatttgtgaagatgatagtgatataaccatattgtatacttttttaatcctaggaacaggaactgtgctacatgcttattatctctagaccttaggacaaacctgcaaggaaactgttgttattcccattttacaaaaataagaaaaatgaaactcagattagtaatttgtcagaaatcagcacagatctttctagatccaaagctcatgccctttgcactaagcccctctgtgtctatttagattaccatttagttgtaggaaaatcatcatgtgttgtcagttctttgatttgggatcatatagaagaactagatctttgtcagggactcagagagacagaaaagtaaatctatttttttgaaaaaactaatgggaaagaaaaatcctcttttctttttcacatatgtttttctttcctacctcattctcccttctccttctactgctccagtcctaatttttttaaaggttacctttccagaatcaaaattccatatcaggattatctaaaggcaggatataattttaatgcttattctttgattgctaccctctcatttctggcctccacgaaagggatactgtcagaagcctgagagaatggtacttctctttcatggaggccatttaatttgacaaagggaaaacatgaaactgagaattctatttagagttctgcctggtggtagctgatcactgaaatggagatgccttttgccaaagccgacttttggctactcagacctaacttgcaacagggaaaagtaaccatgtatcttaaaaagccatgattcattctatatttctacctgcaccccatatcatcctcctgggtcttcattgttctctaaaacttccccttcaaagactttacagaggcaagttagttctttgtggacatggtctcaagtaattctttggacatatatagatgaacagtgcggaaagctgtctatgggttgaatatgctatacacattcgccaattgtaagtccagattccatccagtatagaggtacgttcatacttaatcaaagtagctagcctagtttctctacatagtggaaagaggagctgcttgttgccttgtggaattaacatgaccaaagttccatgttcttttgttttattagtgtgtgagagtttagaggattcatggcagggatcttgcttctctcaaagtggatatggaaggcctgggccaggggtataccactgggttgtcagggtgatgtaccagatctcaactgtaccactttgacactgctacctagggttcaaaaaatgctctggttctgtaggtagacacagactttccagggaaagcatggctgacattttagtgactacctccagtgtgctgggcactgtgttgctaaatgcattcccattcaccctcacagtcaatcatgtcaagatggtgtcattgttattccttcttcatagttgaagaagcaggctcagagtgtttaacttgttcaaggtcacatgacaagcaagtggtagacctgggatctgaagctgtttccaaagactgtgttctttctgtgatgttttgctgcctcatggaatcctaaggccatagaggcatcttgtttagttttccacctgatgtcaagtagaaatctgacctaagttagtgcatttgaagtaaaagggcatgttgtgctgctgaaggcaacacatcttagaacagtttataccatcaggaagttcttacctattttaagtctaaatcagtttccctgtaacttctacccttccatttgtcatgcttctaactctagagaccatagagaacaattcccttttcattcgataatctttctgatatcccaagaatattagtcaaggttcattctggagacagaaaccacatgataatttgaacaggaaaaatttaatctaaagaattattaactagtaacaggatttgcctactacagggtaaagagaactctaaaggttacagaaaataaacttgggagagccccttccccagctagatctgagattcacaccttactaatcacatccactggattagtaaagtttactgaggtgccacaggccaaacttgacaagcaggaaacccagtcatgccctcgtatacacacagaattcaacagaaatctgccccaggagtgttattgaacttgctgggaaactggctagggctttagtggagctcacctggaactacccacagggagaattgtggctgagttgctggtggggcatccacataacttgctgggaagcttcctggaggggtgctgttaaattcactgggaagccagttggggtgtgctagaacctcctgggaagctgccccagggaagaggtgctacttacacttgctagagacaagtgcccctgcctgcctgcctgcctgcctgctggccaggcactactggagcaagaagtaaaaaaggcataccagaaccaggaagaaagccacccccatgcgctgcactggcccttcagtgccctgtactgacacagtgtgacgccatgccagttggcaaagaagagatgtttacagggtccagttcagctatcactaacagggcaatgatgactacagttgaaactgagaggcaataaagtgataagtggcacacttagtttctttaagcattctgtagaaagcctggatacagatgcctgcactgtccttgttatttcttctcaactattttctgggcttgttggtacttcttttaatgttgtggtacccaaatctgaacagagtctaactcagcagatttcagagtgtaatctgggtaccctgagcatccctgagatcctttcaggagatccaggacatggaaattattttcataatcactctgagtcattatttctctttcccacttcttttattctctcacaaatgtacagtagagttctccagaatctacaggtcatgagtgacatcatttcccacagctaatggaatgtgtgctcatatattttcatgttttaaaatttcctcagttttaatttttaatacagtaaatagacaatgtgtttgtgtgtgtgtgtgtgtatcctatataaacaaaatctctttgggattttcagtaatttttaagagcatgaagggattctgagaccaaaaattttgaaaaccaccggtctggtaggtagggctataacctccttcattttagatgttacagggcggggtccccaaccctgggccatgaacccgtagccatctgtggcctgttaggaaccaagctgcacagcaggaggtgagtggtgggtaccacctgagttccgcctcctatcagatcagtggcagcattagattctcactcaagcgagaagcctgttgtgaactactcatgcaagggatctaggttgcacgccccttacgagaatctaatgccggatgatctgaggtggagtagtttcatcctaaaaccatccccgcccctccttcccctacagtcatggaaaatttttcttccacaaaactggtccctggtgccaaaaagtttgaggatgactgttataatgtattcatattttataaggatttgggaatggtagatgtatgacagggattttatttatctgaaatagggagtggggatcaagcaagaataaggatgattgctggagaaagtgattgaaccttactagttttgttccagatccagagaaacatgggattctgaagctgcaggtcctttttggtcttttaatgctaaacagacttaggttcaaatactagccttatcatttattttctgtgtatcactgggcaagttaattaacctctctgagccatgaaaatactagtttgtaaataattcctgcctcataaggttgtcaggaggattgaatgaattacagtgcatctgtaaagcatctggcatatattagttgcttaacaaagttccctttctccccttccctctacttattcttatgctgagaagaatggacttgcttaagatcccatagataatgcagaacccaggcctccagtctttcagccatgtgttcatgcattattccaaagatatttttcgattatgtgccaagaatgaaactataactgttgatattgatgaaaaggcagtggcctatagggttatttctttggtcacggattcagcccttccccaaacacactttttggagctgaccattctcttttaggctctgtgccacaggtttattttaagaccgtgaatacagggcctctcacttgcacaggcctcttccaagaccctgggagtgcccccaacaatgtgttctacaaccagttatattacaactatgcagaagtaaaacattttatctgcagtcagttaaggcagcttttctcctactgactttccctctatcatacttcttcttcagtatggtgactttggagtggccaggagcgctttgggacttcaagacccacagaaatgagatttttctacaattacatgatggactttttgaaagcagtatgatacctagctttcctattctcatttgacaaatgtgtaaagaacaaactgccctctgagatctatggacatgggtactgtaccaaagaagtatgaatttcatgctatgctaaatgcaacattttaaaacaaagaacctgtggttaaattacccagttatttcataaagtagaatgggaaaaaaatgtaaggcacgtcatgggttggtgtttcttcagtatactagaaaatcccacataattggacctagaaatttgatatttactttgtaaattggtcatgatgagaaaccaaacctagtgagttgaggggaggggataaagtgctgagttaaggaagctacactcattcaataaaacatactttgatgagtggtggattttagcggcaccaaaagctgtttgactgcatgatggaggtgggcacgtcggggaccttcggcacatgcactatatttcctagcactgctgcaggcaagttttcagctaggatatacttatctgaaagtattttgcagagtatttaccagaggtgggtagagttctgatattaaagtcttgatcctgagaatgaggttatgcagaccttatttctcttcctgtcattgtgaccttggtcgagtcgttttgcttctctgcctctcaattgtgaattgaagccaatttgttcattctagttaggacagtattgagaattagtagtgttacaaggatttagagaggataaatatgtatgtatatagtatgtgtgtatatatgttgtatatatgtgtacgtgcagtatatatattttttattataacaaagatgcatctgtgagaatctcccctgacacagttctacctttggatttgatgagagccgtggatacaagctgattctcccatctcatttgtgatgtcatgcttttactactttatctcctcacaaaagttaggagaatagtaaataccttttctctttttccagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtaaggaggttttacacagtgtgtttatatgtttaatattacttcctatgactgcttgtcttttctaaaaaagagtattatatttccttcttaaaagtcagagtttctaaaatcttccagtagagtccaaaaggtgtgcgtaagagtgtgggttatgaagctgttctttgaagcactggagaaaccctattccaaaatggcaactgtgccctccactggttttgggaactcccaaggagagtcccaggggacaatttcaaaagagcatctatagcatttaacaagcacttaattgatgtctccttgaataccacttcccttgactcaagcagctaggcgctgcaacaataaaaacatcaataagtgaagaagctggcgacactgacaaacaaagcagaccctgttgatggctttctttctgagttttaagtggagaggctggctgcctgtctttagggagaaacattccctatcaccgtttattcaatgaggctgatggattaggctgggttcaagggttaagtatggagaccagtaaaggtctccccaggggaaagtgccagagtccaggcctggtgaaaagcaataggaattgatgggccctgtcagggtgtacgtgagatgcatgatgacaacaggcggaggcctgcggctgcgggtaaaagtggtatcagacttaagcatgcagagtgttcaagtcatttagctatagctggctcaggggaaaggggagcaaggtaaccattttctttagctaacttaggatttgttgaatttggggttcttaaatcataaatttttaaaaatgaagctatatttagtacatgtatttattatagaaatacatttttaaacacttaaattgaaggtggattttaaggacaaggaaaaggaatcccctcccccccgacactatcgccaccactaaaaattaaaagctcaagttttcctaggtttttaaaaaaaatgtagcttcatttgagtgtaaaagaaattgttatgaaatagattaatagattgatgtgcgatgccctggatgatgttgttattggccaatgaaaggcatgagagtagctaataaaacatacattcatctttttggatttatttttattcataggagatgacttttacagcacagtgtctagggtgttggatgatatttagtatactattattcctatttttaaaacaaattgcctacttgtttttctagccaagtaatggcaaaaagactaatttttttttttttgcgagtgatttctctcttcattgcatgtaatggcttcaaatgctacccatgtgtttatttttgtggcaaaagagaggtggaaaaaaggaatgttcaaaacgacatgaccaagatggacagagggctgtctcttaagtattttcagttggtctaaaggaagactactaaaagaagggtgggctaaatgtatttctatgatttctttcaaccctgagtttgttttaagcaactaagactatgttaatgcgaggaagttttgcagcacttaaagggactgagctcgaatctttacctctttcctctgattacttgtgtttgattccatattacctctaaagaagtaatcattagaagagtgaaatcaggaagctttcttatctctgttagtcagaatatccagatgctatggaaggaacaactttgataacaaccttgtatatacaacttactatgtttctgtcaacgtcccgagtgtttccatacattacttatgctcttggcccaggcctgcaaagcaggtatgtttttcttattctgtgctgagactaagtaaggttagataacttgcttatagtcacatagctaataagtggaagaattgggatttaaatccgaatttttctgacactgtgctgccttccctgaggattttactgtgagtgacatttgccagagatcagtggtcctcagaagtagtacttacagccatcagcatatcttttgcctgtcacaaaattattttgactctaagacaaacaaatacattttttaggtacccctaccattggtgctttagggcctccgtgcccaaattcctgctctatcactgaccaatttatgatgattgacaggttatttaatctctctggatcatagttcattcttacataaaatggtaatgacaatatctacttcatgaggttattatttgcattggatgaaattacatagtgcctcccacatggaaagtgggattccccagtctaggttgggttcagagcactctgtacctctttgtgagcaaataatggtgaactgtgttgtttgttgccttttttttccttttagaatgtaagcaccaaaaggcagtaagtacacttcctgtgtgatagacagtagattttacactttacagatgccatgttagctgctgctgctgttatcattatgactactgctattttcattattccattcatgattctactatgattcatgaacgagattgttgttttcattattcagaaggaacatttctatcttgaagaagggactcagtttagtgttgaatcaagagacagaagatcatgatgctcctaaatcctgctttttatcccaaagcctagtattttcatgcagaaattgggagcaggcttgattgattaagggaataaataagtaaatatttgcatcctaggggagttatattggatcccagaactactattttgtggtgttatcacagtcccttgggattatatctgtcttgttaatctctactcatccttcaacactcagcttggctgttgctgtctcaaagaagctttcagagaatcctcagtcaggttgggttcagagtactctgtacctctttgtgagcaaataattgtgaactgtgttgttatagtgtctttttttccttctagaatgtaagcaccaaagggcaggaaccatggctgtcttattcattgctatgccctctgtgcctaacccagttcattgcattcagtagttaattcagtaacatttgatgaatgaataaatctcccttaccaacacacgtatgaaagatatagaaaagattattctggcctgtatgcccttccactttactgtgatccataatctggttacatccattttggaaagcagtttggagtttaaaatgttaaacatacatctaccatatgaccagccattcttcccatggggatttaccctagagaaatgacaacaaaagtctgcacaaatatttgtacgctaacattcaaagcagcttttatttgtaataggcaaaaattggagaaaataaaacaatgtctatcaacagttaactggataaacattgtgatacatccatagagtagaatatggctcagtaataagtaagaagtaactattgatacatgcaacaacatggacagttttcaaagtaattatgctaagttaatgaagcaggatgaaaaagagaacatactttatgattccatatatataaaattctggaaagtacaaactaaccctagagatagaaagatcagtggttgcctggaaggtaagtggggagggtcaggctgtaaagggcaggagggacgaataacagaggggtacaaaaaacttttaggggaaatggatatgttcattattttaattggggtaatggttttactggtgtatacagatgccaaaacatgtcaaattatacactttaaataaattatttattgtatatcaactatatttccaaaaagccacaaggacaaggaatgttacttatactctagcagtagcataaaaactgaaatacttgaaaaatacaacaaaatgtgtgccagatatgtttagtgaaacctaaaaaatgttgccgagagaaattgaagaacaacttcataattggaaagatataccatgcttgtggatccaaagactcagtattgttaccatgtaaattcttcccaaattgtatagattcaaaacaatacagtcaaaatcccagaagtctttttgttattgaaattgacaagctaaaactgaaatggaaacacatcagacctgaaaaagtcaaagcaattttttaaaagaagaacaaagttgcaggacttacactccttattttcaaacttgctataaagctacggtaatcaagacgtggtggtattggtataaatttagatatataggacaatgaaacagaataaagagtttagaaatggaccacacatgtatggccttgtacactgtcagtgggaatgtaaattgatacagccattttggaaaagagcatggaggttcctcaaaaaactaaaagtagaactgccatatgatccagcaaccccacttgtgggtatatgtccaaaggaattgaaatcagtatattgaagagatagctgcactctcatattcattacagcattgttcataatagccaagatatggaatcaacctaagtatccataaacagatgagtggataaagaaaatgtgatgcatatgcacaatggaatactattcagcttgaaaaaagaatgaaattttgtcatttgtgacaacgtggatgaatctagaggacattatgctatctagagggcaggcacaaaaagacaaacattgtattatctcactaaatgtagaatctaaaagtctgatctcatagaagtagagagtagaatggtggttaccagaggttggagagaaaggcaggtaaaggggaaatattggtcaaaaggtataaagtttcagttagacaggaggaatagttctggtgatctattcacagtaaggtggctatagttaataataacatatgttatatttcaatattgctagaagagtggattttaaatgtttccaccacaaagaaataagtatgcaaggtgatggattagtctgatttgctcttctacaatgtaaatgtttatggagctatcacattgtaccccacaaatgtatacaattattacttgtcaataagaataacattttttaaaagctgaaagagaataggattaaacagagggggaaaggtagactgagcaaaaattactgcttgaaacattttttaaaagatggtataggctgggcgcagtggctcacacctgtaatcccagcactttgggaggctgagtcaagcggatcacgaggtcaggaatttgagaccagtctggccaacgtgatgaaaccccatctccactaaaaatacaaaaaattagccgggtatggtgatatgagcctgtaatcccagctactcaggaggctgaggcaggagaatcacatgaatctgggaggcagaggttgccgtgagccaagatcgcaccattgcactacagcccgggcgacagtgagagactccgtcttaaaaaaataaaaatataaataaataaataaataaataaataaataaataaataaataaataaatacaggatgatatagaggtacaagatgacacacaaaaaaagtcctcaacatcatagtcactacaacagttttaaaataaaagcacattgagttaccactatatctccactagaatggctataagtaaaattaaaaagaatgacaatactgagtgttggtgaggctgtggagcaacttgaactcatacattactggtgaaaatgtgaactggtacaaccaatttagaaaacagttcggcatatagaacattttttatatgacccagcttccaaaagaaatatatatgtgcagacatatgtctgcataaagacttataagatccctaaactagaaacatcagctggtaatggataaacagaatgtggagtatctatacaggggagtactacacagcaatagaaagaaagaaatggatacatgcagcaacatgaataaatctcagaagtgttatgctaagtgaacaaagtcagatgtaggaggctactgactgtatgactccgtgtatatgaaattctagagtagaaaaaactacattgccaggcctgggggatgggattgaccacaaaaaagcaagaaggagcttttcaggtgatggaaatgttttatattatgatatggtggtggttatatcattatatacacttgtcaacactcaatgaattatacctttaaaattgatagtttttattgtaagtaaactctatttcaaaacttgaaaaaaaaattgtgggatgcagctaaagcagtgcttatgggaaagttatagcattaaatgcttatattataaaaagaagaaaagtctaaaagcagtgaccaaaagttcattccatcttaagaacctagaaaaagaagagtaaattaaactcaaagcaagtagaaggaagaaagctaaattagttaaatgctaaattagtgaagtagaaaacagaccaacagagaaagtgtacagatccagcatctcatagcaatactcagaatgttccaaaattactcatcataccagaaaccaggcaaattgcaacttcaatgagaaaagataattaacagacgccaacaaggtgacacagatgttagaattatctggtaaagatttttaaaaggttatcacaaaaaaagcctctaataagcaattatgactactgtcaaaacaaatggaaaacagaaagtttcagtaaaaagacagaagatataaagaagagctaaatggaaatttcaaaactgattacaatacctaaaattgaaaactcactggatgggctcaataggagaatggagataacaagaaaaaactggagaacttgaagataaatcaataggaattctccagtgtgaacaacagagaagaaatagattggcgaaaaatgaacagagcttcagagacttgtgggacaatcacaaaagatataatatttgtgtcattagaattttagaagaagagaaagaatgtgggactgaagaaatatttgaagaaataatggctaaaaacgtcccaaattagcaagagacataaatgtacagactcaagaagctgaaccaaccaccaacatccaaagaataaatagtataaatttacataaattgtgtaacctgaataaattgtagcaatacttcttatttcaaatagtaattagaaaagaggaaaaataaactggtttatatatccaaatatatatacataaggaaaggagaaaatatgcataggtgccacattctttgcttctgttgcttgatctccagaccataggtgatatttgtaactttcttcttcttcttcttctttttttttgagacggagtctctctgtcgcccaggctgtagtgcagtggcgcaatctcggctcactgcaagctccgcctcccgggttcacgccattcttctgcctcagcctctccgagtagctgggactacaggcgcccaccaccacgcccggctaattttttgtatttttagtagagacggggtttaaccgtgatagccagcatggtctcgatctcctgacctcgtgatccgcccgcctcagcctcccaaagtgctgggactacaagcgtgagccaccatgcccggccgtaacttttttcttctatccattccatgttcccttcgttcccaaccagcagtcttgcatatttactacagacccaatttctttaatgtctctaatacaattcagatttccttcttgtgttggttttgataaattgtattttccagggaatttgttcattttatctaaattacaaaatgtattggtataaagtcattcgtaatattctcttgttgtttaaagcctgtaagatttggaatgatgtactctttttcattcctgatactggcaatttttgttttatgtctttcatgatgaatcttgttggaggtttatccataatcttttcaaagaattgactttttttttttttttaaagacagagggtctcactctgtcacccaggctggtgtgcagaggtgcaattgtagctaactgtaacttcaaattcctgggctcaagtgattctcccacctcagtctccccagttgctaggactacagaattgtcccactatggctaattttattttttggcggggggtgggggcggtagacaagctcctgctatgttgttgtgggctgatcttgaactcctggtttcaagcaatcctcctgcctcggcctcccaaagcactggggttacaggcatgagccactgcacctggcctcaacttttgagttttgttgatttttctgttgtgctttttttgtatttaattactactcctttcttgattaatttctttctctcctttgatgaatttaagttgctgttgttttctagccttttgacttgatagatcaggtcattgatttcaatatttgtttttctaatatatgcatataaagctataaattactcttcaattgctgccttaggtgcatttccagattttgatgtgtcatatttctattgtctttaagctcaaaatattttctgatttccattgtattatcttctttgacacatatttatataaaagtacattgcttacttttgtcagatttttaagttaatagtttttttatggatttctggtttgattctactgtggtcagaaaatatactctacgattttattattttagaatttattgaaactatatggccccataaaaggtctattttggtaaatgttctgtgtgtgattaaaaagagggcgcatatgcacctgtggatttaatgttcttactaggccagttaggtaagtctagctacctcagcacctttagcataatcaaaatatccccttgcttgttctctgaaataagcatctctatttcttcttttttctgtagcctttgtcatttctgtaatagttaaattcattatcctacttaaaattaaaaatggtttaaatacagtatttactatatgagaatcaaagagaaatcatgcagcagacctttttagctgttgccccaaagaatttttaagaggcctggagagagaggagtcttccatttgggaattttttttttttttttttttttgagacggagtctcgctctgtcgcccaggtcggactgcggactgcagtggcgcaatctcggctcactgcaagctccgcttcccgggttcacgccattctcctgcctcaacctcccgagtagctgggactacaggcgcccgccaccgcgcccggctaattttttgtatttttagtagagacggggtttcaccttgttagccaggatggtctcgatctcctgacctcatgatccacccgcctcggtctcccaaagtgctgggattacaggcgtgagccaccgcgcccggccccatttgggaatttttaagagaaggaagccagcaatcccccagcatttagagtggttttactaggtctgcttggatgcagaagaatagaccaagtgacttcctgagatccctttggttgtaatgattctaagccatcagaagtacaggcagatctgtaaggtgtgattccgtatggaaaagtaccaaacttcaatgcataaaaaatgtcagattccttcactttcttgcggaacacagagagattgcatgtgttaagataagggtatatttgcaggtgatagccaacagcatgttgaaattgaagaaagaaaacaagaagttattttaatggaggagagagagccgaatatggtgaaccagatcttatttcgttcaggattctaatgatgcctgtactgaggaataacgtgcagattcaagccctagacttccagcatgtttttcacaaatgcaaaggcatccgaaggcagtgcttatgttaaagggttggaagaattgatttacagagaccattttaaagcaactggctccaggtcttgctaaaggaacataaagcagtgattaaaggccagttcacagattgcacttccgagagctatgagagaaacttgggcctagtgtaagagggaagagatgtaagataaatgatgagggagatctacctggatattagcttgaaaattgatagtgcactctagaatcactctccaggagaaagttattagagccacaacagtcctttctccatcctttgtcaaatcattgcacaaatagatgatgccaatacactatactgggatacacaaacaaggctgcggcacactagatgtgacccacccgaggcctcactgctgatgggtgaggattagctctttacatgagcattacccattcatagcaccccagtcagaaagctctgtttaaaagaaacacagtgtcagaatgtgaagatcttaggatcatcctgtcacttcaggctttattgctgagaaaactgaagtgcacagaggttaagttacttctttggggtgttaaatgtacattgaatataatccttaaaggcacaccatagcaagttcttgggaatgaaaggctagaccatgtaggaaagcctgttttcttccagtgtctgtgacttgagcacacagacatttggaccgaataccgggtatcattatttatttaattggaagaaaacagaggggttatttgtgtgtttatatgggtcgtatttcctattggaaggcaaagcgctttgggaaatgttccattctctctccagccctgaaatcaggagctaggaatgatcttctctggccctgtgtgtttctgacttgtttgacaagctctagtgagctaccagatgtggaaattcttttcagcctgggataatttatttatctgtttatgtattttactaggaaagtatctattgagttcttgatactcatttgcgagggactcctaggggaacagtagcagtgtatagtgttacttgaatgtttgattttttttttccaagtctgtctgcttttatttcagatctgagagctgggaaataaaaagcaacttattcctcctcccctcctccatctttgagagagacagtttaaaacatgtggcagaaaatgagccatggagacttggctgaatgtatgaatctgtgaatttattttttctttcattctttgatcctcatttccaaccataaaaattactagtagcacttaagtgttgaacattttcacctgagagatgtgaaatgctcttggctaagaatattcattataaagtcagtgaatgaattcctattcatgtgagaatacgagttcaccagagcaactgtgtgttgttaggcacacaaaatattgatgctctcccttttacaacctgggcatcttgtaggtggtagcactggtaaaacctcctgagtgctaatacattgtgagaatttatttgtattactttgttcacaacttcctaaggtaataacaagtacatactctcaaagaaccatggaagaccgcaaaatagcatggaatgccccagttttttcatgagaacataaaaccatctttgagtggggtttcctgatgcaggaagcaccaagaagaaagacaccaaaggagaatgagcttggtgtgtgtggtagtacaggggacccatcatcatagcggtgtggcagagtaggaattttgttttggtgagcagtggaagctaggctgcttagggtaatagagggccagcggaggtgcaggctgagaggtcaactgaaaagtttaatgtgacaggcagaaaagaggtgttgtaggtttttagagaagtatatggtaaaagccatcagatcacaagatgacttagaggttgcagagactggagattgtgctagtggaaaatctatagacttagtgtttgaatggattgaagaaccaaggagaaggaaaagaccagcttactccatagctcagatttaattagtgatgagggggcctcactaattggagaattccagagctgagatgctgtataacgtttatattttaaacagaattagtaaaacttatggctatctatatgtgtattcaaggagagtaagagattatagaatctgcaattcttttttttttttttttttttttgagatggagtctcactctgttgtccaggctggaatgcagtggcacagtcttggctcactgcaacctctgcctcctgggttcaagtgattctcctgccccagcctcccgagtagctgggattacaggaacctgccaccatgcccagctgatttttttgtatttttactagagatggggttttcaccatgttggccaggctggtctcaaactcctgacctcagatgatctgcccgcctcggcctcccaaagtgctgggcctacaggtgtgagccactgcacccggcctagaatctgcaattctaaataaatgatcccactttttctcttctcactacaacaattgaaaaatagaaatgacatatcctagaattagacttcataacctcctttaaaaactagcagatgactgagcacagtgacccattcctgtaattcctacactttgggaacctgaggtgagagaatggcttgaggccaggagttcaagaccagcctgaacaacatagtgagacctcatctctactaaaaattaaattaaaaaaaaaaaaattaaccaagtgtggtggcgctcacctgtagtcccagctactcaggaggctgagtgaggtgggagaatcacttgagtctaggatcgtgccactgcactccagcctgggcaacaaagtgagaccctgtctcaaaaaaataaataattaaaaataaaaatgcaaaacaagtcttggacatgcttctcacaggcttgtgcttatgatccttctgataagaaattaactgcttacctccctagatttacattccagaatcttaaatatgaaaatgtgcctcagtctgttgggaatccaggagggtctctgcagaagggtttttctttatggcacatggaacctcctatctcatcttgccatggatgggttctaggaaaggctcaccctttgagttcatcttggacagagagaaactcggttcttacttacatagctgaggctgataaaaaagggggcatccctaacagaggaaccataaaacaaagtacatacctgcagtgcatccacttccaataaatatacttattgaaagtatttcagctttcagtgggaactagcaccttagattttcattccttgacctcttgtgtgactcagatcgttgagcctaagtctgacctagtgatgactgggaagattaggaattaaagtctttctttctcttatctggatggtggcctgtatccagagtgcagtgtggatccagtctagtagtcagcttgcacggctgctggtgtgttgctggtgctggaattcacagtgagccaggcctggttttggtgtgcacaaggtcaaaccttgccagagctgcactggatcaacttttgtgctaggtctgacactaaagctttacagtgtaactaggaccagtttgccaaagttgagcttttagaaaaccataatttttttaggcctgttgtgtaccctgttctttaagttgatgggtgtgagctgtctttgagccttgtgtatatatctgagtaagcaacagttcccccgagtacctttccttagcctggccataatgtcagtacagtattgaaaagagcatatctctgtctgttacctccatttttcactttttggaagtacctgaagggttgccattatagagactattgtctttagaagagaatgggccacaaacagctcatttctgtgagtgttcccacctgtcaggtacagttagagcttcccaaaagagacaaatggaagactgtggtcagaggtgagtcattctttcttagaggatcatctccctggagtatttttcacattgcttcaggctccctgtttttcagcctgtaggagaactaaataatctattaggtctgtcctatctccagcttgcattgatttacacccccaagactcacagggacctggagagaaaatagttcatgtgtgccacggctgcagcaagtgctgctgaaagaagatcccaagtagtgggccagaagcccagggaggtgctgaaggaagccgcagtaaagcctgacctctcagagcttctctaaagcacccagtccccattggagaacaagtcaaacaaatgttaagggaaggaaatcaaatatgtttgctgaacattgaaataacatctgatcattgaaaaaaagcacctagttgggaattacaagagagtggcacttttttcttccccactgagcaaattaaaacaagttcagaatttgtttatatagccattaatgaaacatccaatgtagaactagcagcctccctgccccacagaggagggcacatactgcttgctggcacatctgcccatctgagggtctctcctcctcgaagacccccattccaaataagcccattccattggttttagtatgtgccaagcagccctagtgaggaaagagccctgcagacctttccatggccagcgctgtgtgttctgcaccctcacctcaccccaggatctttcctatctgcagcaccatggaggccacctggtttcgtatctctgcttccaaactagtgctcataatatgagatcgttattttaaagaggtgttggtacatttgatggtttaaagaatatgtactttccctccccctgttcaaaatgagatatctgcaatgatattccaaccctgaaaggatccatatgtttgagggttattgttttaaaagctgcctgctgtctcattgggattgattacaggggagctttggctgcttcaggaattcagagcttcagaatttggcttatggttttgggatgtggggaatttgtcttcatgggctgtttatctgccttaattgtgatagagatgctccaaggagatgtgtgggcaggattgggcccagggccagggtaaatcagagcagccccaggcctgaactccccagttcactcaagacggcagtgtatgtagctttcggaggaaagctctatcatttctcctgaatatgaagctgcacccattcattgcaaaattgtacaactgcctgcaaaatcgtgagtttcaggcagtggttggtgattgctattgcattagacatagtgattccacatttggggagaataaagagaaagaaaacttgaaggatcagagtagtcccagaccttggaaatgtcacaactgtgaaacaagtctctagaaagcaagataaactaatcagtgtgatatttacagctcatctctcgatcatatttatttcttggtgcatgaaaattggttcctagggttcacattaatcatgatgaaatatatttactactgtctgttggctggtttagatcaagagttggcaaccattactagtaatatttctaggttcccaaccagcatttaggctgaagatttcaggggttgggtggaggtcatgaccacatgttgacactctgtgcttggagagggaaggaagaaactgacttctcacaaccacggccactaaatatatccacagcagagatctgggcttgattgaaagcctcttctccagtgtggtccattcatgcaagaattgtatctgccttgtttaccactgtatgcctaaatgcttgacacatagtagctgctcaataaatatttattgaattgaatgtgtttggacattgaatttatatatacttcctgtcagtagaattgtaaggggttgttcaaagtatgattccatattccatattcagtggaaaagtcctggtcttttccttgctgactttttcaacaaatggtgctgaaagattggacatccatgggcaaaaatttaaccttggcctggacctcacactacatgcaaaaattaactgaaagtgaatcagatttaaatgtaaaacatgaaaccataaaacttttaggaaaaaaggagaaagtcttcagactctagggctaggcaaagagttcttagatatgacaccaaaagcatgatccataaaaaaaaaaattgaccaatgagacctcatcaaaatgtaaaacttttgctctgtcaaagaccttgtgaagaggacaaaaagacaagctatatacttggagataatatttgcaaaccacatatccaacaaagggctaaacatctagaatatgttttttaaaactctcaaaactcaacaatgaaaaaacaaataatccagttagaaaatgggcaaaggccatgaacagaccttgcactgaagaggatatacaggtggcaaataagatgttcagtatcattaactattatggaaatgcaaaataaaactgcaatgagatatcattacacacctataagaatggctaaagttaaccaaaaaaatacaaacagcaaatgccaatgagaatacagaaaaactggaccactcatatattgtttttggaaatataaaatggtatagccactctgaaaaatagttttggtagtttcttataaaattaaacatgcaactaccataggactcagcaattacacatttgggcatttatcccagaggaatgataatttatgctcacatgaaaacctatatgtgaatgtttgtagcagctttatttgtaattgccaaaacctgaaatcagcccaggcatccttcagtggataaatggttaagcagactatggcacatgcataccatggtatattattcatccataaaaagagcaaactactgatacacacaacagcttggatgattctccagggaattatgctgagtgaaaaaagccagtccaaaaaggtcacatactgtgtgattccatttatataacctccttgaaatgacaaaattatagaaatggaggacagatgggtgcttgccaggagtcagggatagggagggagacagttgtgtgtcttttttttttttttttgtgacggagtctcgctctgtcgcctggcgacagagtgtagtggcgtgatctccgcttactgcaagctccgcctcctgggttcacgccattcccctgcctcagcctccctagtagctgggactataggcacccgccactaggcccggctaatttttttgaattttcagtagagacggggtttcaccgtgttacccaggatagtctcgatctcctgaccttgtgatccacccgcctcggccttccaaagtgctaggattacatgagtgagccactgcacctggcccgacaattgtgtcttaaaagttcaacaggagggacccttgtggctgtggaaatgctctgtaccttgattctatcaatgtcaatttcatgttgtgatgtcatacaatagttttgcaagatgttgggggaaactgggtaaagcgtatacaggctctctgcattatttcttacaactacatgtgaatctataattatctcaaactaaaatgtttaatttaaaaaatattgggagcttagtatctgtgagtcagatgcataatgaattaataaaataagaacactcaaatctctccgtccctaaacttgtatgactttagcttgatgttggattgccttttctgaatcttaatatcaaaattaagattttaaaactagatggagtatatctggagatctatctatctatatctatatctatatttattagatatatgtgtacatatattagatatatgtgtttatatttatattgaataatattgaggacatcatctgttatgatactttggactttagttttgccttttattataagtgaccccaaatcattttttggaaatagatgagatataaataaataagtaatctgaaaaagtccctctgctgcttgattctccaccaagagattatgggatttaagcacacatatagggcactaggatgaaataacgcattaaataatgttttgggaagcagatttatgctttgaagccagccagaattactgagtttgtggtcactgtcatttcgtacctttgcacagtaataagaaaacaaaggggatatgctgtagtgtccctgactgcaagtgatggaagtcagcagggcagctacttgaagtaagcagagtttattttctccttggtggacagagctaatatctttgatccctggtcatttaagttgagcctcaccaaaatcaacttgaaattttgaaggcccaataatagttgtttataagaaactgaagtctctgtttccactggttgtgtaggatttaaagagaatcatcatttggcttatgatgactattctccttttaacttcattaagcaatctcctgagattagacttagaaatagtatgacccacactggagctgaggttatggaaataaaagtgatttcatctttactgggtcttagggagcacagaattagaaaacccacgacctgatcctgacccatctcttcctcctcctcccatcccctcaaactctcatctctccttcccttcttattatctcccaagagattcattgcctcatgaaaaatagtatttggggttaatctttcatttagctgctttttgcttgtgtttccttctctgcctcagagcctcacagattacgaggttccagtaggccctcagatgtcagatgtggagtctcactagtttgctgcacagctgactggagttctttcttttaatggtgtgagcatatggctttctttgctagatggaaaccacattcacaaagagcctgtagcttttagaaatgaagactgatgggagcaaagggttttttcgtgttccctgcctcctctccctacctggttctattctgaatctggtcattcagcaggcacctgtgaccctcttcatatctgccactggcaccacagagctgaagaacattgaccctgaatgtcgtttttgacatcataatctgacttctttgttttcaggtgaggggctgagcttggggacaataaggtgctttttagaattagcatagtaggaagtcagatgacttcatgaatagaagattggactgggagttcgggccaatttagacttgacccagcactgtaaccttgggagaaccatgtctctccaggtctcagttttctcatctgtgcaatgagggaactggaccaagtcacctctgccttctacatgatctctgaggttgcagatctctgagatagcttggacagtggtcatcagctccaactgccaaagtgtgagtcttcttattatccacagaaggctcatggttatgctgtccagtgagctggtacagatacaaggatgaggcacatgtttaaagacactttctttggcagtatcttcctagtagtggtaattattgaaagatttaatggcacagatttttttatcaactatggccaaccccagtctgtctctttgccatcttcatggcacctggccttaaaaaataacttgcaaagaatggagatcaggtgccccagtaccaaggtaccaacctctagccagactggagcaaatgggaatgctgcccaaaccccagaagcctgcccatgtaattggttttcctgcgtggcttattttaagcaagctcctgcctggggttgggaaggtctctcggacagactaaagtgatctcacaggtaaatcttaatccataatgcagtttgtccatgtgtttgtcaaaactagtcagcattagggaactctacatgacaacttctgggctccttggctgtagatggctagtatcagcattgaattgtgtcccaggagtgaatgaaggctccttggcttttctcaaagcacatccttgacaaaaactgccaactaccactgtagttaaaagcataagctgaaaatgaaggcagtcagtccctccattccacttcatttcaggaaattccaaaaataaaaggtgagctttgttcccagagggctgagagtgaatcctataactggctcctctgtggaaaccagctcggaattggaagccagccagctgcccctttcccatctgggcagcatgcaagacgaagcctgaagggaagaagggccactaattcaaagatgcttttgcatattggattccttgtgctctgtcttggctgacccagccatgtgacagcaaggtttgagctggttcatagagctctgttgcactttaatggttaaggattgaccaaactcaggcagtgtgtgcaaggaaggaaatgaagccattgccaaatttgatgtgccttggatctatagactgcacccccaattccatttctctcactacttcttagtctgtctcttggttcatgagtcctgatacattgctcacccagtagcaatatccctgtggaactgtgcctttgacagtgtgatgactgtagaagccacttcagagtggcttttctcctagtgctggcccgtgatttcataactgaacgtcccagatgggcaccacctgttgttacaccttcccccttctccccctagtctgtttccggaatctgactgcggttagcacacaccctgagtttaaaatgcactctctaagctggcttagaaggtagtgcattaacttctttttaggaccatttattgggtacttctatgtgtatggcattttaaacaaagttagataatgcagcccatgctgtttagaaacttacaacttgaaacagatcacaattggtgggttagttccctgggaacaggtcagtgaggaggaagataaaaaatctcagctgttaaaggacatcagaattcacttaatccaatcccttattttatagatggcaaaatggaagcaagacaccttgaataggtcagttgcacaatgcactagtggcagagcttcctggacctactttaaccatgtgcctctggtccactttctataggatgtgagactcaatctaggctgccccctgtgggcttttacacaaaggtagaagatatttgtttgatcctatctatagtaatgggacacgacaaaagacctcaggaggctcaagaaagaagaacttggaaaatggccaagtaagcatagctgagaatctagagagcagaacatttccataatcaggtaagaggtgttgaggaccaacaggtaagaggtgttgaggatccttcactagaatgtaagctccttgggagaagtctccttgaataccttgtccatcactttaaccccagtacctggaagagtgtccagcataaaggttgggttaataaacatctcaagtctgatggaagcctatgaatgcttactatgcaacttcacacaatccttacaacagccctatgatgtaaatataaaaattagaatggaaagaaacagttggaggacgttcttacattgttacaatccccatttgactagtggtgtgggatagccacaaatggaaggactatccaaattattgctaagtccctaacttaggcatagagttttttataacagagataggcttctgtccccaaagatgcgtgcaatttaaaatagatgggggcactatatatatggaggatttcaacagtatagacaatttaatattgactttgtgaataatataactgtggaagcactgttactggaactccagggatattctgtgaagtttcaaatgcccacaccacaatatataaaggcatttggtagtaatgacaaaaggcttacccagagcatttccccaaggtaaaaggaaaaaagttgaattagagtaggggtgggtagccatgaagagacagggtagagtttgagctcttgctcgtctggctgggaaaatgctttactgtatacataatcgacttcgtactacactagggctcaattagagagggcccatcccattctgtttcactccgttttgatcctgtagtcagctgcagagttatagattaagtgacaaggatggtatcttgattgtatccagctgcttggaatcagtcaagggctgagaggccccgcatgaggaacagcgctcactataaaggctccaaagcaacctgaaattcaggacacctctgatgccttttagagcagcatagtttagtatctgacccattgtcaccaaattaagtccctgagaggagtctgataagtgatttcagccaacagtaagaggaccgaaatcttaacagcattggacttgacaactgagccaataatagtaataatgtaattattatggctgcaaaagtggggcttgtaaagaagaatccctagggaaagcgatttgaacttttcttagcatggaggagagagctgtgttgactcaaagtaaacagggggagaaaagcaacttccatcttcagcagaagtgccaactgaattggatgccccctccccatgccctactccttttctttcactttggcatccctggtgtttagttatgtgtgcttggggcccttcggaaatctctttaaccccatgaatcagtgatcatggcattggtgtgacttgaacaggcaggtgcttggtgctgagaaaaggaagctggcagcacatttcatggcatctgcccaggcccacaaaacaaacagaagttatggctcacatactgtgttgctgctctgggctctataaaactgtaatagtatcatattattttaatctgctgaaatacaaatcccagagtagagagaacacagcagcagcattacacgtctgagaaaatgtttgacatggattcatttgtctgcagctattatgacgatgcctgcggtcgattagctctgttggttacaacacagtgttaatgaagccaaggttgtgggtttgagagccctgttaggtgagctggtttcacacaaatgaaagctcttttcatgatcccagaccacgcccaagacctaggtcagacattccataaaaacacggagatggtcacagtgaggactgggcaagacagtgcagtgtctcaccaaaaatgcccctttacctgcttctggaaaaacaagtcacaacatgtgctttagtggggaattaggactgtggtcttcacacagaatggatatcacgttattattcatggtaactgctggtcagtactgctgcaggcttccttcctgaattaaggaatatactggctctggtaaatattttctctgaagaaaagagaaggatttttggtccccttcattcttggctttttactcactgagattctgcccattcgtgtgttagacaactgtgtgtggaatgttgttgcataccaggcactgttctttgtgcgtggaataccacagtgtataaaacagtctctgtcctctttgagtttaaattctgcaagaggaaaatacataataaacaataaataaccaatataatggtgcaagtgaaagtttggtaaagaaaaggatgaggttggaggggtgtagcgaggagtggctggttgcgggtgctgtttgcttcagcaaggaaggttcgagaagccctctcaaagtagttgacatttaaacagggacctgacagatgagaaggacccaagcctttggaagagctggaagaacactccagccagaagaaacagcaagtgcagagggcttgaggtctagtggtggctgaagaacagaagggccactggagagtgaggggacatggtgagagaagaggtgaagagtggatgggccctctgtgacatgtgaaggagttcggatattattctcagtgcagtaggaagccattttgttttgttttgagggcgggacctttctttaaatattttgggagcgatattatgggttgaattgttgaagtcctgatcttcagtacctcaaaatgtgactttatttggaaatggggtattttcagaggttaatcaagttaaaatgttgtcagggtgacccctaattcacagactgatgtccttatcgaaaggggaaatttagacacagagatagacttgcacaggggggaagatggccttgtgaagatggagggttggagtgaggcatctacaagccaggcaatgccagagattgacagccagctaccagaagctaggaagaggcaaggaaacatttcccgatatgtttcagtgggagcatggccttaataacgccttgctttcagatttctaacctctagaacttgagactagtttctgatctaagccccccaatttgtggttctttgttaacagcaaccctaggaaactgaaaagggcatagggtccaaacacactggctctgccctagggaatggcatgaagtgtcctttctggactcagcaacacttgtgtgttggggaagcctctagttgctctggcatatgatcatatgacttttatatatatttagggaaatcgatgatgaaaataactatattaaaatagatataaaataggatagaatgcactagttgaattaccctgtgcagaataccctaatattcttttaggaatggtccttttagggatgctgtgcaaatgatgctttggaagggcaagaatggcacgaaggagacaagttagaaggctagcacagtaatcttggtgatagatcgtggtggtttgggctagagggaatggcactagaggtggtaagagatagaagaagagccagcagtactcgctaatggattgaacatgaggaaaggaaggaataaagactgagtcttagcttttgggtttgagcaactggccggatgatttattgagatggagaagattgagagaatgacttgtctagggataaggaatcaagacttatgttttggacgtgttaggtttgtttatccaggtggagatattaactaagtggttggctatcttaggaacattcggggctaaacataaatttagaggtcaccagattattgatgatatttaaagtgattgaaactagatgagactacttaaagaaagagtttgaagaagagaatagagcctaggaccgaattctcagaagtctggtgatggttgaggaactagcaacagagactgagaagaagcaccaagactagccaacaaattgttatactcattcatggtatggatcttttcaaggttagactaaattatacagaaacacatgggagaaggtactggaagttcctcatccccagtatacccaattctgcttaatccaacaaagctcttatgtaaggacctttccagatttggaaagcaagtatttgttttcattgttttacagattacagaatcagacagcccttctatcctttaggcttccagtaggtcataagaatggtgtatgctcaagagaaatagatgcttttttttaataagaaatgggactttatcataagttttcataatcaccaatttaatacaaatcagggcagttgagttgcagggttccatttatccttcattttgtgaattcattaagaatggaacctatttcattaatcatatgttaagagattgcctaccttggcccaactcagtaagctattacccccacattaattgaaattcccaagcatatacaagaagattgggaggaagtcagaatcagcatctgtctttgagttttggcagaataactaacacctgtttgatggaacatctccagaatcccattatgaccttcttaggttatgatggtttgaacctaggaagtctgttgatacctgtttggataactcagcactgaatggttgctgtctgaattgggacttgattgttattatgtgtctgtccttaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaaggtaagggggcgcagtcctggcaaggtgacaaaactgagagaatgatacacattttatttgacccaatttaatttttcatacctgccaagagggcttagaaaagccatattgtgtgacagtattttacaaataaagctatcctttttctaattataaaagtaatgcacgctcatagtagaaaatatgaaaatagaatgaagaaaagttacttgtaatcctgtcacttcgagataaccattttatcattcaggtgctatttccagcttgccgtttatttatttacttacttgtatgtatacacagacagttgtaaatattctcattagcctgctttttcatggattgtattgtgagccttttctcatgtcattgacatttcttcataaacagttacttgttagcataattaagataccattatcttaatgttttagaagtcatgtataactattttgctatcgtggatattactttctaaatttttgctattttaaataacgcttaatatctaatgttagtgatagatgtccattttcataactgtttgtactcatgaccattgtgatagattcctagaaatagaattattatatcaaagggcatgaatattttgggttttttaagatgtatgtacatacatgtatatatacacatatacatatatatgttgtgaatattctaagcatatatatgttgtgtatgtatacgtgtgtgtgtgtctgttggtttcaggattgtttgtgcaaatttacactcccaccagcaaaatataaaactgttttaccatgccttttcttgcatgaaatatgattaatagaaaagaaatgagcaattttgataagtaaaagtgaattttattgttttaactttgatttgattactagtaagactgaaattccttttgtgtatttattagctttttgtacttcctctcttctgggaatcatcacttcgtgtttttgactctttttttattagggagagattggggaatatgcatttgattttagaatattcagttcaatagtagaatgctccctgggagtatatggtttaattaaacaatcataacttgtctgttgtcagcagtagcataaagaactgatgtcgggagaaaggtctgttcagctcaacacagttaatttaatttagctgtattcatatcgattgtttgttgttagctcagcactactgccctcatatttttcaggtctctagatccagaaatgggtttttttattttgtaataagcaaacaaaaaaacccaaaaactaaggtttacaattcatgggatttacagtagtagactatgtatgctttattttttttgacccaataatttctacactatttcatatatatggtagttttagaattgcctcatttttcttctactttaaaaagcacacactttggtagaaaatgaccatattgaacatgcttggtcacttgaccaaaagcattctaatgcctccttttacccttcctattaatacagccttgtgattaatcttatgagagaaagcttgtccccatgccttggctatgctgccccttatttatcagctaaagggaactgctatttttgaatatttcttctttctgtctcacttgacagtattttaattacctgtatacctacaaaatgcctggggatatcaagaactgggtagatgctcatatgaactgtgaagatattgccatgaacttcctggtggccaacgtcacgggaaaagcagttatcaaggtaggaggctctgccactcacttgctttgtgatcttgggcaaatatctattatctgagcctaggaagttcttgtaactataaattaaatataggactagataaactttaagctctattttagtttaaggttctatgattgatgcggtcacattgggaaattgaagctaggctttgacaatttaaacatattttctttttttatacagtttctttagttgcagtttttaaccttcagtatcagaataaaggctatgatgatcagtctataaatcaaaaaattatattctcaaagctgatatgggttctagttcttttagttaaaggatgtagtttaaatttttcttaaggtagctggttttttttttaatagatgttgagaaaatagtacacctcatacagttatgtaactgtagctgtcctaaacacaacgaatttaattgcttttaaatatcaattaccagtttttaaaagtacctttcccataacatattaaaagctgagaatacacaaagatcctatgggaggcttttgtatctgtaaaagatgcctgtttattcctgaaatttagacattgctcaaataagatccctagatatgtagagaaggtacacttctttatatgagtagaatcatcttggtcttttttgcttctagattagaattttgtgtgttaaaatgggcaatgccaggttccctagcaatctgcctagaaagccaaattcctaggtgagcttatgctggaagcatggtacagcattatccattgattccttatgctattaattgataagagaagccagattaaaccaaagtgtatagggaataggaaaaatcactatctgtgctcaccaaacttgccccagttcacaccctgtcccccagctctctaaataactcagtgaacagctgaccacaaaaaaaattaaataacataaattgtgagagttgttttaaagggacccttcccatccccaaatttgctttttttttttttttttttttttttggtgagactgagtcttgctctgtcaccaggctggagtgcagtggcacagtctcggctcactgcagcctctgcctcctgggttcaagcaattcacaattctcctgcctcagcctcctgagtagctgggactacaggtgcacgccgccatgtccggctaattttttttttgtattttagtagagacggcatttcaccatgttgcccaggctggtcttgaactcctgagctcaggcagtccacccgcttcggcctcccaaagtgctaagattacaggtgtgagccactgtgcctggccccaaatttgctttttaacatgcttcaacatgtttttagctgtggctgcttactctggacagtaatgcccagtgtctctatgcttcttagcctagacttagttatctagctttctttcccttccatctcttcactgtttatttatcttcactaggttgggatagcagcttcccctgagtttgctagggagatcgctagttaaggtttgagagtgtagtggggagtcagggaaaaagattcagagtatgagggacgattcaatttttttcttgactcaagggaattgcaaaatagcttggcatcctcaagagcatggtgctgctcatagcatttgccattagctggaaagaggagaaagagcgcctgttggaactaaggttacggtgaaagttatgggaagctgtatttcatcgcccttatggctacaagaacaaatggtgtttatacaaggaccttggcagtgagaaaacagtcattaaacaggaattaaggagcttgtcatcaccacttctttccagttacagaaggcaaaagccctccaagccttttttattgggcccttgtgagttctgccgttggctgagccagacagagttgaatggaggaatggcgaggtgtgtgtgtgtgtgtgtgcacgcgcatgcaacatctcagcttacaacacaaaagaatgcagtgtggtgtcacaagcatgattttattgtccttgacactgacagccaggtatgtttttgtcctcctctggcaggtaaccccacgaaagaaattcaagtgtcctgagtgcacagccatagatgggctttcactagaccaaacacacatggtggagaggtaagtgagcctccaaccaaaagtgcgccttagcctctgatctctatttcctgccttaggcctgtttatggggctttgttggagatataaggacagcagctggtagccatagtcacctccatgtgcactgtgggaattgggttagttcaagcccaggtcacccaaagaattaatttggaatgctactcactcaatttgtaatggctggaagggtcttaaaaatatagtgggccttaagctccagaagccaaattctccatgtggactaagcagttaaccatctacagtcattgagtggaagctagttaattccaaggaaatactggattatttttcagggtaatagctccacgttatagtaaaagcttgattagaaagaattaaaccaaacccaccagagacaaattacctttgctgacactatggaaatgcctgccaagaacaggatcgaaagcaaagccctcatattacagacagaggggcaagacagctctgaaatactctctttatttcgattcaagtcagtttctcaacaagcacacctttgtgtggaatgtaatcctaggccttgtaggtaagaattaaaagagtgggagatgtatgtcttccgttaagactatactagacctaagagttctcacttgtgccccaaaagtccccaagctttgaagtgcctgaatcaagcctagtactttcagaagacaattatttatacaagacagcaaactctgacatcccagtagtgcttgtcaggggaccaaaatgcactcagataaggatatagtagccttttagaatgaaatatctagttcagatttcacagatctcatatgcctctgcttgcagaattcatttctgaaatctgtcagctatattagaattcttcaagcctagagaatttttgtgtgtgtgtgcagaaagttgtttcagttggcctggcttctataatgttttactctctaaataacttctttatctttttcatgtataaacattacccagatgacatgacctttaccagctgttgatgtgaaataatatattatcactggttgatgtgaaataatatattatcactggtatcataagtatttcacagttaagggtagtgacatacactgtcgtagctcctttggaagagaccccaattgaacttctattggagtacaagaaattgttatttaaacctaccccattgtctgtggttggggaaaattcataacagtaagctaagtggtcattaatagggctgagttaaaatggtgtatcggatatatggtccaggaaaggaagtataggaagaaaagttgacctgatggtggccttgaagttcatgctgaggctaaacaactcctctagcactactgagatcttaacaaatgtaaagaggtttaaaatgcagtgagagccaggtgtggtggctcactcctgtaatcccagcactttgggttaccaaggctggtggatcacctgaggtcaggagttcaagaccaggctgaccaacatggtgaaaccccgtctctacttaaaaaaaaaaaaaaaaaaaaaaaaaaaacatacaaagttagctgggtgtggtggcgcatgcctgtaatctcagctacttgggaggctgaggcaggagaatcacttgaatctgggaggtggagtttgcagtgagctgagatcgtgccattgcactccagcctgggcaacaagagtgaaactccatctcaaaagaaaaaaatgcagtagggagatttaatttagatataattattattaaacactggagtgagtaactaagggagatatggaggcttcctctttggaagatcttttttattattattattaagagaaaggatcttgctctgttgtgtggtgatacaatcatggctcactacaaccttgaactcctaggctcaagtggtcctctcatctcagccacctgagtagctgggactacaggtgcgtgccaccacgctaactagttcttaaattttttgtagagacagagtctcaacatgttactcagcctggtcttgaactcctggcctcaaggtatcctctcgcctggggctcccaaagtgctgggattataggcatgataggatatgttatgatatgtaggatgtatagttaggaggagatgctgatggagggattggagcgaactgttggacttttaacagtgtcaaggaccttaacagtgttacatgtatatgtaacaatgcaatttgtgatgagcgccctgagagaggctcaaagggctgtaactgatcaggtgaaagagaagtaactttttgctaggttcattgttaagaataactttctaaaagaggtgacacttgaagtgatccttcaaaaatcactaggatcccaactagtaaaaccctgggccagaatcagagactctcagcagtggaaactgaatggtttgtcaagggtgcctgatcagcaagttcaacaagaagaagcccaatttggagagcttagaatgctggcctattagtgctggactccaaaaggctttgaatccccaaataaggagctagatttttttttccttcaggctctggtaagctatagaattttcgaacacgagactagctggatcaaagtattgctttgagattaatttggaagtaatgcacagggtggaatgaagagtgaagaggttggagaaaagactagttagaacctttaactaagctgcatgtggaaaggaaggaacaaattaaattacaagagatttttttttcccaaagggagatgtacctgaacttggtttccaactgaagagatgtggggaggctatgaagaaggagttgacaaacatacctttaagattttgagtggtagtagtaccttcagcagtgtaataggtttaggaggagatgctgattaggggagagattagagtgaactgctggacctcagcagtgtcgttaatggggacaggaggtgatgttaatcaggggtgaagttggagaataataagatatgtgatttgggggtctttccctctgtatatacttttttttttttttttttgagacatagtctcactctcttgccaggctggagttcagtggtgcaatctcggctcactgtaacctccgcctcccaggttcaagtgattctcctgcctccacctcccgagcagctgggactacaggcacgtggcaccgtgcccggctaattttttgtatttttgtagagacagggtttcaccatgttggccaggatggtcttgatctcctgacctcaggatccgcccacctcggcctcccaaagtgctgggattacaggcatgaaccaccctgcctggcttttttttttttttttttttttttttggaagaccagagttttattattactcaaatcagtctctgtatatacttttatgtatgtatatcaagatatagatatgtggaactagaatttcagaaagaactttaaaaaaaaatgttgagcccagtcatccctcggtatccacaggggatttgtcccaggacctctggaggataccaatcttcacgcatgcgcaagtccattatataaaatggcctaggatttgcatataaccttcgcatatccttctttatagtttaaatcatctctagattacttacaatccctaatacaacataaatgctatgtaaatagttgttacatggcattgtttagggaaaaatgacatgaaaaaactctgtacatgtttagtatagatgcagtttttttccagatatctttgatccaaggttggttgaatctacaaacatggaacccttggatatggatggctaactgtatttggcagtcatctgtccagagacagcagttgactaaagaaaagcaaaggcagactcttgggaaattctggcatttaggagacacaaagagtaactgaaaacagagaggcaaccactggaaaagccaggagagaaccaggatatacagtgctcagaagcatggaaggaacaaggaacaggcaggctggagaaggtctttgaattcaatggttgttggtaccttacaaaaataatagccaggggtggtggtaggcacctctagtctcagctacttgggaagctgaggcaaggggatcacttgagcttaggagttcaaggcagtatcactctacaattgcacctgtgtgaatagccactgcactcctgcctgggcaacatagcaaaatccctatctgtaaaaaaataataataatgtcatagagtatgaagccaaagggttatagagtatgagtcgacagtgaggaagtagagttagtgaatgtaaactatgcttttgagaaatttaacagagaatagaaggaaacaaatatggaaataaattagcaactgggaacaaaactatttatattaaaaattgagtcactgaattattaaataaggcatttagatagggagggaagaagacatgagttaagccatcttgggtagataaagagatgatgttacaactgtagaatacatccttccttcctcttccctccccctgtctttggctggtctcctggcctcagacaggcctcctgcctcagccacctgagtagctgggattataaatatgagccaccatgcccagctgttttatttttaataataatctttgcagaatacacattttatgcaaaacaatgaaagcagttagccactttacaagtgtgtgtgaccttgtgttgggttttgtggttcagtagctcatttattcctatatttgggggtctgggatcagaaatctcagttgtataggagagtagcttccattactacccagcttccatttccaggatccgctgttagttctttaagagtcagaagcatgtgtcgctgttcattttgacaagtgtcttcaccaaggttagggcaatatgacgggcagacagtattgacttaaaaaaaagaacatagtattttgaattaggctaatctttattcaaatgatgagtttgccacacttattagctgtctgacctaaggaaattgactttaccttatccgaacttcaatctgttcatctcctaacatagggatattaatatctgtcaaattacaatgtccattcataggttcaacaaatatttattgagcatctttatacccaagctgttatgtgtagtgataaatgaagtagtgatacatgaaagcctgtagcacagggcctgggaatgttagtttccttcccggtttccccagtgttagtcctaaagactcctggttactttaagtaatggtatgtgtttgaaaggaaaatagaaaaccattagttctttcttccccagacaccttcatcacttcagagagagtcactggcagttcttggtgtgtttatacttgattggaaaaccaacacaggagaatggttactgacatggtagctggacccctgacaacagctcatgtgggccaccggcaaccagccaaagtcctgtctcccctaacctgctctccaacccagaccccctgtgtgaaaaagtaggaagcactgttattacctggcaggagagttaaggaccttgaccattcagtggaggcctgccgcttctccagtgtgggcctgtatgaaggagaaagaagtactcactagacttgggttagccaggggcagctgtcaacaaatcaagctggcctgagccccagtggcttcttgcctatgacccattcctgttggcggatctagttacagaggagacattgtcctcaatactctctacagggccttggaaccgctatcctctgccaagaaccaggattcttctttaatacgtacttgctagtacctatgctgggaacagctgggctttgccggccagagtctgtatgcataactagaaatgagaagaatctggacatatttacaggcggaacaacagtcaaaagtaaaaccttggagagatttgattttatctgccatgctttgaccccataatttgaagagagggaagctgttgtcccacgcttggtccacctcactttgttaaagttcatccatcttttcccagtctcccttcaatttggaactaggaacaccacctcctgagtctcaaaagacttccagcaggagggacactcagtcactggcatgtaatggtagagtgtgatccaaagagcaggctctattgccagctcaaacctgagtttaaaacccagttccaccacattctacccctgggtccttgggcaagttacttaacctctctgaaccttaatttcttaacccataacatgaggctactatacacccaatagttgggcaaggggggtgatgagtatgggggaggattactttaagcaatccatgagatatgtatgtaaattatctgtcacataataggtgctcagcagttgttaatttccagtccccttcattggaccctagaattgtgttaataagtacatttgtatcatctaattaagacttttgcctcagaagccagaatgcctgctttggctctagctttttctagttatttgacctttgaacatgttatttatcctctctgtatctcagtcttcccattataaaatgggaatgatagtcctaccccatagggttgttgtgaggattaaatgcattattaatgcatagaaagcaattttaacacagcttggaacatacagtaaatggtagttgttgctttgtggtgttggtggacatgatgatgttatgagttaaaagctcaaaatgaaataataacaaatttttttagaaacataatgaccaagagagaagtttgttctttttgtagtgctctcagatgtcctgggcccgactgaggcaagagtgttgacctttctgaaatccatccttgaggtccccttgacttcaaaagcagcttttccaggcgttttccctctggcctaatgctgaagcgtcctcattacccagctgtcacactcagttggcctgattgaccagagccattcccgaacacatgcctgacctgctcacctctgagaaggctgactttgggggtgaggtggagatagggagacagcctctcccctcctctggcggtgctgtgctgcactggcactgaagtagttgttgctaaaagttctgacatgggagtgacaaaaatgatgaaaattatgaaggctgtcctatgtgaacttcagctttcacagaagattgtgcagattgacataattcccagaaattgccacttacaggccctctgtcaatgttggttgaatgaatgaagtgtttattgtttgaaatttggccctgtcacctttttttttttttttttttttttttgcctttcatcattttgtgagcaagatctctcctctgccttttaaacttcagtaaactgaagctcagatccaagtagttttttttctttccatcctttgccttctcttagctggcagagatggggttaagaattgttggcagctaatccaccttggtttgaggccctctcacactgagctggaggaatgactggaatttgagggggaggggaaaagatactctgacctttgcaggcccgtggcctccaagcagcatctcctgttcacgttctcccactgaactaatagtccaagtacccccagttcaccgcttttttccacacctgtcaacctttttaagaacctgggagcagactgtggctacttgagctttttttgttgatgttgaacattatgtattttgctgttatctctcaacctcttgaacatactatcttttctccctgcccccatccttctcattctgctcaaacccctcctccccacctcctctccaaatcccacaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaatactgc

SEQ ID NO: 36047 - DNA, 29157 bp, Homo sapiens
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggtgagtgcaggtgcctgggggcgcgagccgcctgatgggcgtctcctgcgccctgtctgctaggcgctttggtccctgtgtccggttggctgggcgcggggtctctgcgccccgcggtcccagcgcctacagccgggaggcggcccggacgcggggccagtctctttcccacatggggaggaacaggagctgggctcctcaagccggatcggggcacgcctagctctgctcagagcttctcaaaaggcctcccaggcccctgtccctttgtgtcccgcctaaggatttggtccccattgtattgtgacatgcgttttacctgggaggaaagtgaggctcagagagggtgagcgactagctcaaggaccctagtccagatcctagctcctgcgaggactgtgagaccccagcaagaccgagcctttatgagacttagtttcttcacttaaagaaacggcctaaccatgggtccacagggttgtgaggaggagatggggcattcgcacaccttccgtggcagagggttgtggaggggtgcggtgctcctgatggaaccctgtgtcagagggtttgagagggaaatgtcagccaaacagaaggaaggagtagaaggaaggaaacaattgtcagttccataaccaaagtaatttctcgggtgctcagagggcactccccagcgctgcacattagtgacctaaatgcgtgagtgcggagctccctgcagcaccgggaggggaaggtcccaggccgcagcagaaagggctgtgatgggcatcaggacctaggcagtgggaggggcacagtgaaagcccaggtgtcacacctccccagcccagtgcagcctccacttgtcttacggcatctacctaaggctgggagcttcctggatggaagaggtggcggtggatagagagcagcagtgggagcccaaacccatccttgtccctgcccttctggtctcctgctccaaattccttcccatgggtgttggtcatccttctcttctctaagacagattgggactggccaggacccgactgttctcttcccctcaagctccctggcgagtggcctgttgcacagggttagggccacctgggaggggcaggagaggaaggaagccttgccttcctggaagtggtcatgggctgtggtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggtgagtggggccagctggatctaagccgtgtgagcattgggtggaggagtctgtctgcttagccctggagccatgggctgggaggcactcatgaggtttcccatcagtctgagcagtctgcttgggccctatcatgagctgtgtgggtaggtggggagagtaactcctgtcctggcccctgccttggaggccagcgcactgcatgtctgcccagaatgtgtgttttggccagtgtccagccaggtccagtgggcagcatctgagtgcctgacactgaatacaagtgtggggttgaagattttggaggggccagacctagacctgcttcagggggtcacatagctccagagctgggaggtaagagcttgtgggtcacacagctccagagctgggaggtaagagcgtggagacttcacctggtgtttggggggctggggactgggaatcctggaagggagctcagcggtcctttagtcactctggttcagctcctcttaggggaagaaatgaactctgcccacaggttcccgtcattgctcagcccccacctccggcttgaggcatggtcttccattttactctctcccttcacccccagaacccacccattaccaagctgatttctgataccagctccctgcccccttctctgttctcagtgctgtcccctctctccactcagactagcccttccctggtgccttcgttggccacagcttctctgcctgttcccaggtctcagttcactctgcccctgccctagggagagtctcccgtgagtcacagcttcactgcatcctgaataagacctccctggatcagcattggagactttccaggatctgacccagacccttttctagccccatctccaacctgtctctaactttgccaacctaaataggcaggctagcccagtggtaagagtaggggagtttagtgcctgactgcttaggttggagtcctagatccaacacttacttattagctatgggaacttccacaagccacataactagttaaagccatagctccctcccctggagaatggagaggttggcagaattcacaatacagaggagctgtggcaactaatggagacacgtatgtctccattagctggtatttgtttggtatttgttctcttttaacacatccaccattcttagcttcctctttttggatttttgcctctccagtgagaagtgaaatctggtcctgtccgcttacacattccttgcgtgacacacagtgctgtttgtacagcaggcatccagttaatgctcactgggtcacaaatggctgcatctgattgggttaattctcagtgtgggatagttctataaaggcttccaaggcaagattatattccctgggatttccccgggatgagggtggatgaagggggagtatggcagctaggtgtccccaaacctctgcagactcagccagggagctacaggcctcttgcccacccaagggccatgggtggctctcgccataaggggatggctcagaaacaggagacagcagaggctgaacattctaccccatagcacatccaaagggcagagggcttttacaactgtgtgtttattttgtttttttgtttgtttgttttttgttttagtttttggtaacagctttactgaggtacattttccatatcataaaaaatcacctatttgcgtacaattcaatgagtttcagtaaccttaccgagtgtgcaactatcaccataaatctgttttagaacacttttatcccccccagtaaaggtccctcatgcctgtttatagttaatcctcatttctaccccagcatcagacaaccactaatctattttcttgtctccataaatttgccttttctggacatttcattcaaatggaatcatacagcatgtggtctcttgtgtctggcttccttcactgagcataactgaggctcgttcatgttgtggggcatgccagtagttcttttcactgctgagtaatattccattgaatggatgtacattcaccagttattggacatttaggttgtttccagttttctactattctaaataacactgctatgaatattcatgcacaagcatttatgtatgataggttcttataatatttcttctggctatatgcctagaagtgcaattgttgggtcctattggaactctgtgcttcacattttgagaagctgccaacctgttttacaaagtggctggtcattttacattctcagcaatgtatgagggtttccacttctccacatcctcatcgatatgtgtcattgtctgttttagctattataacctgttcagtggctgtgaaatgatatttcgttgcattttcaatttgcatttttgactaatgatattgagcacttttcatgtgcttattgtccattcatatatcttctttggtaaaatgtctgttcttatcatttacccgtcatgtactaaatcctttttgatgttatactatctagcattatgttcttaatttcatttttagattgttctgtgctgtatgcaaaaatatgatcaatttttgtatattgatcttgtatcctgtggcctggctgtacttgtttattaattctaatagtactttgtagattcttcagtattttctacatagaagatcatgttatctgaaagtaaagtcagttttacttctttctttccaatatgggtgtctcatttcttttcttgccttattgctgtgactagaatctctagtactgttgaatagaagagttgagtgtggacactctctcatcattcctgatcttaggtggaaagcagtcagtctttcaccattttagtatgatgttcattgcaggttttttgtggatgccttttatcaggcaaccaggtgagtaaattcaatgcatcttcctccctaattacatggatttgagcaacaaaagcaggctcaaaagaagaaccagtatttgagcaaaaaaagcaggctcaacaggagcaccagtctttctgtgcagagtgaatggtggtagctcaggcacaccaaccaactgatttgtccccattgacactgacttaccatttacctcagctaccaaccgactcaggtatattttcccctgttctcttggcattccctgggaagagatttatgcacaaaacaatctagagagacgtggattctcagctgggctctgcactgctgagtggcgagtcactcagcctccttaggagccaatttccacatcagtaaaacaggagcaatgactcctttcctgcctaccttccaggttcaaagtgggcaaagctggtagaagaattccataactgatctgggggatcaccatcattttttaagtggtaggaaacatgtcaaagtcataggaatgaaaataatctagagggactttctcctttaatttattgagaaccacagacctctagccaatgcagagatcctattagtccagcaagatgcctccacttgtggagaatggctggacatagccatgaaatggagagggaaggagggcagccgagagagagggaggagtctggaaaactccatcagagggtgcggtggtcacgccctcagtcagtggttgaatccttactccttggcccctctctcccaggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggtgagtcaatgccgggtgttggttgggaccaagctgaatggaagggagagagaaatggaaaaagatagaacacgagctctccttacttcctctgcttcacctgttgggcaacgaagtggggagccgtcctctctcacagggaactgtgctattttcagagcagaaaggaaggagcttaagtcaagagaccatgtgtgaggaacctggagcctccacataaactataataacaactgttattcattaataacaactgttccaaaatgaaatgtaatcagttgtatttgatgaatacataggatcagcaaaaagcaaagttactcagagagggaaatcctccaaaagagtcatgacctctaaaccctgtgagaaagaagcttgtcctggtcaccgttgccacatcacatggctggggcagggcctgccagggtgctgggtgttagaaagacttttgtccaagacactttcagagagagagaaaagggtatcatgacttgtatatgatttctgattccttttattttttgagatgtaagatctactgaaatgatttttactcattcattcaacaaatatattctgtgtacctgccatgtgccataatcatgtgtactcaactccagcagagtgaataatttgcataaaagttcccgaggcaacttcataggattatcttataaatacaatggagttattagaatagcacttagggaaaaatctagtttaatcaatgttttaggctattattttacaactattacctgcatacaaacagtaccagtggctgggcgcggtggctcacgcccgtaatttcagcactttggaggccgaggtgggaggatcacctgaggtcagtagttcaaaaccaggatggccaacatggtgaaaccctgcctctactaaaaatacaaaaattagctgggtgtggtggcacatgcctgtattcccagctacttacaaggctgaggcaggagaatcacttgaacccgggagggggaggttgcagtgagccaagatcatgctattgcactccagcctgggcgacaagagcgagactccatctcaaaaaacaaaaaacaaaaacaaaaaaccagcaccagcatctcttgcttgtttaaaatgcagattcctaggctctattctaacctactcaatctgaatatatgtgaaagaagccacaaaatctgccttttaaaataagatcctgtccaaggccataccacgctgaacgcgtctgatctcgtctgatctcggaaaataagatccctgtttgaaatcagtactacataccattcattcaaataaagttgagatagattaaatggttaaaaataaaacttgtattattgaaaaactagggggcaggttaactagcagaactgtagaggaaatagaaatctcttaaatgatgatctaaatcacgaaacaaacagatattctaaaatacagaaaatgtaattcatagcccatagaaaatatttaaataaaaaaattagaaaggactggaatgaatgaatatgcgccagctctgacacatgattactatttacactctataaaagaataactcaaggccgggcgtggtggctcacatctgtaatcccagcactttgggaggtcaaggcaggtggatcacgaggtcaggagatcaagaccatcctggctaagatggtgaaaccccatctctactaaacatacaaaaaaaaaaaaattagccaggcatggtggcacacgcctgtagtcccagctactcaggaggctgaggcaagagaatcgctttaacccgggaggtggaggttgcagtgagctgagatggtaccactgcactccagcctgggtgactccgctcgaaaaaataaataaataaaagaataacccaaattggaaaaaatgtagaatcatagaagaaaaatgatatgaacagagttaccagtaagagggaattcataattaataaaaaatacttgtgagatgttccccttactaatcagacctgagcgatttgttagtactcacattttctatagtaataacagctaatagaatgatagcctgccctgctggtgattcaagagtgaagctggtcctcacggtcagcgccattctgaattggtattataagtcttctggaagcagaatggcaacggcagcccgggtcacagggggaaacgtgctcctcatctgggggattccaccctcagctgcctacccaaggacacaagtggtcacaaggaaaaacactgaggacaaagatattcatgaaaatacagtcttcacaggaaacagttagaaataaacttaaatgctaaacattgggggaaattattcaatacacgatagaacacccacattatgagaaaacattatgctgtctacaaaatcagtaaaggctctgcagaagttagaaaatgtatccagttttagaggaataagcagtccacaaaatatgatgtatcccaggggtccccaccacctggccacggactggtaccggttgatggcctgttaggaactagacctcagaccaggaggtgagcagagggccagtgagcatgactgcctgagctccacctcctgtcagatcagcggcggcattagattctcataggagtgtgaaccctagtgtgaactgtgcatgcgagggatctaggttgcactccctatgagaatccaatgcctgatgatcagaggtggaacggtttcatcccaaaaccattccccatctgtctgtggaaaaattacattccctgaaactggtccttggtggcaaaaaagttggggaccactaaactatcccacattgcaaaccaaagaaatatgtaatcatgtgggaagcaatgtgctgaagcggaggaacatggtttcttatgaaaattttaggatagcttaataactatattttctatccaataaaacagaacttaaaagaaatgaatatagagcaaaaatagaaagtatctagaacaaacgacttcaaatatagatgactgtgaggggtgtgatcgggagagtgacacaggcaggcagaggagaaagagggcaggcgccagtctcaggacttagagggctggtgctcactgtcccaaaacaggggtccttggctctcaccatctctcataggaagtgaggggacaggatggaaagcggacccctttgacgacccttccagccatggagactttttgaggtcctgaagtcccacttgctgggtttgggtgagttttctgctgaagccagtctggcctctttactttcaggaaaacagggccgatgctgtgacccttgatggtggtttcatatacgaggcaggcctggccccctacaaactgcgacctgtagcggcggaagtctacgggaccgaaagacgtgagttctgcctggggacccagaggccacggtggcctcagcctgtgccctgagctgtgtggattaagactgggggaacatgtggaggtggagtctgggtcacatcacacatgtagggaatggagtcgctgggctctgggccagatgaaggccgttcctcctgacgctgacccacgagaggaggacacacgtgagctgtgaggaaactgcagcacagcattcccccttcccaccggagacttttcaggatgggttgtttttgtccctcttgtccaggctaagaactttcaattctgtctgcccctttgcagagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcaggtaagatggctgggggatagtgagtggcctcaggcagggggctctattccagttgtaagcacaggccacacagatcatgcaggtgaaagtgtgggatgaatcaaggtgggggtgaggctggccagcttgtaacatcctgctggcaggatccgttaccctagcagcccttgggaggcacagctgagtctgctctcggcagaggtgcatgtctcgagctcccagccccatgacagagtctctcctgcaggggtggaggaaggggccttgcccacggagacctcaggatgggaggtgtaacctgctgtgaccagggctggctcacactctgtggtccacttctctgtgtttaacagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgagtgaccctgtccccttctcgtcagtggccaagtgtcccttggcctcaggccgggaggccttttctctggccccacatagagcccagcctgctcttggggacgagaggaggtctgttctcctactgctgtgtgtccaaagagagtgcaggcctgcccagtgtgtgttcccctccagccttccgggcccaactgtgcccccaacttctcaccagccccacgggcagtcactgtggctgtgggccctcctgttacctcagagagccctgaatccaacttggctgccctgttgtcctgggttcctcatactaatttctgccgcctgcctaaccacagcaggactgaaggcatcttgtcatgagatgtccagtcctggctcctggttgggcaggaccgctgcagtgtccaggctgatgtccttctgcccacctgggcctctccccgtggctgaaggacagtgagcaatgcctgattcgcccccatcctctctgcccccacgcggaggctgagctcccccttttcccattctgtctgctggcactagcgtatttttgcagagggaggcctccacacttccccactggccagggcacacctgcacactcagtcctgaggaaaacagccacatgaacagtgatgctaaggctttaccctcttgggtagaggcttcaaaactctcctttatatagaaaaaagttttgtcctcttagccctcaaagcagaagatgggggcctctggctagcacctgagtcattcttcagtatctacctggagggggcccctaccttcccagctgggatgccccaaagcttcagagccctgccctgcagggagtagaaacccatagatgctgagtgccagggctactgttccacagggaggggctggggagggctgcctgtgcttacccctgatggtttctcttttcacaggtgtctgagagacggggctggagacgtggcttttatcagagagagcacagtgtttggtaagagcagggtaatgagccgtgggtactgaccccttttatcttacttgatcatgactctgacctttgagctaattagattcctaagttcatggcagaccattttcaagattcctacagggcacagctctgattttatgatctttcatattttaaatgatcagttttcttcaaacctcctgtgcctactgcctttctcttcccctcatagacacccatgcctaggtgcttggcaatgcgtcctccagtcctccaagacacatgtgctcatgcagaacagattgtgctggtttgtgtttccggtttctgggttcatagaggttttagtgagcattagaaatcctgctacttgggttttctgctcagcattttgttttagaggtttatcggtattgttgtatacatgtctagctcaggggtcctaacagttgaggagtgttccgtggaatacatccaccttttacttctctgtcaccatagtgatggacagaggttgtgctctcttttcctctaccacatgcagccacacgactgataccttcacctgtgttccttacttacgtgctggacagcgtccctcctggacttataataaagcagttgatgagtatgtagaggctaaacacactgcacccaggactagtggacataagctcactacatttcatgcaagaccaatagagacagggctactatattccacccagggccactagagaaagtgacagacacccacattcactcaggaccatcagagacacaccccacatccacccaggaccaccagagaaagagacaacacccacattcacctaggaccatcagagacagaccccgcattcatcagaggccaccagaaacagacctccacatgcacccagggccaccagagacagaccccacatgcacccaggatcaccaagctgctgtctggaatgacactctgcaagtgttctaatttccccacaacttcagttagaagtatttttgactttcatactttttgtccgaatgatggttgtaatgcaatagatagttcgttttatttttaattttcatttctctgacagctggtgagtttgatcatttcaacatatttgctagccgtttgggcttccctttcttattttgtgacatttgactactttttaaattgagtttcacaccttgtttctgcatgattttgattcaaggacagaagttccttctatctaggtatcaaactattgctgattttaaactttagtaaaacctcttctcagtcaaaaatctgacaacggtagtctctgttgatcaaaaatccttgatattgataaggtcaaatccacaagcctcaccttgttggtttgtagttttgagatatttcaaagatgcccttcttcacacccaaatcataattatttcctaaaataagatttgaagatccccttcctcatctatttatatgtgctctacctagaaagtcagatatagatttggctttagcattttatcccctttacagtgaggcaatttaccttacaataaaaaaagtatattttttctgccatatgtgaagccaattctacaccaagtttgtatatatccaagtggaccagtttctgagctattttatttcattggtgtatttgcattttttctgcttttgttactgtggcttaccaatgggtcttactatctggtggagagaaagagagagagccagtgagaggaagagagagagaatgagagagagctccctctcccctctcactttattattccttttcaaatatactcagctaaaacttcagaattattttgttgaatttctggaaaaaatcatactttaattttgattcgaattgtactgaatttaaattgttccatgaaaaatcagcatatttataacattaagttgtccagtccatggtgatgctaaatctcccccatttgatcacacctctttttagtttctttgatagaactaaaatttttcctttgtgggtctgatgtgtctttgtgggaggctaattattagctacttaatggttttagttgctattgtaacatcttatagtccatattggtttctatttggttattgttaatgaggataacatctgatttttgtaggttgctcttataacttgttactcctctgagtagttttattagtttctgttggtttcattggttttttgtagatgacgatatcatctttttaaataagagtgtgtctttttccttccagtgtttatatctcacatttcttttgtaaattgtgtgatctggatatctagaattgtgctggcattgtaacagtgggcatccttgccttgttcctgattttgcggtgaatgtctacattttcttcttttagtaaggtttttgctgtagattaatggcatttatcaagccaataacttatggccaggcgtggtgtctcacccctgtaatcccagcactttgggagactgaggcgggtggatcacatgaggtcaggagttcgagaccagcctggccaacatggtgaaaccccatctctattaaaaatacaaaaattagctgggcctggtggcgtgcgcttgtggtcccagctacttgggaggctgaggcaagagaatctcttgactccaggagatggaggatgcagtgagctgagatcgcaccactgcattccaggctgggcaacagagtgagactccgtctcaaaacaaacaaaaaaactttaccgattctatctattactatttttctgaggctgaaaaaaaaaccacacacaaatagatgttgaacacataaacaatcgttctgcatctattaagatgaagacgatctcatggttttctgccattaaatgcagattactttagtttttttgatgttcagccattcttttgttaatggaatacactggtaaaccttcattccaatctattagctttttaaatactctgtgagattgagttagttagtacgttatttacaaattttgcatttatgttcgtaagtaaaataaacttttaattcttccctcctatactttttctgattttgacatcaaggttgtactaatctcataaaatgactcgggcaagatttttttcactttacacattctgaagcaacttatatatgatattccacatttgcctgaactcattcataaaaccattcttccccttcttttgatatactcagtgttggaaagtgtctcaccttcctgccttattccctgccttgttaacatttttgtcatttttattcttcccagagatgtgagtaagggagcaacccttggtggccccctgagcttgtctctgcaaagtgacttttccaggcagagatgccgcagaaacagacgggtctggtttggcctctctggcctgccaggcagcagctgcacgggaaccccagggtggcctaagtgatttaggatgaggatcacacctcggctgccccctgaggcttttggggcactacctttacctttctgagtgttctggagcaaacccctgcctttctgaccctcagttttgtcagctatctccccaagctcaaaattctatagggagaaggggaactatagctcgaggttactgctggagtcggcttatctagactccctcccacctcaccttccctgcagaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggtatcttcacccacggtcctccccacttgcttggatatggggggcagggagcaaggtttcttacttccctgacttctgccactccagaagtcctgtagctttgctgcaggatagcacactaatgcattgggctgcttgcccaggctgtactgtggacagcagaagcaatgaaactcttctgtcacacgggctgacagcgtcttatgatgggagcagaagcagggggtggtcgatgcaatcttctcagggccctaaggtgcttggacctcagcaactcttcaaagaatgagccatagctgagcttgggtctccgagatggcacaagtccctctgcaggagggtctcaaccgaggctcctgctctcagttagaatgatcccaaagctccagatactcttttttaacatcatttttttgtttcctccctatttaccattgacaccataattctattttttcttaattaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgagtgagcccaggagggtcctgaggtccgcctggtgtggtcttctacttcccagcaggtggccctactttgtggcggtcactccttttcccagacactgtggggtcatcgtggaggtttgatgcaggtgtgagtgtcttctgtggattaggtcaggtgtctctaaaagaatagtctggccacctgatcagtgcacgtcaggctccccaggcctggcagaaaaatcagtttgcctcctattaagtgagaaacatgaacatgaacaaagatagccaggacccctcctggatgaatccgggggcctggatttacccacacttcccaggcccagaccttgaacttagttggggacaccatggtgggggaactcagctatggctccttctctactggggggctgggggtgggagtctgggggaacccagaggctgcaccgtagttattggtggtgattgcaggcgttaggggaagtcagggttgggctcaaggtcccctaggccatctcttgggactgtcactggtctctgggtcatggagcgtttatcctcagagacagagacaataggcgcctcctgactctaaagattaatggatagattagaagccaggaacttctccaaaggaacagaagtgggaaacacagggagctctgtggacctgaagaaggggcttggagctgagaagtggaggaggagagggtatgggtccacatgtccacacatgtactgtagctcctgttccagggagagtctgggcaggaccctggctctggggaggttggacaacctggcaaagctcaggttgcccagccacctgcggtcttccctctggcaggtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctggtagggagctccatcacaggggcgggcggtgggcccggtggaagacctagggcctgggcatctgcttaaagtgaagtcaacagtcaaagaggccacgggggcctgggtgaggcagggatgcctggagaggtgtgctcagggccagaaagcattttagtttcaaaaagcagtttactgtgggtttcccactcctctggttataagaacaactcaggattattataaggaatttggaaaatatggaaaggtattatgttaaaacaaaacaacaacaaaccccccaaaccacctgtgatctcacacagagggacagacatggttaaagtctggctaattctccattccagtatttctctgcacatctgcagatatgcatgcaacaataatgaagtgttgcagtatgtcgtttttaagcccttttcactaaacagcgtataatgggcattcttccacatgaatatttactcttggaaagcattaatttttttttttttaagagacagattcttgatctgtcacccaggctggagtgcagtggtgcgaccacatctcactgcagcctggaactcttgggctcaagtgatcctcccatctcagcttcccaagtagctggggctacaggcatacgccaccacacctgcataattattattattattattgtagcgacagggtctcgctttgttgcccaggctcgtctcgaactcctgggctcaagcaatcttcctgcttcggcctcccaaagtgctgggattacgggtgtgagccacagcactcggacgaaaacattttttaaacatgcttccaggatatcttttatgtgaatatggctcagtttagtcatgcccccattcctctttgtcccttactttgctattatcaataaccctgtggtgagcattcttgagtagaaatctttgtccacttctctatttttaatatagttgtaaaaatattactgggtcaaagaggaagtttcatactactgatgagtccatgatcctgtgttgtagcctggacttgttcattctggtggtgggccaatatgacgacttcagcttatgtgttggacaacttctgtgtagcgcttggagtggagtgctaatgagttcagattagatgaggccagctgttcccatctgtgtcctcagtcagtgagactgctccaggaaggtgtccccaaagtgccagggacacagaaaaggttttgctcagaggacagaggattagtgcaacctgtgcctggtctttccagttgaattgacagcccagaaagtaggcagggctgggagagaattagtggtgcacacggtgtttcctctggctgctcagtttgaatagtccatctctttctgctgtttcactggtcacctgacagaaaaccattctctcagagagctatatagacaggcaggacgggatgcagcctcactgtggtgctggagatctgctctgtctttgcagaaaggagaagctgatgccatgagtttggatggaggatatgtgtacactgcaggcaaatgtggtttggtgcctgtcctggcagagaactacagtaagtggagttagcatcctctggtatattccctctgggtcatgggagtggggctatgagtaatcccattcggtgaatgcaggtgaaacattatgatgaacagatacattcaaaagggagaatcagggaaagaagaaatgaaaggggccgtgttacccacaaagcctattgtgttgagaattaacaagggacaggttggttttatcttcttaattttccagaagatctcagtgaattataacatacaaacagaaaagtgcacataaatgtacaactcatggcacttcacacactgtacagtccatgctctcgggcccagaacaaacactgcaagtttcagaagccccttatgtcctcctgtcccccgcccccttactcctgcaagggaagcctctctcctggcttctaaggtcgcagatctaagtttgcctatgttttaaacttcatgttaaaggaattacacagcatgtgtttttttatgtctggtttctcttgctcatcgttatgcttttcatccacctaagtgtgtagttgtagactgttcagtctcgtcgctgtgtgagtctactgtgattattcatcatttgagtgtggatgggcatttgagtagtttccagttggtggctgtggtgaataatgcagctgtgaatctctgtgccatgtcttttgttgaacatatagacgcatttctcctgcatggaactgctgggacggtctctttggatttgattctgcatcattgagatttaagagtttgtggcttctcactacatctgaatggataatgatgtctggcttgtctttattctttcagaatcccaacaaagcagtgaccctgatcctaactgtgtggatagacctgtggaaggtgagttggcattagccactttcagggtcaaggataagttcttgttgctggaagaggaagtggcaggaactgtaaaaaaaacagaaagaattgcagccctagaagctatagggcttctaggagcaataattttaagggtgcaaataattcacagaggaatagttctaattaatgtttatattgaccttcacacttggcaaagaacatccatatagtccctcattttgtcatggtcatggaatggggggtgctacttccccacctcatggggatgaggaaacagtggcaccgagagtccccaagtgcccaggatctcactcacagccataggtaatactgtggtagatcctggtcttgaccccgggtcctcgtgacctgggactcgtgtcccagtgctctgtgcaccactcctcctgcccaccagagctggtgcttgctcagtttcagaaaagacttgcccttggtgggtgtctgtcagatgcattctctcaggaggacaacggcaaccatgttgagttcaaccagtgcagggtgggttcagactcagctcagggcagtccctggggacatgtgcccctgtacccacacagccgttagctggctggatgttggtgctcttgcctgatgcacactgtggttggtgatttatgcactgttggggtctctcttgttgtttatagtgtttgttgctgtagaagcttacactgagagatgcattgctggtttgtaactcagggacattgtgtggctggttgaagacagtcccctgtaatcactaaaataatcagcttttcttactgttttatttcatcaatctcaccttaacataaggcagcagcttatgctttctcggtctacctaaaaaggccagttctttgagggaatcattgcctggtgttgcttcttggcctgttttggcctgggctgtagacagctccactggaatccatgtgccaggcctcctggaggttaagacttgtttttctgtcatctgttatgccaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttggtaaggagttccaaaggtgcggtgggtgggccaccctggagggtaggcatattgtgctgtggaaccttagggaagggaggggaggggatttgcaggctgatagtggcctgcaggcctcttccagcataaggaaattctccctgtggctgccccctggaggcgtgggtgcactgggggtttccctgcacagcacttcccatgccccattcaccccaccccaagattaaagattggaatatctgcctatttcgctgcaccctaagaataaatgcaagttccaagatgtgcaaatgctttttacctcttggagctccagacctaaattcctcttaaactctggcttcccagcttggggaaagatgtctgcctgcctcatgaaaggtgactcctgttactaagcaaaactgacgcttactctacactgcaacggagcctgaataagacctcaagagcctggctccacctgcttctgcagttttctctccccaccacaccccacactcatcctagtcagcatcagccacaccctgcctgctgtgggccccgtggcatggtgtgtagcacatcctcaatgtgactcccttcttgtatgggcgtctcctagggcaggggctccactgcatgggtttttgatcctggccggggcaggcagctttcacgtggctctgctcctcaccagctccatggcagcctctgagctgtagggaaactgccaggatggaatgggaactcccagcttttcctgaggttgacacatagtgtggctcttccagcagcagtgggagtctgataatgggtgacgtttgctcagtggggcagagctttcttgtcacctttgtttattctttcttgggttaaatcacacaatgaacgaattcagatcaggttcagctgcaaggaacagaaaactcctgaaatagtagaggcttaaacaagacagaagttaatttctgtgtcatgtagtccagaggtggtttgcctagggctggtatgaagacaatatggggtctggaacctgggctttaatcatttggctactctgccatttgtgtggctttcatgctcaaggtcacctcatggcccacattgcatctctaagtccagtccctgcttctgcattctatgtgcaggatgaagaaagagaaggagaagaaagggcaaaaggcatgtaccaattgtctttcaaggatgtttctgagaagctggcgcccaacactcctgctgatatttcactggcctatagctacccatatggccatatgagccccagggagtctgataagtctagtctttataccaaagggccaagcacccagatacaaagcagggtttccattactgataaaaacaaaatcagatcctggactaggcaactcacaggctctgctgcacacagccatcacggtcatgagctgagtccccagctcaaggctgtgatgacgggaccctccaggcagccacagctctcatccccagccttagttgggtgtccatctgtgcctacagtctgaatgaagcttttctggtgggtcctatgttggtgacaacatgttgctttgtgatggtgagtgtgttctatctagattgctgtcctgggaagtctaatgaactgaaaccaccctgcatcggctgttaggtaaaggttgcttgtgtggactcaggtttgaagagctgactccccgtgttccttctctccagatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgagtctgtgactgagctccatcaggatggggacttacctcatccctcagcatgtcagcattgcagttctaaggagccagatgtgacctgtcacagcagagtgggggtcatcctgtgggtcagctcatgggtggccccagtgagggctgtccccaccacacccaccgccccagagagtggaggctggcaccagggctgtctgacctcagctccgcagtgcttctccctgtggctttgagccaagatcaacagcagtaggcctcaatagcctcgtcctgaaaatcaaatgggtagagtgtggtatcctaagtgcttcctacaattccatttatggggaagaattctctttcccatcgccgccccttttcttctcacctaggtcatgactatggcttaggtttccctttttctctgactttggccttagaaatggcaaagagatggcagaattgcagtgttattctccagtaacgaagtgaaaaataagccaaaaaacaagttttcagaattcataagttataaccacttagtgacttgtaaccacaccccacgttttacagcaccattcatccgggtgttgcttctcaggggcactatttaccagtgtgaagggtgcagagaggatcttcccctgttccttttcctccatttgccaagagtacatttcacgaccagatggcgtcatgtgtctgagggtgtctgaactttttaatataaattcaacagccttgttccagtaatggaatgacagaaaagtagcttttgctatataagtggctcataaaaaaagacccaaaacaaaaaaaaatgttttgtgaatgtataaaaatatctttaagggactaaggatttgcaaatggaaatgtgattctactcagaaatgctgaacacatgtctcataagagcccgaaagaagcatgtgctcctctttttttttttttcagacctgcagcaaggtattagttcactggaaacacccacattttaatattcctaattatactggaagaaaatcccttgtcttttgtttaaattatatctagaatctagattggggaaatttatagcaaaatcattaaaagctgaaaccagtgtcatacccctttatttctatcatccttataatgctggttcttaatttttaactttctgctgactctgtagtatagaagaagatctagcctctcacactgcccccagcaccttttccaccacacaaccacagacttcaactctcttcagcacccaacacgctaatgtcatattcagtacttatgactgtgtaagcgttattctcatattatatttcccttattgtacaaactttttgtttactctggagttcataaatgtcttttcttatttgcttaattttctgcacttaaaaaaacacatcactatctcatccccaaactgtctgccagtaatgtaaatctcctaacaacatgcatacacacacacacacacacacacacacacacacacacacacacacacacacacactctctctctctctctctctctctctctctctctctgggtgctatcacagtttcatcatttacttggaagtgctgctccagaaggcatccatcttcctgctgcagtttggactggttgctgtgtaggccgcctgcacatctgtggtcctgggggtcctgttgaccattattttggtgctttcctttgtcttacttcatgttagattgcctgtttcctgggtcgcatatctttagatttcttggttttgtaatgtcttttatatagggttttaaaaggagggcaggtacacctgtgttcaatctgccgctgtaaacagtaaattcctagaaatagttgtcttttagatgtttacttccatatttcagtttttggaatgcatattacaaatatttatgaaagccccactagtttctcttctgtaattatgtgtatattttctggaacattttaggtgcctggctgagaatgctggagacgttgcatttgtgaaagatgtcactgtcttgcagaacactgatggtaggtgaaggtgtttccttttctccttcaaagcagagtctttggcatcacaacacatcttagtgttcagatttgcctttgggaaggttttataacattttccatatttgtgattaaaagaactccaaaattctttatctcaatagacaacatgataacatctgtaggtgtcatatggattttgaaacgaaattcatacacacacactctctctctttctctcacacacacacacacactcactctcacacacacagatactagccatgctcagtagcaaatgtctccctggcttcctctagtcaaccacagaaacacactgtctgcccacatgagatcatgcatgcctattggaaactgtggatgatgctacaaactgggtgaacatatgcaaatgaagcctccctttatgaaaaaggaagtagaggccttcattcatccccatgtgagccttggtctggagactccttgggagttagtgggaacaaaattacaggtggttgcagatgatggaagataatcttccagccaatgtttgaacaatcactctctctcctggtcctcagccatttgctaccttccaatctgcatctgtctccttagccccacttcagcattccaacccccaagtctcagcaggtgacttgctattctgtttcctgagaaagaactgtctccactttcggcctccctccttcagtaatcactgcagtctcagccacttctcccttctgcttctgctccttctagtgtctcttgggacagagattaaaacaagacatgtaaatttgaaattatttcaatatcaaatagaggaatccaagagaatgaataaagtgctttcttaaagggagagagcagagagacaaacgggagccggaacaatgagccggcatctgcacaaacatagacatgcatacaattacatttagaatttacaagccattaactgaagtaatctccagggatcagattgatgtcaaatttaattttaactttctccggtactttacaactgtattttgttagaattggctgtatatatttgataaacctataaaagttcctttcctttctctggttacactaatagcatttgaatatgaaagggaggagaaaccaatttctccttgaatgtaaaccatctattctttttctggaactcactgaaaaatatggcataggtggagggttttcttctttaaaaaaataagaactctaaacagctttattgaggtagaattcatatactaaaaaatccacccatgcaaagtgtacaattcagtgatctccagcacattcacagagttgtgcagccatcaacacaatccaactctagaacgcttgtatcctcccataaagaaacccttgcacctattatcagtcattgccctatccttcttcagcattggcaaccatcaatccactttctgtctccataggttggcctattctggacatttcatataaatggagtcatataatatgtggtgggtttttttttttgagatgaggtcttgctatgttgcccaagctggtcatgaactcctagcttcaagtgattctcccaccttggcctccaaagggctgggattacaggcatgagccaccgtgcccagcctattgtgtggtcttttgtgactggcttctttcacttagcatcgttttcgaggttcatgcatattgcaggatgtaccagaacttcactcccttttattgctgaataacattccattgcatggacacagcactaatatttggtatatttgaagtttgtacagcttgtgtaggatgaagctccttctctgttcctcacatcaccacaaccccagtgtgtgcatttgggaggtcagtggaatggccacacccacccagaagagacttcttggctaagcaggggaggcgtggatgatgccaccttctttttctccccaggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggtatggaccacagggcttctagtgctttcttagctgtgtgggctcatgttaggtgaggagatcacagagctaggtgcaccagcccactcgatcctctctagtcctctacttgaagctcatggtgagagtattggcttcatgctgtggcgttgcccagagtgtcaacaagaacaacagaggcttttgactctgggctttctgggactcactccatttctgctgagactctgtgccctggccttgttgccatcactgcctggctcagaggctgtctttttccctcctgctgttcttctggcaaatgaggaagccactgagccttcctcccacatgcattagtatagtgctttttactcaggtgacatttcctgaacctgggccgagtgaacagtgctctaggccaggcctctaaaacagcaaactcagaaggtgccctatagatttagggctctctaaatgtgatttgaacgaaatcccaaaattttcttaaaatctgggattttattagaacttctatttttatcatataacatcatgtctctgtgtgcttttgaagaaaacaactcaggaataacaagactggccaccataactggcctttatggagctcttaatgtgcacacacagtggtgctggtgagagagctgccgtgactgaggggtttgggtctcagtctccccacatgggagcctgggacagagcaggaactgtgtgagggaggcagggtgaccgacctgcacactgagctggttagtggctgagcctgggttttcctagcagcctgcctctctagaagagctgcatattagaatgtcctgagcaattgacttgtgagggcagatctcaaaacccctccattgttgccttgtcacccataagaagttgtatgggaaaaggtcacaggttaagaaggaaggaaagatggcagatggtaggaggtaggaccagaagtggtgcgaggcctggatgctgcccaaggcgggcctgccaccaggagtgtggggtgggggactccactaaggaggtggaatgactccagaactcagctccttctgccccatggttttctcagggctgttcttgggtggaagaaatacccctttgcctcctttaacccataaattcctcttttccttagctactcactgtctgcccttttgtcgcaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccgtaagtagaccctagctagcatccccgagaaaccaccatgggtgaaggtcaaggtttgagggccaaacagcattctaggaacgaacacaggtgtaaaaatgttaaggaaagataatatctctttacagttcaggaaattataatctcattgataaaataattagagaataaaatagagcagtatgtaataaatttttataaattttatagtacggatagtgatggcactgtcatgaaatctttggaaactgataatccattttattcagtaaaatgaaaggtgcatatatacatatgcattgagaaatgacaaaaccagccacgtgtgatggctcacacctgtcatcccaccaccttgggaagcagaggtgggaggatggcttgagcccgggagtttgagaccaatgtggccaacacagagagaccttgttctacaaaaataattttaaaaattagcctggtgtggtgtcaagcacctctagtcccagctacttgagaggctgaaataggaggattgcttgatcccagaaggttgaagctgcagtgagctatgattgtaccactgcactacagcctaggtgacaccgaaagacccttcctcaaaaaaaaaaaaaaaaaatctgattctagacagttaccatagatgccaactatagagaaaacaaaatctcaaaaaaattcaagtgtaggaaaacacatcttaaccagggaaatatgttgatattaatttaatcccttaaaaatatttagaagacatcacagagtattgtaaggctcccggtgataactgtgggatttcagtgtgcacagctccctgtgcactgcaatcattcagattcctattcctggtccctcacccagagttgggggcattagggatgctgttggtccaaggatgggggcagggccagaaatgtctttatcggtagttttcaatgagagacaatttttcccctgaggggatatttgacaatgtgagaagcatttttttgattcttacaacatagagggtgctgctggtaacaaataggtagaggccagggatgctactaaacaaagcacagccagccccctgcaataaagggttattatcaggccccaaatgtcaatagtgccaaggttgagaaacccttttctgtattgacaaacaactcaggtcactgtgatgcaggtcaggaccaccctctgagaaatatggctacagggctcttcttgtgagcagccagctcaggactgcatagaccacatgcttcttgagggcaggccagtctatccatgctgtgtccccagcacttagcacagcaactcacacaaagcaggtgctcagtaaggatctgtgaatgaatgagtgaatctgcaggtgaacatgattgcaaacaggttcacattccgggagaagctagaggaccaccaatgtcttgtgaacttgagaatgtgacagtcgattcaatcagagacaagtgcagggtggttgtgtctctcaggccagagcagggaaacaccctggctggtgagggctagactctggctcccttgaacaccgtagtcgctaggagtaggggagtgggaatatgagtgtggcaagcactgactcagtgatgggagaagggcagagaaaactcttagtattctctttgatttattggattaaataactggtttaatggaagaaatcagtttctgaatctcttgctctgttgtgtcccacagccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctcctt

SEQ ID NO: 36048 - DNA, 2751 bp, Homo sapiens
gtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagaggtgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggaaaaagcagaagggacttgtctacctttggtttactgtttctgtggatctacttcacagatgcaaatttgaatagcatatagatgcattgtaaaataagccaaatgctgggttgttcctgtatttgtaaggacatgagtttttaaaaatgaatttcctgagtattaatactaaaatactgttacatgatcagctcttgatataattgaagagatttcagatacctgatgagtctcattctcacactaattcagaaccttggaaggcactgagtgttcaaaaaaggtagctcttaactgaggaccctctgttgaaccattgtgcgcacccctggctcttgggcagtgtagtagcaggaagacagggttgttgccattagaaatggaggctttaactctccctgtcccccatttaaaactttgcccttttgtcttttcagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcag

SEQ ID NO: 36049 - DNA, 3759 bp, Homo sapiens
cagggctgcagcctcatctgtttgcggatcagaacccgagctgtgcttgtggctgcggctgctaactggctgcgcacaggtaaggccaggcaaggcgggagccactcaacatctccgcttcatttccttggctcttcccctgccatcctcgtcctgctacctgggactccgggatgtgccctttcgaccctttcctaacatctttgctcctttccgcgtacttgaaaccccatggctcaacctcttctgttctatccctcttcagctctcccagctggacctcagcttttccaatcccaaatcctcctctacttgttggatttttccttggagtctgtctctcctacccagagcatttccttctcagcctgctccctctcctcctaggctaggtcctctctccagttctcccgccttctctgccccccggtctaggtctctcccgctgactggttagcctgcatcaccactagctcccctcagtctcatctctctctcaggctctctactcctttcagccttggtcctctgccctcccgtctgggtgtctgagttgtggggaattgaagtgcttcctattgctatcctcctgccaaacaggtgaagtgcttcctgggcacagagatgacccggaggtgtcactagccctagtctccacacactaacacagctgacccgctgggccctctttcctacatcactgcagccccactggggccaacctctggtactgggtgggaataggcaataggcataggcaggcaggtttggagtacagaaaaggagaagctgcaggagcctgtgactggtatttgtgccactcctactccctacctgttcttccaaccttttcctctagaagctgagagaagagggtggcaataagtacttttgcctcattctgaagccttggaagtaagtacactttccctaggggtcctgtggaggatgagaaaagggaagctggaaaggccaggacttttgcctacctcaacaagggaccaagttcagtgaaagaagggttggcatccttgattgggcagcagatttatcagaagagctgtggcttcagggctgctcacctccccacccccaccctgcatctttccccagggctgggaaggatgcctaccagggacaaaaggagatgtgggaactggagccctaagcttgctagctgtcagaaggactggtgccacttgatgcccaggactcatgccaaggactgctgccctgttcccagccccttgcttgatggggaggccatttggcccatctggccaggagaggcagcagagggtgaggtctggcttttttatcttgtctccactccagggagctgtcaccatgcctcactcgtacccagccctttctgctgagcagaagaaggagttgtctgacattgccctgcggattgtagccccgggcaaaggcattctggctgcggatgagtctgtaggtaagtggacatctgtagccaggtagggtacaggtggctaggggaccctggggatgttctcactgcctctctttgtttgcccctaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggtgcagcccctggccctgctctgaatggaagctgggtgtgaaaataagcttgtgtaggaggggtagcaaggagaatcctgcctggattcaaccctctgcttgtacttcctctacaggttgacaagggtgtggtgcctctagctgggactgatggagaaaccaccactcaaggtataggatgggtgggcttgaggaccaaagaggtgttagatagttgatgctggtaaaagaggggcagagtaatgaggttggcactgtgcttgcagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcaggtgtgtgtgttgggagggtggtgagctaggtgccctgtatgcctggtggggagagagtcacaaggctttcttcatctcccctactgcccctcccaagcatctctgctcttgcctgcagaatggcattgtgcctattgtggaacctgaaatattgcctgatggagaccacgacctcaaacgttgtcagtatgttacagagaaggtgagtccacacctgggcacacaaacatactgcagggacagctcggcaggagtgtctgttccccagaacccccagcttagatccaggcacactttcccctagcactttttcacttcatcccggcacaggcctgtgatctgagcctgtactgagccctcacagtctgtgcccatctacccctacatagggagcatcgagcagtaaccagtgggggcccagacccttagtaaacctcctctaatccccacccaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggtactacccagctccctaacctgctcctatccctaaggcccatcttcaggtccttcttgtggccttcaggggttccctatcctggaaaaattgggagtgaccagtcagtttgtcttctctcctccacactaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggttgggagctacaggtggtggtgggtgggggcagcacccagaggctatagcctgggcagggcttggcacctgtgggctggctcagcctgcttactccacgctcccttttgcaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaac

SEQ ID NO: 36050 - DNA, 7449 bp, Homo sapiens
atgcgaggctcagaaaggtgcggggcatgtcaacaacctcgcaccctgcaaggtccgcgcgcggagcagcaaagccgtgtcccgcacccccgcgttcgcagactcgcacttgcgagttcttcccttctcccgcacgcgactgcgcccagggacgcaagcccaccaccgggacaggctcacaaagctccacgcagacccacaagtgagcgaacacacatctctgagcagatctgcgggggcagaggagcgcgcttcgctctttcctgcacccccagcctcctcgcctccccaccccgcccctcctccacctccccagcccccaagcccccaggcagccgcgcgccgggcggggcgagggcggggcggggtgtcgggcggcgccggcccaaaaggcggagtcgctaggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagtaagcctcgagactcccgctggcagcctgggctcccggctggcactaccccaccgggataactgtcccggccaaaccctgagctgagcctagagtagatgaccgaggtaggagggcggctgtagattttcctcccctcacttctccgtcatatctgggagcaccccaccccggggcatgcttgtgtctacttgcatgggcttatatctgcccttcccttccttctctctggcacccctattactctaaagtgagggactcatgctgggcagttcctgccttcagcatagacttcgcccctggcagccagggcccttgttccaggccccccacccccccactgtgaaagcctccacgcctctccttgtgtgtcctttgggtatctgaccacactgacagatacctggtgtgacatcaagagtgcacagaatgctcaaggtaaccctggaaggacctctcaggagagagctgggctgtaggcattcattatgcattcaccctgtatttaaagcaaacctggaaagtccctcactaggggtcttttggggtggcatgagtgaggcacatgctgtgcatgggtaggctgagggaatcacctgtttatggggctctcaagtagtaaaagcgaagagctgggagagggagatcatgggaaagcttcagaatgaacagaagaggttaaaggggttacagaaggttctgggcaggaaggagttaatttctcctgggcaggtttagggctgtgaggcaaatggtactgggaggaagactctgtcggcccctttgttcttgcccttgagttttctgaagttatgggaacaatatttgagggaatacaggagagggtggtagggaggagcagggagagaagtgggcagcttggtatcacgaaagccatctcaccggcttagccactctcggccctagcaagcttgccccccactccccttgagaaatatgttgtgccagcttcctctgaccccgtgtcatcgtctggtgaggcagtctgttgtctgtggcttgttagggtgggggagagaacagccagctgccaaccccagagggcaatgccctcctgcccatggacgctggggaggctcagccagccctccgccacccgctccctgtgctttgcctccttgacctgatgcatctcgccctagtatgggagagagcaaagtccctgtttatgcccatgccaggtgttgactggaggaggaggaggggacaggaagccatgagtagggagggggggaccctggccttttccgttcccaagctcccaggtttcctctctttcaggaaggagcctcttccttacccacctccccgccttccctgacgccgctgcccccctttcccagatggggagcaagagtcaaatgaaggctaagtacagcagactgtacccccaggagagggggctgatgggtgaccctctggccacacacacacacacacacacacacacacacacacgcacaccctatcatacccaggactaaagagacgccagtccagagtagagtccgtaggcagccaagctgggcccagcgtgggggcaaatatgaggctacaatgaacggggtaggtgaggctggcatgggtgactcaggccagtgggcagcagccctgggatctccaggcctcaggcgggggcagcatgctgagaagggcgccagcctccctcatgctggagggcaggcccctcattctgacctgccagctccctttgtttggaggacactgttgggggtgagtgggcgctgtgccctcctggggtcctgggggctgtgcacatttgacaaggtaagttttcacaagttctcatgagtgctggggcgggtagcagaggtggatgaggaatgagtcagtgcccgtcacgggaatgagggaaagacgccaggcccagagctgaaatacctgttctgaaatggcttctatgtttatctctccagagaggaattttaaaagcctctctctgctcctctcttttccccagggtgggggaggggcctggtaagcccagtttgggcgctggcacgctgctgcaaagcctggcctctcaggggtcatgctgattgggcagtgggtgcccacctccgagtcctctctgcctgactccttcctcgccctcccagccgtggccagggctttcagttcgaagcaacttagcgctaattctgctgggtctctagctggcagtgcctgggggaattagagaaactgaccagcttgcggggtcgggggaagcacttttccccctactgggaccccacccaggctggagccaggtgtctggagctggtggggaggggctggtgggcagtcaggctggagccggtggggccagggggaatgaactaggggaggggtgctggctccaccttgggaggaggggagaggaggggagagggggagaggaggagagaggggagagaggggagaggggagaggctgtctcaagctcaagctcagagctccagcatttcatctagggggaggtggaagtgtggcttttagagataaaaggacagggttgttttggggtgctctgagaaggggaaaaggagaccagtgtataactttgagtagctagaacgggaagatttgagggggctgaatgaattgatgagagtgatttaacttaaaggactggggcattatctgtgggcccgggtatactagcttcacttttgaggaaaagtgaagctgggaaatgtgagatctactcagtgggtccggggaaatgtgagaggagtaaggaaagtgaagacacagatgtgttggaggctccaggctagcatggtaaagagaaagggtttcctggattctgattacagaatggacctgtgggggtctcagattgaggcctaacagcatttaaaaggagcaactggtagaacagatttggggaaatatttatgggtagaagagaatgataagtgagctacagaaataggtagaagcccatctaaatatcaggtaagtatcaggggggttatggaaaatgctttggtacccgaaagatactgagtgaatgctatttgaaggaccaacaggagacagtgatggtgcaggggaatgtttagagatggcagagagaaatgtaagacatcaagatcagtacatattgggagttgaaacttcggaaaaatctcttggggtccagtgtgaaatgtgagaggtcatgtaaacattcagaggcccaaggatctggcctggcttctgaatgaccacctgcttcttccccctgtgtgtgtccccaggttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctgtgagtgcctgtgaggggacagtgtctgtgtttcttttttgccattacatacatgcttgggtacatgcttggtgtagagtccagcagcagagggccccttccgatcttgaattctattttcattcatctacatcccaatgtgagtgagcttctactatgtgctgggcactctgtttagcgctatgagcacaaagataaataaaacactacagagcccctgtcctcaaggaagctgggaagaaacacacataggttaagagacccttagaacagtgtgctacagtagacatgaacacaggggccttgggaaaatgacctgggcacctgccaggctatggggctcagagaaggctcagtggggaagatggtcccagagctcaggacaagcagaggagctggccaggcatgaaggcacacgtacaaagggagcatgacatcttcagggaacttcctgtggctcagcctggctggagttggagggacacaggaagtgaggagatgtgagcctggagaggtggacagaacagaccatgggggaactaaaaggtgataaggagtttggactttatcctgagggctctcgccactgatgggttttattttattttattttattattattattactcttgagatggagtttcactcttgtcgcccaggctggagtgcagtggtgtgatctctgctcactgcaacctctacctctcggattcaagcaattctcctgcctcaacctcccaaatagctgggattacaggcacctgccaccacgcccagctaattttgtatttttagtagagatggggtttcaccatgttggtcagactggtctcgaactcctgacctcaagtgatctgcccgcctcagcctcccaaagtgctgggattataggcatgaaccaccgcgcatggcctgatggattttaaaagttatgagatcatccagcactttgggaggccgaggtgggtggatcacctagggtcaggagttcaagaccagcctggccaacatggtgaaaccccaactctactaaaaaaatacaaaaattagccgagtgtggtggcgcacttctgtagtcccagctactcaataggctgaggcaggaggatcgcttgaacccaggaggtgtgaggttacagtgagccgagatcacaccattgtactccagcctgggtgacagagggagactccgtttcaaaaagaaagttatgagatcagctttgtataagatggatctaggactctgtcggtgggggctaggcaggagtagtttttgtttttttgttttttttctgagacagagtctcgctctgtcgcccagactggagtgcagtggcacgatctcgacttgctgcaacctccacctcccgggttcaattgattcttctgcctcagcctcccgagtagctgggactacaggcatgtgccaccatgcccggctaatttttgtatttttagtagagacggggtttcaccatattggccaggctggtctcgaactcctgacctcgtgatccgcccacctcggcctctcaaagtgctgggattacatgtgtgagccaccgcgcctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcagtgagtgtcagagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgacaatccacaggagaagagacttgcagcaggtgggtagctggagcaaactgggcctggggcacaggaaggggtctgcttgaagaggttgggtacaggaggtggctcctttaccaggctgaggctgagggaatcctgttgggctgagagccagtacaaatagtggagccactcacactggtggcctttgccctctcaccttgcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggacatgcttttctgccactccatattaaaacatatgaccattgagtccctgct

SEQ ID NO: 36051 - DNA, 8896 bp, Homo sapiens
caggaacgagatggcggttctctggaggctgagtgccgtttgcggtgccctaggaggccgaggtgaggggtcttcccaccctgaggtgcttagcgtagcctccagccagggaaggggatggaagtgaggactcatctgccgggtgggagatctcttgaggagaagaaaataccgaaatcacagcaatgaccactgtagtctaggggtccagatgtttacccgaaggtatatttcacttgctgtgagctgacgagttgagggaataatcagaaagagagctccctctggaagtcgcagtcctgatgaggctaatccacatagcagttctgttttctccccgttcactgtccctagaatgctccccactcgctcccaccctgagtcgggaaagagggttaggagcttgcccatttcttctggagttggtgtgtttggatgtgggagtggaggggggatcagttcgaaaatcatttaacctgggcatttgtgttacctcaggtactgtagtaatgctaggatacaaatgtgaagaaaacgtagttcccgccctcaacgagctttcattctgatgaggaaaacactgtcatagtagtccgggcaagatgaggtcctgaactaggaaagtagcacaaagaaaagaagattgtctcaagaactgttaaagagatacgccaataggatttggcgattgaatttaggggaaaagtctctcatgatttccagattactgagttaggttaaagaatgcctgaggtgtcattaaataaagtagggaacatgcagatgttccctggtcttaacttcacagtaaccccagtgaaatagatgctatcttcattttacaaataagatgttatcccctatttattgttaagtagcttacctatggtcatttagaaagtttgtcagtcctgttaaaggagaggttcttatgatcatcctaatgactctttcctcagctctgttgcttcgaactccagtggtcagacctgctcatatctcagcatttcttcaggaccgacctatcccagaatggtgtggagtgcagcacatacacttgtcaccgagccaccattgtatgttctctccatcgctgctgctttctgggctctagccatctttaccttcactaatggtcatgcctttagcaggacttcctacctgtaggggggactcttgtgtccaactttgtcaaatgaagacctagtttacacctttgggcagacagtgccattatggttgaatgatgccatttataatcatagaagaccttctagcctaagtctttacaaatttttttcttttgttttctttttttttgagacagagtctcgctctgttatgcaggctggagtgcagtggtgcgatctcggctcactgcaacctccaccttctgagttcaagcaattctcctgcccctgcctcccgactagctgggattacaggcgcccaccaccatgcccagctaagttttgtacttttagtagagacgggtttcaccgtgttggccgggctggtctcaaactcctgacctcctcaaactcctgacctcaggtgatctgcccacctcagcctcccaaagtgctgggattgcaggcgtgagccaccacgcctggaccactaacttacattcataaggtgtctgttcacttcactgaaccaagactggcttaattctgtagcaatacagcaattctgttttttatccatcttcttggatctgtcttctaatcaatatgtaggcattgagatacccttgtgctaaaagacttcaaaaaacagagataaagccttcaaaaaacagagatagcttctctcaactactattttgatattttacttcctttgtactcagagttatatcctatatgtacactgcctgtcagtttgggttactgtgtggcatatgttgaacatgaaagatgtgtgtttctcacatcaacttttatgaatctggtcctttttgtagctggctccaaggctgcatctctccactggactagcgagagggttgtcagtgttttgctcctgggtctgcttccggctgcttatttgaatccttgctctgcgatggactattccctggctgcagccctcactcttcatggtcactggcaagtatagcaattccaaatatagttgtctgctcagtttgtttgctgtgagcttgtcttatgtattatatatgagggagaagttgattgaaatgccctaaatttgttgaaaactttaaaatatatataaaatatgtatatgcctagatttatatatctgcctgcctattcaatgtctttcaattcgatttccgtatctaatagcattttgaatgtagcctgtcaaactgaatttctgatctcccctaatctgttcctcctgcactcttgccccatctgaattaatggcatttccagttttctctttgttcaagtctaaacctggtaagctccaaacttggtcattatccttgactctagtagtagtctcctaactggttcccatttgtgttcattcccaacacagcatacccagtgatcctgttaaaatgttaattagaataagacattccccttctcaaaaccctattttgtctcttcatgttactcaaagtcagaattcttagggttgtctgtagactctacatgattgaaccaccctgtttcttccctcatttttagctgctctctctctcattcacactgccttccttgagattccttgaacatgccagggacattccaggtctcagggcttctcttactgcttctgcctgaaactctttttctagctatacacttggcttgttccttcatctccttcaggtcttgaatgccattctctcaacaaagccttccctaaccacttattcaaaattgcagtttctgtcctgccattccttatctctcttgcttgttttatttttctcaatagtacttactgccttctaatatactacatcatctgttcattattttatatagtaattgcttccttgcattttatcacccaaatgtatatccctaaatagtatagtttattcttgcctcttaaaaaaaaaaaagagatgtatgtgggtggattattttgttatttttactgtatttgtttgctgttgtgcctctagagcctagaactactctctggtacgtgacatatagcactcagtaaatacttgctgaatgaatgagcatccagcgcctgtttgtttgtttgtttgtttgtttattttttgagacagagtctcgctctgttgcccaggctggagtgcaatggtgtgatctcagctcaccacaacctccgcctcccaggtacaagcgattctccctgcctcagcctcccaagtagctgggattacaggcgtgcaccaccacatccggctaatttttttgtatttttagtagagacggggtttcgccattttggccaggctggtctggaactcctgacctcaggtgatctgcccgcttcagcctcctaaagtgctgggattacaggcgtgagccaccatgtccggcccagcttttgtttattttatctggtatagtttgtatgactttctacgtaatgaaccttctaaaatgagggtaaatgacaggttgggttccttgagttgttctttttaagttttgcaagggacaatatgttgtcattgtggggggtagggagccactttcggattgttgaaactggaagtactttggagagtatcttaaccaactcttttattttacagatttggaaactaagacccagggaggttaagtgacttgtcagaatcattttctagctagtgttaaagattttttttttcttttttttttgggacggagtctcactctcacccaggctggagtgcagtggtgtgatcttggttcactgcaacctctgcctcctgggttcaagcaattctcatgcctcagcctcccaagcagctgggattacaggcatgcgccagcacacctggctcagttttgtattttaaatcgagacggggtttcaccatgttgtccaggctggtcttggactcctgacctcaagtgatcctcccaccttggcctcccaaagtgctgggattataggtgtgaaccaccgtgcccagcctaaaggggttttaattatctggttttgtaggactggttaggagaatgagttgttgttgttgatgttgttttttaaccacacagacctttccaaataaaagattccagttgcatatgaaatattagatcacaagtacagtaagtaatatttctctaacatgtcatccctcttgaaggagctgtctataatgtgctccacttcctcaacactgagtctcttttagcctgtattaattggggtcttatcccaactatataacttaggttattcttaccaagggcactgaaggccttcatctttccaaatccggttgtctattttctgccctccacttgcttgaagtctcagccgccttcaactcaattaacaattctccccataagtcacttttctttggctttccagatgcatagaagtctcctctgccagatccttctcctcttgtctgacctcgagatgacaaaatctccagggctgagtcatggccttcttaatttctccatctgtacccttttttaggtgagctcagatctgacctgtttttctgagctgcagacttgtttatctaattgtctaattgacatccacttggatgtctgatagttatcccagatctaacattggccaaatcgctcttttttccccccaaatctcccttgatttctcctttaaaacccccttctcaaagctatgctcaaactaaaattcttaggagtcattctagatatttctttttgttcttaccccacttattccatcagttctgttctttctttaaaaaatagtctgaatcggccaggcgtggtctcacgcctgtaatcctagcactttgggaggccgaggcgggcggatcatgaggtcaggagtttgagaccagcctggccaatatggtgaaaccttgtctctactaataatacaaaaattaagctgggcgtggtggcacacgcctttagtcccagctacttgggagactgaggcagaagaaccgctggaacccaggaggtggaggttgtagtgagccaagatcgtgccactgcactccagcctgggtgacagagtgagactctgtctcaaaaaaacaaaactctgaatcggtcgaggggaaggggagggagagcactaggataaatacctaatgcacgcggagcttaaaccctagatgacgggttgataggtgcagcaaaccaccatggcacatgtatacctgtgtaacaaacctgcacgttcagcacatgtatcccagaacttaaagtaaaagaagaaaaaaaaaaaggaaaatggacattattagaaaaaaaaatagtctgaattgtcactttgcaccctgtcaccagcctaggttaagacaacagtctcacgtaggctacttcggttgccttctaactagtttcctcttcagttgttgctctgtcccccacccactctgttcattcatcacactacagccatagtgacctttttaaaacgtaaaattatattcctccaaagtagatatacaaatggccaataagcacatcagaaattgctcagcatcatttgtcattagagaaatgcaaatcaacaccacaatgagatgccacctcacaccccattaggatggctgtaataaaagatgggcagttttaagtgttgctgaggacttggagaaattggaaccctcgtggttctgctgggaatataaaacgtttcaatcactttggaaaacattctggcagttacaacaaaaagttaaccttagagttaccatctgactcggcgatctacttttaggtgtatacccaagagaactgaaaacgtgtccacgcaaaaaacttgtacaggaatgatcatagcagcattatttataatagccaaagagtggaaacaatccaaatggctgtcagtggatgaatagctaaacaaaatatggtgtattcatacaatagaatattattcagccatacaaaggaatgatgtattgataaatgctatgacatggatgaacattgaaaacattatgctaagttgacacaaaggccatatattgtatggcttttttttttttttttttttttttgagacagagttttgctcttgtcgctcaggctggagtgcaatggtgcgatcttggctcggcacgatctcggctcagcacgatctcagcttactgcaacctccgcctttcgggttcaagcgattctcctgcctcagcctcccaagtagctggcattacaggcatgtgccaccacgcctggctaattttgtattttttgtagagatggggtttctccttgttggtcaggctggtcttgaactcccaacatcaggtgatccgcccacttcacccacccaaagtgctgggattacaggtgtgagccaccacgcccagtggtgtatgggttcttttatatgaaatgtctagaacaggcaaagccatagagacagaaagtaaatttgtagttgggtagtgggctaagaggtagagggtttctttttggggtaatgagaatgttctggaattaaatgatgattgcacaactcaatatactaaaaaccagtggattatatactaaaaagcgtgaattttttctggcgtttgacttacattgcaataaaactgttataaaaatagtaaaattaggtcactcctaatctcaggcactccctgcttaaaatgtatcagtggtttcctattatatttcatataaaattcagattccttatcatgaccttcaagaccctatgcaaccgacccctgccttcctctgatctctgcttcacccatgtgctccagccacacaaatcttactattcattagagatgccactttggtttggatgttctcattcatgtcttcctttctaaagtgtttcttctcagtacatatatatttactttttccttctcattcactagtatattccataagggtagggatgctgtctcacttactatactcccaacatttatgacagattctggcacatgatatctacttaataaattctttttgaattaattaaaaatactgtagagttttagttatttttagttattggggtgaaaggatcacttgcagccaagagttcaagaccagcctgggcatcatggtgagaccgcatctttaaagaaataaaaaacaggccaggcgcagtagctcacgcctgtagtcccaacactttgggaggctgaggtgggcggatcacaaggtcaggagttcgagaccagcctggccaatatggtgaaaccctgtctctactaaaaatacaaaaattagctgggtgtggtggtgggcgcctgtagtcccagctacttgggaggctggggcaggagaatcacttgaacccgggaggcggaggttgtagtgagccgagatcgtgccactgcactccagcctgggcaaaagagcgagactctgtctcaataaataaataaataaataaataaatagaaggaaataaaaaacaattagccgggcatggaggcatgctcctatagtcccagctacttgggaggctgaggcaggaggatcacttgagctcaggagttcgaggctgtagtgagctatgatcaggccactgcactccagcgtgggcaacagagtaagactttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgctttt

SEQ ID NO: 36052 - DNA, 91977 bp, Homo sapiens
gtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccgggtaagtgtcgccgccgcccgcgtccccttcccccatctggcacagcggtcgcgcggcgggccctggcacggtgggccggggtcgcatggtccagggttccggtcggcctgagcccggcccacgcgcaggtgtgtgcacgggagggccccggcgcctcccgccccggcaggtgttgcccactggccgctttcccggcgcgacagcccctgtggagacaaaagcggttcgagtcgatgctccactaggctgccggaggtgtgggtcggactcgtgctgcggggctgcctgcggcttcctcggccggagccttgggatccctccctctgcgctgccgcttagtacccggcctagttgccggagtggccgagggcgagggacgtccgaacctcccaagacgcatcttgacttgtgctcatcgctgccagggatcagcccttaattctgtgttggactcgagaaacgggagagtggagtttggccgaggccgaacgaagctcaccgaatgggaggaacggagagatgatgtctttgtcccgaccccagagtgcgaggatcggtataaagttactcctaggaatgactcagcctgcgcccgccccacggatagatttgggatgggtgtgcacgcggatttcacagcttccttggtagaaacaaaaatacattaaccaacagtagaaatagcagcttctgaatggaatatctctatagtttcttccaccgcctggtggatgtgctgtgtttactgtttatggtttcgtaatctagtcgtttccatcatgactctttaaagtgtggtcataccttgaagtagtgtagacttggctgccaaggaagactcatgtgctcactgttgataaagagtcacgttactacgagacattcagccagatgggaatgttctcaagtctgctgcaaacatttaaagtgtacctatttgctaactattttattgtgtagtttcttaagtttttgtgttttggtgaagcttgtatgatttatacataagtttggacagttagcaatttaggaagagacttaagtagacttaattgtgtgtttaatcaagaatgttattacattgtgatagacgataaaaagagggtccttccacttctgatcagataaaactgtgagaaaccaaggaactactgagggaggtggctgattttagtttttggattattggatttataagcagaccattgctaggaatgtgaaaatatgttcgctttttatatttgttgtaacagaatatggccctaatgaagatattttctcaataacattcctgtcatgtcttttaatgtttgtgattgtgttcaaaacctggataaagttttatgtcagggatgctttaggcacataatgcttacgttgagaaacctctgttgatggaaagtggatattgacatagttcatatttttaaagtaattttatttagtctattttgaactttttatggtaatcaagatatgattatttatgtacctaatcctttatatgtttgttattggacgacagggaagacaatgaagcggtacttttgtccctgagttttttttttttttttttttggctcttgctgccaaacacaagatcaggatgcatggcagatttactttagcaaatcaagttcataaaggcagaagacacaagacttttgttttcgaaattttgaacctaaattttgattatgttagcctgagaaaagtttttagactctaatattaacttaaaattttatatcatacattcagcagatatttgagcacctacatgctttactttgcagatgtgtatgtcttatgaatatctttttaaaagaatggctgataaaattttctcattcaggtaatgatattttctgactccagttacacttttcttttgtagtaatactggcctaagacactttgaaaatctagcagtccctttcaacacactttcacgattcttttattatctttttaccactgtgaggtttttgaactagttacatgaggaacataaaaatgtttaagtaattgttcttgagtagagacggggttttaccatgttggccaggctggtcttgaactcctgacctcaggtgatctgcctgcctcggactcccaaagcccggccactgattgccttttgaataaaggcccaagagaagtaaggggtgtaagtgtgtgactctcgaaaggaatttttggcagaagaaacagtaaatggaaaggctctgatatacatggcatataccaagaaaaatgaagttactgaagctggactggtatgagagaggcgatagtaatggtagattgtggggctctacatattcaggtttggaagtcatagtaaggaaactaatgtgctctaactcacaaaggtctacagatgaattcaagtaaacccagcatggctggaaagcagttgaagccaaattcacttcatttattcctgaaatgctaattgaacccctgcagcatactcttttagcttcagcaatgcaacagtgaacaagaaagacatatctgtctatgtatatatatttatttataggaaatgggtaaccactggaaattttcatggaggtaaatgacaaacgcagattactttgaggatgtagagtagataaaaggctagctaagccgattgtatagtgctaggttgatgagtttttgcttaactcacatagataaaaggatgtgaagattacttgtctctgattatttattatggaccaaatcaacttaatttgactgtaaactgtacccccattgtttagggtcctgagaggatggcatttctttctatccctttgtaaagttccggttctgttggattactttttgtaagtgcagtacttgaatgcctccaagtaccctctttccttggctaatttgtttctgctttcatggctgtttagtgagtgctttgaggattgtggaataacaatcctcgcccattttttttcatccatgatttttttctacccgttagtttgctcttttgaactctcatattttattggcttgtaattgtgctaggagataaaaataattgtgttccatttcctttttttgtcactgatttgagactgtccactcatttttccttcacattccacacattatacttgttcagtaactgtccagcatacctgttgaaatattaattcaataccatattatattacagtaatataacggcttttagtaattgttttactgcaaataccagatttgggcaggctggtttaataatttggttatatgtttatagataatcttggtttaatagaatgcagctaattctacattttcttttttttccccattttccctgtcttatataattctatatttgctatatagataattttggttttactgttagtttccgttataaaataaaacacaactagaaaattttcactaaaatcatgcattttatgtagtttttataaacgatagggacaccaaaatgtgtaatgcatttatatgtactgatacagaaagatttctgttattttatgcagttcaagcaaagtccatagtagtatgtagggtgtcacctcatttttataaaaccatattgcctgaatatacacatatttcctgtacacctagggaaaaaaacctgaagggtgtactccaaagtatttttcatttttgttttaaaagtattcctgttctgctatttttacctcatttgctgtctttgggcactacctttctaaatgctcgcttcattcttttggcgaagttgcttgtctagtttgtagacaaggcgtatatttaggaagtctgaacttttatgaaaaaggttttctttcagggaaatgtgaggaaaatgcctgacctactcatctttcattctttttcttggcagagaaggggtaggatcagattagaatacatctgatttggggagactgatgcccagttttcagtccctgggcaacctagacactccgtttgtggtggacattatctccattgatgcagtagcccgtgacccctcaatgagggagaattgctaataattgcagtttacagaattagagatcaggcaaaattatttccaatcatcttttctctgaagcttttagtccactttagggttatctgagtctcatgtgttctattcagctggaaagcatcttgaagatatttgtattccaggcacctagcagtgtctggcttatgtttagatgcccccaaaatagtggatgaataatgaatgtgtccagttttgaaggtcagagattgtcattggggtgtccccctttcaccttatcatataaggaagcgaattctgttttgtttgtttgtttttgttttttaaggcagagtcttactttgtcgcccaggcaggcgacaggcaatggtgtgatctaggctcactacaaccactgcctcgtgggctcagatgatcctcccacttcagcctcccagtaggtgggattacaggcatgcactaccactgccaactaattcttgtattcttagtagagacggggtttcaccatgtttcccaggctggtcttgaactcctggcctgaagtgagccacccacctcggcctcccaaagtgctgggattacaggcaggagccactgtgtctggcctaattctaagttttgactgtattagaatagttgacagtaaggctgggataattgactttatcatcatgataatctctcgagaaaattgtaaatctccacttgataagttggatagattttaatgagtatgtgagatactttctggttcttttcctcaaatatggatatatatgggttcagttgttattcctgtacatctggaaacaaatgcagtgggatcaatatatttttatttttatttatttttttgagatggagtttcactcttgttgcccaggctggagtgcaatggcatgatctcagctgaccgcaacctctgactcccgggttcaagcgagtctcctgcctcagcctcctgagtagctgggattacaggcatgtgctaccacactcagataattttgtgtttttagtagaaatggggtttatccatgttggtcaggctggtctcaaactcgcgacctcaggtgatctgtccgcctctgcctcccaaagtgctgggtggcatataaagtggactaaaagcttcagagagaaaagatgattagaaataattttgcctgatccctagttctgtaaactgcagttattagcaattctccctcattgaggggtcacgggctactaccgcatcaatggagataatgtccaccaccctgtcggatcaatattttttaaaatacagctctcttctccccttcatttatagctgactgtatcctaggaggatttaggaggaccagatgtcctcataatgagagataggtttttccccccagataagagaattcctgctaccttatattaactacttaagagttctgtaaattcagagaaaggagaaagaatactataggccacctgtgataagggaagacttcccagaagtggtaataggacaatacttggacttttgtttgtttgtttgtttgtttgtttttgagacgagtctcgctctgttgcccaggctggagtgcagtggtgtgatctcaacttactgcaagctccgcctcctgggttcacgccattctcccacctcagcctcccaagcagctgggactacaggcatccgccaccatgcccggctaatttttttgtatttttagcagagacggggtttcactgtgttagccaggatggtctcgatctccttaccttgtgatccacccgcctcagcctcccaaagtgctgggattacaggcgtgagccagtgtgcccggcaatactttgacttttaaagatgagtaaaattcagatcagcaaagatgggggtattttacctggcaggagtatgtaaagtgagggtataggtttgtcatgtaagggagtagttgatgatactgctacaaaaataaactggggttaattatgaagttcttgagtgctggagtttaattaaagtcataattgccaccatttttaaagcttttagtatattcctagcaccgtaaaggactctgaagtacattattgctatccttctcatctctgtgaaaggtatcgttgcaatttatagattgtcaactgatatgtggaggttacctgagcctcagtgagatagatggtattcaaatacaagtaaattttgttcctaagtctgccatttttatgttaatctagcctatatcaagttggcaaattcacatgctaagaggggtgggcagatagtacaattaagtgaaactgtctgagtactgaaccggaggtgacaaagagagtgtagctgtaaagaaactacagatttgtgccctgctgtaggcaacagtaaggtgctagggaagatacttgagggaagcagcctgactaccttggttgtaactggtagggagtatttaggaaggattgaagccggatagagatttaaagacagagagaagaggttgcagtttcctaagtaagggttatgtcattggaaaatgaggggttggattagaaaggaaaaaaatgggtaggacttggacagaaataactgaagcctggtccattgtcactttggaaagtttgtaaaaaaaaaaaaaaaaaaagaaagaaagaaaaagaaaagaaaaataactgaagtttggggcaatagtagaatgatagttcattgacagtgaataaattagggaatagatttaaaggaaaagcaccgaatttaaatttggacatgttgagtttgaggtaacagtaggatttccagctggaaatatgaagcatcagttactgctagctctaaactcagaacagagatctggattagttaataacagtaattgatgtttgtatttcactttatggtttacataacttccatatatgtatagattattcgttagatcctgaccacaaccctgtgagacaggtacttttactttttgtaatcaaatgaaaaaacttgttaggtgaagtcagttcaggtcacattgggccaggacttgaatatacttcttttgattccaaatctcatgttcttttcacagttctgttctccctcttatgtttacataaagataacaattggggcgtggtgactcatgcctgtattcccagaactttgggaggctgaggcagacagatcacttggggtcaggagtttgagaccagcctggccagcatggcgaaaccctgtctctactaaaaatacaaaaaaaattagctgggtgtggtggtgggtgcctataatcccagctactctggaggctgaggagagagaatctctctctctcttttttttttttttttgaaacagagggagtctcgttctgtagcccaggctagagtgcagtggcgagatctcggcttactgcaagctccgcctcctgggttcacgccattctcctgcctcagcctcccgagtagctgggactacaggtgcctgccaccacgcccggctaattttttgtatttttagtagagacggggtttcactgtgttagccaggatggtctcaatctcctgacctcatgatccgcctgcctcggcctcccaaaggagaatctcttgaacctgggaggcggaggctacaacgagctgaaggctgcagtgagcggagatcgcaccactgcacccagcccctaggtgactgagtgaaagtccatctcaaaaaaaaaaaaaaagataacagttggaagactaaacatgaatgaccatttagggaaggctatatttagaatgggagtggggcagaactcccctaggacctcagattgggactgaaatagggaaggctggtgggaatctttgtcttgctctcttggtgggactaactcttttggtgcaacaaattcaggttctttatttctttgtaatgtatagggtgtcatcttttttttttaatggatatgtgtttttcccctctaattataaatgtgatttttaaaagaactgggagaaagtaaaagtctggcatccagagatagccagtgttaaaaagattgctattaaattgatccagactttttaagtgcttgcatatacatatgtcctcctgcattagttgtaaaaataaaatccacaaacagaatcacataatatatactgtaaattgctttttgtactgatcaatacgtatagatcaaaacatttttaaatgtctaaaatttgataccttatagggttgtgtaataatttattatttttttggagagaggatcttgctgggtcacccagcctggagtgtagtgatgccatcatagctcactgtagcctccagctcccaggctcaagcaagccatatcctcctgcctcaaccttctgagtagctaggactataggcataatttatttaaccaacctccattgatagtttttaaattcatcattttaaaaagtgatggtataatgaaaatcattgcatatatatacctttgtacacttgtttcattctttgctcccagaagtagaattgctggtttgtacattttaaattttgatacatagtgccagattaaattcccttaaaagttataccagtttatatttttgtcagaaatgtgccagtggacccactgttaatcttgtcaacacttagcactcattttaatcattagtagtaatctgaagggtaaaaagtagtaccttgttgatgttttagttctcattagtgaatatgtacctccagatagtttatttttcttcatgctatggatagccatttgtcataataccattgcatgaaaagttgatcctttctccccaatttgaaatcccaccattattgtatagatacacaagtgcaggtatgcatgtataaagatcaatttggatctgttcagtttcatgcattatgtttattaatgcatcatgattcctactaacttgttaactaccgtgtgagttatgagtatgtttgacatgttttgacagttgttctgtcctacgaagtctcagtatatatggtaggcagtttatagtaattcttagtgggtagaaactaaagactgtttaagcagagggtcaaataatttaagaaaatcttgtgtcagttgttgagttactaacctgttacttttaatttagaattggcttgtgttaacttgtatagtattaaatatggtttcattttataaaagttaagaaggactttatataaaatgagcatcaagtcagattttaggaaatcgtgactatttggtgaaaagtaatacttatgtactaggcttatttatataaggcttataaagttactttataattccttgaatagcagttgatttctgtgcttgtaccttacttaacaattacatgcaataactttagttctagatcatagagagtcaacccacttacaggatttaatggactttacgtaaattaggggtacatgtacataataagcattcccaaagttgcaagttaataaaagaattagctccttttaatgattgttttcttaaaagaaatcattggtttattaagtttatcctcttaagttttagtaatgtgatcagtgagggtaaactgtcagtttctagttggaacttgattttacatatacttttgtgtttttttttttttttttttaatgtcacctttgtgtgaattcttgtccattctttctcagtctaacttttgcatacctctcttcatattagtattattgaactttttggaaggcaggtaatgtgctttttattactttttggcactaacacacaataagtttcttaaaattagtatttgttcagtgtgttagactcatgtttaatgtatgatttgactatttatagaagatcagaagaataatctagtgtacccctttatgttttaagatgacgaaactgagattcagagaaattggataactcctgaaatcacaggagtaaagatgtgaagctaggactaaaaaccagatctcttatttctttccaagtattttttatttcagggtgaccaaatatgtacttggttactgatgtccctttttgctgaatgttttttaacaattgtggcatacaaaggagagaattcagtttcatgggatcatgttattttgatagcatataggagtatgtaacataaagtatacagtcttgtgaataaatagcgacagtgttcctgtggattctctctgagcaactttctgatttcagttttggttgccgtagtccttatccatggttttgaccgcaaacatttattgactgtttactgtctctaggtagtatgttaggtattgaggtatgatatgtcatgaccaaaattttttttagccatttgcaatacagcttgggcgatgtaagttatttggcaagtggcaaaaaagtgtagcagggcatttatttatgttctgaataccaacacttacttgaatagttggaatttgaagtatgggctgtcagtacttcaggaacaagaccactgacagccagtacattgaggaagactttacgacagaatatttgtgaattcttggttacataatggaagctgtggaatgacatgagtagaggcatgaaaatccatttattcatgcacctcatttcaggagatcagcctaaatggtatggagcttcatgtagggacccaaataaaggaaatagtggagtgtcagtctaaggaatttatacttgagtagaagttatgaagcatttttagtttggggagaagtaaacattaaaagaatctaagattatgtagttggtggtgtcatctgagatggaatctgcagatagtaggtgctcagataggtaattgttagagcccgatatgcagtaggaagatctgaattagatagcttaatgggaataaggtggaagagaggatacacatacttagtaactgtttatgtggaaccaaggagtacttattcatatatgatgttaaaatatattaaaccaagttgattacttttttttttttaatataagatactgggaacacattggctgataaagaaactgctgaaaattagctacctgcatgtgatctctctctgttactaagttactatttggattctgctttgtcatttgcttagagtactgctactagaaccccaagagtacatttgcttatgaaaccctgtttattcaacagatgcttttgagtgctttgtgttatgtcacagagttacttcctgtccctagagaacattttgggaatatttactgtgatttcttttttttttctgcaacagccatatgaggtaggtatgataaatatccccatttacagattagagaatggaaatttagacagacatgtattgatgaagaaagttgttttcttgttttatctacatttttttcttcttcttttctttttttttgagtctcactctgccaaccagctggaatgcagtggcatgctctcggctcactgcaacctccacctgccgggtgcgagtgatcctcctgcctcagcctcctgagtagctgggattacaggcgagagccagcatgcccagctaacttttgtattttcagtagagatggggtttcaccatgttggccaggcagtctcgaactcctgacctcaagtgatccacctgcctcggcctcccaaagtgctggaattacaggcatgaaccactgtgcctggcctgttttatctacatttctttccctgataataaagccatgcagctcatggatcttctggagaagattcattcagtagaattttataactttgacttagattacacaaaattggtctatgtaggtcatatgatacttcttttaataagagaacttaaaacattagcatgaataggtatattttattcatcctggtacccatacagagtatttaactaattttataaaccatacatttcaattaaaatctgaccagctttattacatgaccacataaagattaataatccagggttgaaataacagctaaagatagaaatagatagttttggctgtgcaaggtggctcacgcctgtaatcctagcactttgggaggccgaggtgggtggatcacctaaggtcaagagttcgagaccagcctggccaacattgtgaaacttcatctctactaaaaatacaaaaatgagctggacgtggtggcaggtgcctgtaatcccagctacttgggaggctgaggcagggagaattgcttgaacccgggaggcggaggttgcagtgagctgagattgtgccactgcactccagcctgggtgacagagtgagactccatctcaaaagaaaaaaaaaagtgatttttttttttttcaaagaagactttagtggtataggagctaaggtaaagaagagaaaatttgagatcaagcagctttatcaagagatttaagtgacagaaaagtgatgatctggccgagcatggtgagtcacacctgtaatcccagcacttggagaagccaaggtgggaggatcatttgagggctggaattcatgaccagcctgagcaacatagagagaccccatctcttaaagaaaaagaaaagaagaaaaggaagtaatgatccttgtgagcaaaaacaggtcagtatcctcttgttttgactggatcagagtgttcaggcaaagcagtaatcaaactcctttttccatttactgctgttgtatagatctggtcccttggccagtcacagtggctcaagcctgtaatctcaacacttggggaggccgagacaggtgaattacctgaggtcaggagtttgagaccagcctggccaacgtgctgaaaccctgtctctactaaaaaatacaaaaaattagctgggtgtggtggtgggtgcgtgtaatcaaagctgctcgggaggctgaagcaggagaattccttgaacccaggaggcggaggttgcagtgagctgagatcacgccattgcactctagcctgggcaacaagagcaaaattccatctcaaaaaaaaaaaaagatctggtccttcacacattgttatatacataaggttgtacagccatttgagaaagagaccagttatgtctgtttccctaaacaactggcttgagagtccaatttatacaacttacttgtagaatctttagtaattaggcactttgggtgtcacctaggtcaacctccctcttaatgcagtgacaggtccagggaaattcaattcaagtaaagatttcacgtttcatgcctgcagtggttgttgttaaacattgagattgagagtgtagtctgagaataagaaaaccttgaatatcctttatattggttagatgttggtgcaatttgtttttgtgtatacatgtttacttataggaaactgtaattttcattattggcaattgtttctatgttccctttatttagtaaagcatatttagtgtttatgccttgccatggatacagggtggtcatatcagacattgtttgtatgttctgctcatgttaatggattggctgcaaataagatatgccaatgaccaataagatatgcttagtccacacttaattaagaacatgttgctgattttttttcttttctttttgttttttctaaagatagtcttgctctgttgcctaggctggagtgctgtggcacagtctctgcttgctgcagcctcaacctcccaggttcaagccatcctcctgcctcagcgcccccaccccacccccccataactgggactacaggtgtgcgtcaccacacctggataatttttgtatatttgtagatatggagtctcaccatgttgcccaggttggtctggaactcttgatctcaagcaatccacctgccttggcctcccaagggtgctgccaatgcacccagcatgttgctgattttctttgagacatagtggcaaagaaaattttctcagctctgtcttaccaccgtgaaagactgccttcagagtgtttcagttacctcttcccatcaatatgagaaaagatgagtgtgaggaataggtagagggaaaaattaaagttttttgtgtagcatgaattatgggaggggattatataggtaattctagcatgcacatagctcttgtataggcattgtgccagtaggtaggtattagagtagacatggttctttgtagtagccttttataaaattgacttgctttggtgaaacagctcctggcatcattcagacatttttatcctgttgtgtgggtgtggaaacactgggattgttctataagctttcttttgtttttgtgtgtatatatatatatatatatatatatatatttttttttttttttttttttttttttgagacggagattcactgcagtgcagtggcagaatctcggctcactgcaacctctgcctcccgggttcaagtgattctcttgcctcagcctctcaggtagctgggattacaggcatgtgccaccatgcccagctaattttgtatttttttttttttttcactagagacagggtttcaccatgttggccaggctggtcttgaactcctgacctcaagtgatccacctgcctttcccttccaaagtgctgggattacaggcgtgagccaccatgcccggctgtatttttataattcttaatggaaatcaaaaacacagaaagataggcaatagaagaatgagctatgatgtacccatcattttgattcagttatcatcacgtcatggccaatcttgttttagctatacttccatctgcttctcattctcttgttacttttgacctgtaaattttgaagaacagatatcccctacagtagccctgtgaggaagatgttatctctacttttgagatgagaaaattgaatgttaggataaatttcttttctaaaatcacccagcttgtaagtggcagaataagaattttaaccaggtctgttaagttcttcctctgcagtcagttgtttttccttctgtttaggtcagattataaccaaggagggtggtgtattctgacagcagctaaatgttttactggagtattaccaattcagtacctacagacacttgttaattgttttgggttagggttagcttagagttagatttttttcctttcctctgcattatttttgaccatttaaaaaatcatattgaaggccgggtgcgctggttcatgcctgtaatcccagcactttgggaggctgaggcagacagatcacctgaggtgaggagttccagaccagcctagccaacatggcgaaaccctgccttactaaaaatacaaaacaattagccgggcgtggtggcaggcgcctgtagtcccagctactccgaggctgaggcaggagaatcacttgaattcgggaaggggaggttgcagttcactccagcctgggcgacagaccgagactctgtctcaaaaaaaaaaaaaaaaaaaaaaaaaaaaaaaaaaaaaaaaaaaaaaaaaaaaaaaaaccaaccattacatatacagtttttgttaatactgtaagccttattaaaagttattctctggccaggcgcagtggctcacacctgtaatcccagcactttgggaggctgaggcaggcggatcacgaggtcggagatcaagaccaccctggctaacacagtgaaaccccgtctctactaaaacatacaaaaaattggctgggcgtggtggtagtcccagctactcgggaggctgaggcgagagaatggcgtgaacctgggaggcggagcttccggtgagccaagatggcgccactgtactccagcctgggcgacagagcgagactccgtgtaaaaaaaaaaaagttattctctcatattttaaaatttctattcaagacaaccctgggcaacatggagaaacgccgtctctacaaaaaaatacaaaaaattagctgggcatggtagtgcatgcccatagtcccagttacttgagaggcttaagtgggaggattgcttgagccggggaggttgtgaggttgctgtgagctgtgatcccgccactatactctagcctgggtgacaggacgagatcttgtcttaaaaaatgtataaataaatcaaatttttaatttttatccgtaacattttaaatcctgtcttaaaatatgaataataaaagtatgggtagacaaatatttgttactaataaatgtaggaaagtgtcttgtgtatgctttaactatatttcaaattttttccctaaaattgatttcatggtacagttattggcttaaggaaatgtgattttataaaacctttgcttacctacctctacaaacaccagttgctttccagaaacatcataattatttaaaatacattctgacctgtaatatgaatgttgaatgtgattaaaataatacattttctagtgttttattatggaaatttgcaaacatatacaaaagtagagagaatgttacagtgaacctaatatagccatctcacttgctttaataagtaccaacattttgccaatctcacctttctactgcccagctaattctgttctttccttccagccttccttccttcgcttatttttgctagactagtttaaagcaagactcaggcatcattttacacactaatttttcagagttcattttctgttactacaatgccattatcatccaaacaaaagtaattctaattctttagtataatccgataccctgtccgtatttagatttgcacatttatcccaaaaatgttattatacagttgttttaagtcaggatccaggatctgaacaaattcacacatggcatttgtttattttgtctcgtccatcttttttagtttataaaaagtcttcttttttttttttttttttagtaaccatttgttgaagaaacagagtcattgttctgtggaatgcttattctgaatttaactgattcatcataatgtttgtctttttctttatactccatatttcctagaaactggaaaccgtaggtacatatagttgcttgattaaattcaggtttactttttcagaggtggtctggggtggcaagaaaactttatacttgggctgtgtccagttgaatcgctattagctggaggttttccatataaatggactgaaatacgtatcttttttgttttgttttgttttttgttttgagacggtctctctcccttgcccaggctggagtacagtggtgtgatcttggctcactgcatcctccatcccccaggctgaaacaatcctcccacctcagccccgcaagtagctgggagtacaggtgtgcaccatcatgcctggctaatttttgtatattttgtagagacagggttttgccatgttacccaggctggtcttgaactcctgagctcaagtgatcagcctgcctaggcctcccaaagtgctagaattacaggcatgagccactgtgcccagctatccaaaatacatttcatataggaaggacagtgcttaatttctttgctttttaagtttttatcatgggttctatcttagctcactgaggttttttgtttttgtttttttgagtatcattatgcagcatggatttttatgggtttttgccattcagttacttgtactcattcttttgatggtcagactgtcccatcatagccagtagaagccttttaaagttgttttccttgcctttttgacctaatctctttagtctttgttagctgtcttgctttatggcatattaagatgttccaggcttatgtgattggtacattttctactttagacatttagcattagccacttctccaaaggttctttctagaaaccaaagtaggccgggcgtggtggctcacacctgtaatcccagcactttgggaggccgaggcgggtggatcatgaggtcaggagttcgagaccatcctggccaacatggagaaactctgtctctctgaaaatacaaaaattagccgggcgtggtggtgggtgcctgtaatcccagctacttgggaggctgaggcaggagaatcgcttgaacccaggagacagaggttgcagtgagccgagattgtgccattgcactccagtctgggcgacaagagcaagactccgtctgaaaaacaaaaaaaccatagtatgagtgtgtaatgaggttagccaactctacagttagaaggaacagtcccacaaaactgccctcatttcaggtactagtggcaagtttggcggtgcccagaacccaccctcacttcaaaccagctgactacaaactcacaggttccccatatccaccctctctttggagaattcactggaacaggtcagggaacgaaggaaagcactatactcacaattacacttttattataagagaaggatacaaaaattaaaatcaggcaatggcagagagcagaatctggaaggggtccaaactcagagcttctggccatcattgctggtggagtcatagacagtgttaccttctcttggccacaacgcgtgacagtatacacagagtattgctcactagggaagctcacctgagtctttggtgtccagagtttttattatggcttgatcctgtactgtccacatgactcacctttagtctctagccctttctggaggtcagaccaatgtctttagtcagtagttcctctggaggtcagaacttaactgatacatgagtcacgttgctacactgacgtgactgaagccctaaggcaaacaaacacagttctatctgtcaggatattacaggggcctagagatcacctcccagtagcgaagggcaaaggccagacctttctttggttaatgttaatttttcactgcctgttgtgctgtgggtacttctggctctaggtctgtcaatgccttcttttcaatggagctatggaataaatgttttatggaaagagaaaaattcttgtttatactagtatttctaaagtactttttacttctttatacattttatttcttttctcttgggttgaaaaccttggaatcttaggtcgaaaatcttgcttgcttagtaggagaaaaatactgtcttctttttagatttgtaattctttgattactgaagaggcctcaaatattttccacatttgttaaccacttgataacctactcatgccctttgcctatttatctattgtgagtctttgtgattttcttattaatttataggaactcctactaaaaagctaatagtaatccttagtcacttgttattgtcattttcaccagtaatcacatctttggatatttgaattaaatgatgggtggcaggtatggaaaatatcttcttctttttggttttctaccctttcctctcccactaaactagaataccagtcattgtgtgatcagtcctgggtctatcatctgttagaaagaaaactgggaaattgggcttgtctctgggcaggacttctttgtattgttgctgtcacttccatatgatggaagtgctgcttaccaggaggttcagtccttcactagtagatgcctggtattaactaaagtatgtgcagctctcactgaagtggctgtagttgcttaagctttggaggaagaggcacacactttctctctaaaggaccagatagttaagtattttaggctttactctccaagaggcaaaattgaggctatgatgtatagatgtttaatgtaataagagagaaaactcctgctgcgtcccgtttgtccgggatgagccatccaggatggtgggcatgttttgtgcccagttggcatcagttcgagactgtctccggatccacaggggactacccgggggggatgagcctgggagtagaggccaacaccatgttattttctgctttgagagcagatcctgaatcaccctcctcttcttcctgaaagcctggtgggagaccacgtgacctgttgagtcttccactctagagccaagattatactcctcactgtcctgcagttgccagcagtagggtggagttccctatttgaaggtggccccagtgtgtgtcctgggagtgaagtgtgtgaggatgcaaaggggtagctgtctgtgttaaacactcagctctgttcttggctacgataggtaggttctcctctatatgtttctttagctgtgaagtgttcagtatgcacatttctagagaattccacactgccaggatgaccaggtatggaaaaatttctctctgctacatgccaagatcaccttttcttttcttaaattttaagttaaagggtacatgtgcgggatatatgggtttgttacataggtaaacatgtgccatggtggtttgctgcacagattatcccatcacctaagtattaagcccagcatccattagctattcttcctgatgctgtccctcctcccacccttcaccctctgacaggccccagtgagtgttgtttccccatcctacccccgtgtgtctatatgttctcatcagtaacaggattgctgggttaaatggtatttctgcctcaaggtctttgaggaatcgccacactgtcttccacaatggttgaactaatttacactcccaccaacagtgtaaaagcattcctttttctccacaaccttgccagcatctgtctttttctttgactttttaataatatccattctgactggtgtaagatgatatatcattatggttttgctttacatttctctaatgatctttgatgttgagcttttttttcatgtttgttggctacatgtatgttttctttttcttgtaaatttgtttaagttccttgaagatgctggatattagacctttgtcagatggatagattgcaaaaattttcttccatcccgtaggttgtctgttcactctgatgatagtttgttttgctgtgcagaagctctttagtttaattagattccatttgtcaatttttgcttttgttgcaattgcttttggcttttttgtcatgaaacctttgctgtgcctatgtcctgaatggtattgcctaggtattcttctagggtttcatagttttgggttttacatttaagtctttaatccatcttgagttgatttttgtatgtggtgtaaggaagggattccgtttcagttttctgcatatggctagccaagactccaagcaccgtttattaaatagggaatcctttccccattgcttgtttctgtcaggtttgtggaagatcaggtggttgtaggtgaagatcaccttttcatttatggacacaaggaaatcttgttctctcaggatctgggtccatgccatttcttggatgatgactttgctttctgttgaaaaccttaccttgtcacatttaaagtgttctgttattccactcttcttacttcatattgaaagaggttttttttgtattgtatttagtaaaggaaattttttaaatggtcacataagggagaaaatctgcaaggggaaaaaagtgttgctatttctaaaggaatagtaaagtcccaagtcatagaatatgcttactacatgtagtcttatttaagggattttaatgtagtatgttcatgttcttttttcccccgtgatccagctatggattttaagtttttacaactttctttctatgtgactttaggaaataacttctttgagccatagttttgtcatatgaatgatgcggataattcttaacctctctcactataggatttgtaagaatatcatatacttcatacagttcttactcatgtttccagtcaatggaagctattgctatgccaacagtatcattatctctaaagaataaaagcaaagtggaagtatgtattttggaacttcatgtttgtttttactttaaaaaaaagattttttgtagcttttttccccctgaaagtaggtatcatggagttttatataaatataaaattttcatgttgcccactatgatattaaaattcatgagagcagacagttttattattttgtattttattcccaaagttaagaaaatgcctggtacctaactagattctcaggtgatatttttattgaatgaatgaatttattgacctgtgttcacacccctggctaagtttacttttgttttggtttactaagtttgttcctttagacaagtttaatctgaattgtaatttctcatctgcaaatggaaaccctaatgatatgaatgtattacatgtaatgataaatgaagtcatgcatgtaaagctacttagcattatgagtggtatacaatgaataactcaataagtattagcaatgattatgattatgattttatgtgccatttacttaggacatgtggaggaaagaagagcatttgtggccgtgaaagcaatgagcgtcacatttcctcacaggttaccggtactggtagacccatgggaaatgatgccttgtgttagtagttggatttttctctgttgttcttgggtagacttttggtagctggcagttagtgaggatgtagagagtgaaaatatttagaagaggcttctgattaaagatgccagtcttaggactatacacaatggatgaaaacgtgggaaaatgatattgtcattaacatcacttaggagctgttagaaatttgtatactggagtcaaattttaggttctagagtcacagttatcaaaactatccttgaagtggtttaaattaattttaacctaggttctggagccagtgtaatcaaaactatccttaaaatagtttaaattgttcatcaagtatgtagacaaactcattctcaattaggtttatttctttcagctttttttggtcagcattgtttatgattatggtttcttagggtgaggtgtgtgcatgtcaaatgaagagattagtgtttgtttaaaggcacacagctgctacagcttattggagtttccctcaatttgctttaagtatcatggaagaggagaatggaactgaggtcgtctatactctaacgatttctaaagcttctgattgaaagcaatatattggctgtagatcatgcagaggaaaagctgaactgtcccagattggaagagattaaatagatattacagctaaaagcaatatgatgatcctgaaataaatcctggatctgaggggcggaaactacaaaggatattattgaggcagtagtttgaatatggactgtagattagataataatagtgcatcagtgttaaattttatgatttgataaatgtactttggttatgaaggagaaaattcttgctgttaggtaagacattctgaagtatttatggataaagggaaattctgtctgcaaattacagtagttcaggaaaaaatatatccctgtgtgtatacgtatgtggagagagagcatgtatggagtgtgcactgacacaagtgataaatagaacacaagtgttcacagttggtgatctgagtaagggggacgggagttctttgtactattcttgtaatttttctctaactggaattatatcaaaacaaaagataatattcaaaggaaaacgagaaaacaaaaaacaatacagtgattattattgaagattttgtgtttagtctcacaaaaatggtgtgtctccttgtactgctttacatcttctcagttcaggcctcttcttatcccaacaataccgtttaaatgtaacccacgtagaggcctcctttgatcacataaatctaaagtaagtcgttcttcctacccactcttttcttttgtgcgttgattacagcttatatcatgtttgctttgttcttgtttaatgctgctttctccttcaagactgaactccatgaggacaaagactatgtctgttttttcccccacagaatacccagtcctggcacataatatcaatacacgtgttttggatttggatgaatgaatgaatgaaggaatattccttccactttagtcagcatcccttagctacctaatctctgagaaaacaaaatgcctcctgtaagataaagctgtaagataaagcctatgcttttggatttggtattcattcactcattcattcagcaaatctttatttaatacagtcatctgattcctgtttatctctagcttccttttgttaacatctctcagatctgcatgacttttctaggtctgcaccttctggccagtcttctgtcaatctgttaagtgcgtttcatagttccctgtcactctccacatatttcttagaaagtatcacatttatgataattatgcctactttccctggctgtagatactgccttttttttttcttttgagaaagagtctggctctgtcgcctaggctggagtgcagtggtacgatcccagctcactgcaacctccgcctcccagttcaagcagttctcttgagtctggaagaagatgtgtatgaggctagggcaggtggaaggggtgatcatagcaggcagggcaaatagaatcctaagcgtggaaaactgccccatgaagactcagagactttagcagctcgatttgtttagggagttcaagcagtgtgatatttgggactgataagttgggggaggggtagaggatgagggtgaaaagttgtggtggaaaggaagagcatattatatttgctgtcttaggtgttattgtcatttaataaagcatttagaatagtttcctggaatataatgaatacaaagtggtagctgctgccctaaaagtcataatcgtcttgagttttaaagcagcagaaaaacttggatcaacctacctagcatgtaggaagatttctttgaaggcagcatggaggttgacggactagtgattgaggaaatcagtgcaggttgaaaacagggtctgatttaaggcagtagggatagaaatagggatatcgtgtcattaagtatttaaatgttagaatttacaggacaaatttgctgatgttcgtatgtcttttaggaggaagacaaatctaggataatatgtgagagattgggtgaatctagacttcatcaacaaagagaaatgaaaaattaaagcaaggagatttaaggggcagagctcagttttagaaacaataatgttgaagaaatgcatataggagattgatttggatttgttgagtttcagagggattggatagatagtttaggagagatttgggagtcagcaatcaacagtggtggtagcagcagctatgggagtaagtgagctctactacaaaggtaaggcggctgagatccctcccaaactttggagagttgacttatctgccaagtaccacattttttctttgacatcctattgggggaacccacccccaatatttcactgtaggttctattttccattagtgtcggccggctgagaaataaagagagacagtataaatagaggaattttacagctgggccgccgggggcgacatcacatatcggtaggacagtgatgcccgcataagcctcaaaaccagcaagtttttattaagggtttcaaaaggggagggggtgtaagaacagggagtaggtacaagatcacatgcttcaaaggacaaaaagcagaactaataagagtctaacaaagatcacatgcttctgagggaacaggacaaaagacaaaagcagaactactgataagggtctatgttcagccatgcatgtattaccttgataaacatcttaaacaacagaaaacagggtttgagagcagagagccagtctgaccacagatttactagggcggagtttttccccaccaccgtagtaagcctgagggtactgcaggagaccagggtgtatctcagtccttatctcaaccgcataagacaggcgttcccagagcagccatttgtagacctccccacaggaatgcattcctttcccagggtattaatattccttgctaggaaaagagtttagcaacatctctcctacttgcacatatgtttataggctctctacaagaagaaaaatatggctctttttgcctgaccctgcaggcagtcagaccttatggttgtcttcccttgttccctaaaaatcgctgttaattctgctctttttcaaggtgcactgattgcatattgttcaaacacacatgttttacaatcaatttgtacagttaacacaattatcacagtggtcctaagatgacgtacatcctcagtttacgaagataacaggattaagagattaaagacaggcataagaaattataaaagtattatttggcaactgataaatgtccatgaaatgttcacaatttatgttcctctgctgtggctccagctggtcgctctgtttggggtccctgacttcccacaacaacatcctcctaatatccctgtgatatggttgtgttatattaatcatctattgttgagtgagaaattacagtaaacttgattgtttgaagcaacataaatctattattttatagattctgggcatggcttcactgggcccttttgggtctctgcaagacttcagtcaaagtgttggccagggctgaggtcttctctgaggctcaactaggaaaggatctgcttatgggcttgtggtggttgtcaagattcagttccttgagaattgtcagactgagactgtagcttcttgctagctggccatcttcaattccttatcaggtgggcctctctatatggcagcttgcttcatcaaagctggcaagagagagtcagctggcaagatgggagttataatcttaagtaacgattacctacatgatatcccatcatttttgcaatatttttttggttagaaacagatcacaggccctgcctacacttgagggtggggatttcactggagtatgaatacagtaggtggatgtggtacagataattgctgctgtcttagaggctgtctgctgcaggtgccatttttattcctatttacaaaagaggaagccaaaacagttgtccaagatcatataattgcaagtaatggaccccaaaccaaacccaagctttctaactccactgcctggatacttctttaccataatattttaaggaatgaggaattgttgtggaaatggccgttttgaggaatttattggtgacttttgtttgatgccatggattgatgtgggttgaagtcatgtggttgttattatagtgaatgtgcaagtagaagggcctgagtagagattattcttagacggtagttttaaaaggaagaaaggaacaatagccatatgttgtttcgtactgaattgtttctctttataaccagaaatttttcttttccagttttctgagtttaaccagtaatgccattcagttgccaatctcaagcaaagcaaacataagccagttttaatctactttttaagaaaagtggtagtccttttcacagtgcctgacggtaagtcacagtttctacctgtatagcagagtttaatctattgcctttaaaataatgattctggaaatcttaattttaaaaccttatttgctttttccttctctaataattctctaaggcttatgtggaaagagcataagtaaaggtacctactactttctgggaatttatttatagttatcgttcaccagtttcattaatcttatggatcttttcctccatttgttgaaagtaaaatgctagaccatgaaatctgtcccctttttatgtcattattttaagttttttttctttctctttttcttttgagatagggcctttctctgttgcccaggctggagtgcagtggcacaatcgtagctcactgcagtcttgaactccttggctcaagccatcctcctgcctcagcctcccaagttgctaggaccacaggcatgcgccaccaagtgtgtctaatttttttaaacattttgtgcagacagggtgttgctgtgttgcccaggctagtcttgaactcctggcctcaagtgatcctcctgccttggcctcccaaagttctgggattgcaggcatgagccactgtggcttgttgtgtatgttatcctcattttatagatgaaaaagctttattttctagatgaggtttttccttgggcatgttaatcacagagttgttttaaatattctgatctccagacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattagtaagtttaaccttaatactaatctattttttattatgttgaggaagaagtggggggaaaactctcagggataagatgattgaccaactgttttattcttaatgtaaaacactgagtgaaatatgcacatagcaacctttactctagctactggccttttacttcttgaagaatcaaactttttttcctgtggcagaacagttatgcttttcttttcactaaactcattactatttatttttatttttttttaagcattgagtttactgaactatccagttagccatcctagacatcaaagcccattttgatatttttgttatttatatagtaatactgtactgtgtcataatgatgatagtatttgtgattgtagttgcatttgtaaaattgatcacttctcttgtttcttctagtaactgtatcagagggtgaggtataagctcacagaattcagataaatcatcatgaagttatatgtatttctggttaacactggaactactctaacatttgacactgaacttacagtgcaaacgtgagttgtatttcatttatttttttttcgcattctgtctgcatgcagaaagttaaagaaatattattctactgtttaaaaagtaggataatggcggccgggtgcggtacctcacgcctgtaatcccagcactttgggaggctgaggcgggcggatcacgaggtcaagaaagatcgagaccatcctggccaacatggtgaaaccccgttcctactaaaaatacaaaaattagctgggtgtggtggcgcatgcctgtagtcccagttaatcgggaggctgaggcaggagaatcacttgaaccccggggggcagaggttgcagtgagtcaagatcgcaccactgcactccagcccagcgactgagcaggactcttgtctcaaaaaaaaaaaaaaaaaaggtcacataatggcaagtcttaaatcttttatcccaacatattttatatgtaattgttatctttctctaaaagactagttacattctttaaattgtgctttgtcctgttggcatgaatataatattcatgtaaacagtaaacagatcagtaaacagatctactcacacaaaacaaactgatttccattgttgtaagtacctatagtcaattgctattctatttttcacaggccattgttaagggaattatcggaagcttcataaaacaatgtatatcacttccatggtttttggtcatttgtttttattcagtttatgaataaatgtcaataggtttattttgtttgttaaggagagaaaagataaatttaatattttcatccaaatttagtgggactcaggtatctaataattctctggcttgacaggacaggaaagaaatagaagtagtaaatatcatttccaacgctgtttatatttttatagtgaccataatagcaaagactttatggcaatgcagaataaaactgacattggaattattataaatagtgtgtgaaataataatctttgttgtaaaaattgaattatggattttttttccagaattagttttcattaaacttgattttacacttacatgaatgattttttggaagatagggataggaaggaatcttcacatgtgttagacttaatgtagtttctaaaacgtgtggagattttaacaaaaattatgtagcctgaggattttaatagacctgataaccagtttgagcatattcttttgctgttatttacctaagatcagccagttgttatggaatcctgttcattaaataggaagcttatatttttattactgtttttggggaaggttttagagtgaaattcattaacctctaaggtgtttttacatagtactacttggaaaataaagtcattgggcaaatataaacaactgatttattttatttcattttttgaagtgtggcagaccttaagcatgccattcaaagcaaatacaagattgctattcaacaccaggtgctggtggtcaatggaggagaatgcatggctgcagatcgaagagtgtgtacctacagtgctgggacggtaggtattcaagagtcctttcacacaagaatgcaacatctttacatcacattgggaactcagtgttcaaaagtaaggtttatttgcttcatatattgaaggcaatgtgcacgctcagtatttataacattttattttggttatttctccttttttaaaaaatataggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggtaagatataaacaattattttaactgattgtttctaaaagcattcggatctaaatagcacagtagtctaaattgcataggaagtatgcaaaaagtttgacaaataaactttaaaaatattttccggttaatatatctagttttaaaatttctgggtcatacattgctagttattctactttgataatgacagtattttagagtggaaaagctgtcttaacatgatttggtcaccttctttcctagataatatgtaaatagttacttttgaacattaattaataaaggacctacgttagagtagatgttaacaaagagaacttaaatagctctaaaaatgtatttattttttccatatttgtggttagttcctggaggagaattaggtttctttctaatatatagctcttaacactgctacttgcagttcccacggattgtttcccagtcatttgattttcctttttaatttactatttaccttctagtaatatcattgacattaagctatcagtggtaagctacatttttcttttaatcatggaaaaaatgtgttagaaccaatgaaataatagtatttaccttttgtaaaaataaataacattactgaacattagctttaattagtaaaactcttagagatttgttttaagcagtatatacatttgtacaaatacccccatttttcacataggatacaacattaaaaggaaataacctcatctgtgtgaaacatatttaataaacatttgagagtccaaaagtgctttgagaggacaaaattttaaaaaatatacttatgtaaactgaatttacataatagaatcttttagagttgtttttttgatttggttgaaaagtgtacatactacattttgatagagaaagtattaaatatgaaaataagttaaaggataactaggatatataattttcaagtgattagaaagagcaattaaaactatattcaacgaaagaatgaaaacaagaaagtaaaaagaaaagataaaatgtcagaaatacgtatatcaggaattaaatataagctggcattatttctcttttaatgcatcatatttaaaatattttttaaatacataaatagtaatctgagattcagataccaagcattctatatcagtctgttttcatgctgctgataaagacataacccgagcctgggacgaaaaagaggtttaattggacttaacagttcctcgtggctgaagaggcctcggaattatggcaggaggcgaaaggtgaaattggccaaaacaaaggggttacaggtcccatgcaagttcgaaatccagcatggcagccaagttttgaagctccaaaatcatctcctttgactccaggtctcacatctaggtctcactaatacaagaggtgggttcccatggacttggggcagctctgtccctgtggctttgcagggtgcagcctccctcccggctgctttcacaggctggcgttgtgtctgtggcttttccaggtgcacagtgcaagctgttggtgggtcttccattctggggtctggaggaccgtgaccctcttctcagagctccactagggagtgcccccagtagggactctgtgtgggggctccgaccccacattttccttctacactgccctaacaggttctccatgagggccctgcccctgcagcaaacttacctgggcatctaggcgtttccgtacatcttctgaaatctaggcggtggttccccaacgtcaacttgtcatttacattaggtattttattgacttattatatagagacaggatctcactgcgttgccgaggttggtctcaaactcctgggctcaaatgatcctcctgtcttggcctccctaagtgctgggattataggcgtgaatcagcatacctggcctcttttcagatttataaaatacattgagccaccatgcctgccctcttttcagatttataaaacaaattctaaagctgctataaccaaaacagtaacataggtctaatcaattcattatgtgaggaattagaggtgatatttcttcatggtccgggatgtggtctctaaagtcagattttctgagtttatgtctgattacttcatttacctgtggtgtgaccttttactcatttaccttattggtaaatttaagaatagatttttgtttattgagatatactgaaaaatgcacaaaccataattgtacatccattcttagtgaattttcacaatgaacacattgataaaaatagtttcaggtgtggtagcttatgcctgtaatcccagcactttgggaggccaaggcaggcggatcatgaggtcaggagtttgagaccagcctgactaatatggtgaaaccctgtctctacttaaaaaaaaaatgcaaaaattagccgggcatgctggcatgtgcctgtagtcccagctgctcgggaggctgaggtaggagaattgcttgaacccaggaggcagaggttgcagtgagccaagatcgcaccactgcactccagcctgtgtgacagagtgagacttcatctcaaaaaaaaaaaaaaacacacacacacacacacacacacacaaaaccccacaaaaacaaatagtttcaacccagaagccctacttaggactttctccccatcagttttcatcctccctgttcattaatgctaaccagtatcttgacttctaaaccaacattacttggtctctttttgaatgtaaataaatggaataatgtagtttctgttcttttgtgtctagcctcttttacgcaacatgatgttcctgagaatgattcatgctgttgcatgtatccgtggtttgtattctttgctgcattgtattctattgtacgaatatgccacagtttttttttaaatctgttctgctactagtaggtattgagattgtttccagtgttcaactattgtgactaaacctgctgtgaatgtcctagtacattcttttgactactgtagtgtagagaaatcagaatactttgacagtgttaaatctgtcttctcttctacttctgcaatctcttctgtaccgaaatgtccatagttctttcagatttcatcttgaaatggactcagtgcacactgtcttttttcttccatatattagctatcatttacatggtaattctattaatttcacttgtcttggttgttaaagcttgatttagacttctctgttttcagccgtgtcttcttccagtgtagccttcaatcagtgatacgtttctttttaacttatttcctgagctaaatctctgtgttgagttcttttttataaagcaaaattagaccaagttcttaggaaaagaatttggttataatttccatttgctcttggagaaagtttttctgcatttagttttttttacttttaattctttttttctacactaaattagggtaatttagtgtagatttcatgttaaaatttttgcttgtgtttgaatgaatagaattattcctctataagacagtgtaggaaagggtataagatagcacttcctggtgagcaggaagctgccctggatcacaggggatccccagttagaagcagaatctatatgtgtaagagagggatggagatgacttattttgtccttctccttggacaaaatttagcagttctagggctttttctcacgttttttcctttggctttttgcaagtatgtaacataaataggtattatttcttctgctactctctaatttcagatagggccccaagaggttcttgctgtccacccaagcttcccacaaggaggattcagttctcccaagttttgctaaatgtctgcaatagtggtgtgaacctaaattatcgtgagacaggtcacaatcaatttagaaaatttattttgtcaaggttaaggacacacccaagacatagcttcagggggtcctggtaacatgtgcccaaggtggtcagggtacagtttgcttttatacattttagggagacatgagacatgattatgtgtaagaagtacattggtttggttcagaagggcaggataactcgaagcggggtctttcgagtccttgatcagcctttcactcaatacataatttagtctggctcagtgcatctgcatttttacataaacaataaacagtaagacagaggaagcagataggcctttgtttcaggtcagcagaggtgtgactttctgtcccgcacatatgaagatatgctgtcagtttacattgtgaaggtgaaattcagcagaactgttttaggttaaagatcttgaagcctacaagaaatttccctgtggcaaaattgtgagggaggtatgtagctttcttatctttgtagctatcttatttaggaataaaattggaggcaggtttgcctgacatagttcccagcttgatttttccattggcttagtgattttgggttcccgagatttgttattctttcacagtgggtgccctttttatttgacccaagttgatcagttttcatattcttcacaggtttgctgcatatattgtatgtgtggggtggtagttgtttcctggtttcatcaagatggtgtcttgtttcccttttgtatttggttggtttcatgaaggagaagcaggcaaagacatctttacttcattatcttacaactgaaactattagccctttcttatacacatatggaattaagaacaggtgaagataagtcatttcttcaaggccagatagccagggagaagaagaacctcttttctccaaggccagtgctctttacattcatatcattgtacttccagaaagtaaactttcatattttacctgtaaagatatttcttttcacctaaatttgttcattaacaatattatcttctaaaacagaatggtcataattttggcatccttatcagccaaatatatcagcaaatatatcagcaaaatatatagagaaaatacttcctctttcgttgcatcccccactccatcttaatgatggtggaacatttgttttgcattttcctagactttgatatacacacaaaatgcatttctctctcatacctctgttgtttcacatttctaactgaccttagcctccccaaataaatgaaagcatactatactttttttgttgttgtttttgagttggagttttcgctcttgccacccaggctggaattcagttgtgcgatcttggctcactgtaacctctgcctcctgggttcaagtgattctcctccctcagcttccccagtagctgggattacaggtacgtgccaccacacccagctaatttttgtatttttggtagagatgggtttcaccatcttggccaggctgacctcaaactcctgaccgcaggtgatcgcccgcctcagcctcccaaagtactaggattacaggtgagagccactgcacccggcccatactatatatattattcctttttcattgttgcaaggtactcccatttttgaaatatcataaatttattttcctagtaaacagtgctacagttgaacttattttacatttataaattttaacaattcataaaattgaaacatttgaatattttatatcctccatcttttgtgtgtttaagaatcttcctcctacattttctacatgcgctgcaagaacttcttgctttaatgtacccaacagctcttttactcgtcatttcaagggtgtcacctctctttcatctgtttaaaaaaatctgaaaacattttatttgttatttcataattccagagtttttttccccactctattttagtggcagcatgattgattaattgacattaattgacatggcacataatcattttactgacattcctaccccataaagaccatcttacttatttactttggtaactagataacttacagtagcttttttacagtttgcctggacaacttaaaaataatcattttacatccattctttcaggtgccttcccgttccaccttatgacattttctgtattatcagtcttcttaaagcttctatttgattacattcttcatgttaaagagttcttgaggaggtcttttctgagtaaagtccaattcctccttccttaccttagtatcttctgggtctttgatcatctggccctctttctctcgctttttcctccagaccatttgttcttaaccaatagtgcttcatatttcctgtctttgccacttcgtgttccactcttttgaagtacttctttccctatctttgttcatattcttttcatacctttatacttaagttaaatgccttcagttaactttgacttctcatttcctgtctcttttgtgacttttatatctgtctcataccagttaacaaaggtagaatgatctgtcttatttccttgccaactaaaatattttataacagtggacttctttatatatctccatatataaagcaatctacattgctgccttgtaatttatccttaataaatatttttgtacttcattgtttggaactgaatgtcagatgtctattttctgaaggtattttcactgcttaaatattttctagaatctcatttagggttactaaatctgttatagttatactaatctagaagtagatgacgtattttagctttgccttcaccaaaaattgtttttaacatgaatgtcttgagataataccagaggacagtgacatttgagatggcagatgttgatcattagtcaaataattgaaagccctactcctttgtttttcagaggtagcgtcttatggattcttcttttgactgtctcttaggatacctgctcggaaacacctcacttatgtttaggctgtcttttacagaagagaacagagataaactaaaacagtcctttgaaatactttgttaaatgtgctctacaacgcatccacacgtacatgtttgtaaacatatgcaaacttctgcaaacaaaccattgccttcttttactttcttttgtattctttttcaatataggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcagtatgtttgccattaaaatggataatatttgtttaaaatgcctttgaaatttatcagtaggtttaattactgcaaatttgtttcttataggccatatatttattgtaactgaggtttattctttgagccttttctgatagtgatttgtaggttatagtttttaatttaaaaaatgataattctctttacatgtatgagtctcccacatttctttctcttgggttgttttacttgtaataaggctccaaatacttttgaaatcatttataaaaccaagaatctttgcttatgtcttgtccactaaacaaaaggcaagatgtgaaaaataacatctaacagaaataggcacattatcaaacactggacaatggaggaaaattttaagttctttgtaaatattgccatcctgatacaggtttgatgaggtggaaaaaaagcccttgtgttgtctgttttcttttcttttttttttttttttttctgagacggaggctcgctctgttgcccaggctggagtacagtggtgtgatctcagctcactgcaacctccacctcccaggtttactccattcttctgcctcagcctcccaagtagctgggactacaggtgcccgccaccacgctcagctaatttttttttttttttttttttttggatttttagtagagatggggtttcaccgtgttaggcaggatggtctcgatctcctgacctcatgatccacccgccttggccttccaaagtgccgggattacaggcgtgagccactgcacctggccagcccatgtgttttcaatgctcattaagatggcaagttttagttctttgcatagaagtacatttaatacacattgattctttttttaaaagggctgtagttaacctgaaaatataatggtaattcagcatgaaactaacccttattgtgtgtgtgtgcatatgcttttagcattttgtgttcaggttttttgttttggatctgtagatttttttttcttttaattatcttgaccttgcattagaggcaagtagcatgttctggttttaatctttgtctttttgtttctttgatttttttaaatttgggtaaccttttaaattcagatttctctgttttgtggtatgaatattagtttttggccttaaaaatggaaaaatcttgagaggaaagagaaggattcattaagactagaaagatctttttaaagtttaaatgagaaccttttccagtaactttctaagggttctgttagctgtatcagtttaaagtagggacctacatcatattgcacatcattttatagaagttaaatcaccaggatttcatattttccctatgcttttgacaacataaacctgttttcagggtgttatgagtacaagagttatcttcattaggattgttatttttatcctgtgctttgaatatatcaaatatatttgatttacttaaggccataaggttatattctaagatactgctatggtgaatctttttgtaaatttaaatttgttacatctttaaggttttgtaaaagcctagtgttcacttgtttagtatagctactttactttagagtgttttttttttttttttgagacggagccttgctctgtcacccaggcggctggagtgcagtggcaccatctcagctcactgcagcctccgcctcccaggttcaagcgattcttgtgcctcagcctcctgagtagctgggattgcaggtgcctgccaccacactcggctaatttttgtacgtttagtagaactgggttttgccgtgttggccaggctggtctcaaactcctgacctcaaatgatttgctgccctccacctcccaaagtgctggcattacaggtgtgagccaccacgcccagccctagagtgatattttaatgggttaacgatagcctctctctgctaaactagacttttagtgaatagctagctcatagactagtttatgtatgtataatgttatggagaggtggtgagatttgtgtgtataataatatgtgatttcattcaaacatgctaattcctaattagagcagtctcatagttttactgacagatcttttgtattttaagtttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcagggtaagtaacgttaatttgatgtttgttttgtcattttactactttatattatttatcctaaatattttatgtactgagagaatgggtattaccttttagtagaaataaatgagtcttggagtgaaacttttaacataggttgaatcaatttaattcataattttatttatgaattgattgtaaatttgtgaaggttatttgagattaataggaaaaatttctagtgcaataagaataatttacatacagtaaactacacaggtcttgagtggttcatgcaagaaataaccaccacacaaattaagataatgaaaatttcattgcccagaaagtccccgtgtgactctttccagtcactatttccttagaggcaacttctttctgacttttaaagaagaaatttcaaatgctgcatctgcctgagatctttaaaattcgaaacgtagacactgtattttttagttgtgttttatagttatagtgagcttgtattttggattaaggtcttctccagcacacctgaaaaccttttaaacctgaggaataaataccccttcatatctgatctgcaaactgatgcaaaatctttgacaccaggaaggaagttgatggggcatgtttcattgttacagaaatgttaaataatgttgtgaaggctgctgttgtcaaaagataattgttaaaaatagttaaacttttcaaggagcatgcagtcgaagaagagttcatctttgattcactatttagagcaggatagcacattgtctgggatgcctaaaaaagaatacatacattgctgttaaagttataggatatagtaaaatggaaaacaaaaaatctaggttttgtcattctttcagtatccagtttcttgatgacattctgtaggctaagcatttctttcaattaagacatgtttgccagagaagtatgtaatatgttatgcaaagattgatcactgccaaaaatgaattaaagttagtgttcctgcttaaactattgacaatgtagtggcctgaaaattccatttatgattgtagataattgcttacatgattgtgatcagaataattaaggtattttgttttgttttgttttttgagttagggtctcactctgtcgcccaggccggagtacagtggcatgattatagctcattggttctccacctcccaggctcaggcaaccctcccacctcagcctcccgagtagctgggaccacaggcacacaccaccatgtccagctaattttttcattgtttgcacagacggggtcttcttcctatgttgcttagcctggtctcagattgccgggctcaagcagttctcttgcctcagccttccaaagtgctgggattacaggcatgagccactgcacctggcctatcattttttctgtaattaagctgtgccagatgtcaaaacagagttatatatatgaagcgaacctgaaatcggctttgtatttccatgttcagtgtgaaatttcacggagtcttaggtttttttcaatttgtatgactaaaggaaaggaacagtgattctctgacttaatgaaaagtcagccaggcacagtggcctgtaccagtaatcccagtgacttgggaggctgaggcgagaggatcacgtgaggtaagaagttcaagaccagcttgggcaacatagtgagactctatctctaaataatgaatgaaagaataaatgtcagaaatatttataccttcagaaaatagaaggtagctatagtgttattactaagcaatcacttttttctttttagaagttaatgctacattgaatagggcatagcaacaacatctgaagtctttgtgatattttacatgaccattatattaaaaaagcaaaatacaaacttgtatttggttattgttgtttgttatcaaattagctaacgtgactttaaaatagtgcctataatatagtactcattagttgtatatgcccattagattttttttttacttactctatcaggaggagtagctattggatgctgggcttaatacctaggtgctaggatgatctgtgcagcaaaccaccatggcatacatttacacatttatgtaacaaaccagcacatgctgcacgtgtatgccagaatttaaaataaatgtttgaagttaaaaaatatatattattctgaagcagttaaaatccaatttggaaaaatttatttatattttacaaagtatatgatctgtaaatgtgatgtattgcgtaatgaatggcactttaccatgatgtttttattagatcagtatttttctcctctcaggagtactatactttttcttgataagactaggggcatttctgaagatgaaccgagtatgagatttctctctgattggagatggttttttactctcattttattaaacggttgtccaaaacaactaacctacctgatatctgatcgcagtagcactgttttccaatgaagtaataaaaatatatgccaagattttttttccgtaaaaggaaattcagtttaaatctatcgtttttgcagattaattccaattgtaacagtattttgtaacatgtactttcaactggcaaattaaaatgtctttctcaggaaattagtcgagacataggtattttggaaattaggatttggaattggaatagcaggggctcaaatctgggcattgagattcatttactatctgtcatccataagtcacttaacatgggattcctagttttatatttttgtggattaagagatgctagttttgtaaattattgtttttccccccattttatctgtcagaaaaaatttagaattgttgctgcattttcgtagactcatatttttagattttagtgtattcttgctaaaaagactctttttttttttttgagttggagtctcgctctgtcacccaggctggcgtgcactggcacgatctcggctcactgcagccttcacctcctgggtagctgggactacaggcacccgccaccacacctggcaaatttttgttttttttaatagagatagagtttggccatgttggccaggctggctttgaactcctcacctcagttgatttgcctggctctgcctcccaaagtgctgggattacaggtgtgagccactgcacccggccttaagatgactcttgagtgttctgtttcagtttatactacaaaaggcacactgatttgtgtttctaacgattaataattggaagtgtctgcatttagcacatttctaaactgtccaggttaatgcagcataatttattgagctttagcatttctttcagacaacttgtgatcttaaggaatctatgcaggggagtgggtttaaaggtcagaggcttaagaatagagagtgtaagaaactttgttttatagtttctttctcagttaaaaataatgttagcctttgtagatgccaaagagcccaagagtaaaaattaatgtatcactgactgttaattattgaaaattggctaaataattactaatgagattctgtggtttacatatatgtaatttaaaacatttcttcaaagatttttattatctgtgaacaaatggaataaaatattaagtgcagtgagattttaggaagtcagctgggcacggtgactcatgcctataatcctagcactttgggaggccaaggtgggagtccattgcctgagcccaggagtttgagaccagcctaggtaacagggcgatacccatgtctacaaaaaattagctgattgtggtggcacatgcctgtagtcccagcagttagggatgctgaggccgtaggatcgcttgagcctgtagtgagctgtgatcatgccagtgcactctatcttgggcaacagagccagaacgtggctcaaaaataaattttttttaggaagttgtgtaaactatttagtgaatcataaaatactctcctatgtttgtcagtgcagttatactttcaatgaattattaaattcagatacgttgtattcaggagcccttgtttttggtttaagttgttggtatgttaagtttatgtataattgtaattttgcctaggttgaacatttgaaccagttttcatctttatcatgctaataatttgtaaccaggctttgatgtgcatagtactctggtgtagaaatacatacacattggactcagttaccacaaaattgagaaaagtgagaaaatgttcacaaatgtacaagtagcagttgagacaacattgtgcaaaactagtggtgcctattctgaaataatggttttgttaattttttcggtagtgttagacatgcaccctcttaactacactggattcttgataataacaataaaatagtttagtttaattgcttttgtatgttctctgtgtacaagactctatgcattaatcagttttttccgactgtagagaaggcagcatgaaggaggtatttgactaggatctttagagggagaggttgacttaaacagttaatagaagaattgtgaacaaagatcagagatagaaaaacacggtttatcttgaaatgatagacatttcagcttgaaaagatgagaggcttgaaagatttttttctgatatcagatcaatgaagcctttattatattctacatttattggatattatctgtgggcagaagaaagtcatttgagggttttattaggaacaagcatagtaagtcaataatagaaggtttcatggttgctacccaaatgtagatgttagtaaacagtcagaaacacagtttgagaatctgtgagactgatcagtgattgaagtagacttgggagttatctccagaaaagttatacttaatgctgaaatcatattgagaacagtaaaaatgggctaaggacaaaatccttctgaatcatctgttttagaaagattagacagagcaaaaggagccagaaaaggatgctgtgaaggaaccagtagaagtaacttcccagagcctttaaggttgggaaaaggttatctgccatgctaactgttgaagagcctcaagtgaagcaaggtcattggtagtttttggctgagcagtttttatggaaaacgcagacagaaaggctgccaggtaaaatatttttttaagggaccaggagcattatcggaaaattttataggttccatgaatttcagcaaatgtgtagaattagagccagggaacaggagagatggaagagtgagaaagcataattgagcaagccgattcgttgaggagatagaaatagagaataaggaagttttatcttctatctccaggagggagataaatttgccgaagaagtttatatgttttaaagagaagttgcattgataagagaattaatgatattatgctgacattgaaaatacctttttctgagagatattgacaagtgattaaattgtagcactgattgaaatgtgtgattcttgaaaatgtattcctaattatgtattctagtgtaaattcagtgttgtcaaggatatttatcctgtacttgaccttcttatgaaagtataacttagagttcccatgcttttgcttttttatatcttttatcacttattttctctcaagctgtatgtcagaatagcatgaaatacattttaaactatttgctgaaaattgtattcgtatgtgtttccttgtcatttagcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcaggtacctattttagacttttctcaggaaaaggaatttatagtttttttgtacacatgttttatatgcagtatcaatttggtgtgcaccatattttcactttttccttgaatatttttaatgtattaatattgtttccttgtaataaaacagaaaagcatgttcttaatgattgagtttcctatagataaaccatgaaactgctacttgaagctgggggcagaaatcaacattttttgatatgttgaaagcagatgatcatatcagttattgtgctaaaaatttcaatgcttcctactaccccccataggacgaaggataagaaatgaaattttttaagaataggagaatacgaaatcttgaagaatttactaatacttctaatagtaatacctaggttttagatctgatttaatgccataatcctagaactgttgaaaaagtggattttaaaccaaaggaaggtgatggaatggctaagtaagagtggtaaatgtggacgtttctaagcaaaccagtgcctctcttaaattcatgattgcctgtccttcacccaccatggctagcattgtggcaaaaccacccatagctgaatagttgaatgtcataatcagattctgacagctgtttttctagtttaattttccttgccaatatttttcctctaattgtgttctttcattggaacatataaataattacatcccccatattaacttttccttttttttaaggcaaaacatacttcgttgatgttatagttaaggctgatataaattagaatgtcctttagtatttccttttagtgataagttcaattttgttgtttgaaaatctcttaaatcaccttgatttctggaggatatttttacctggttcatttaaaattctgggttgttagcattttacttttggtcttttccttctgtttggtttttagcaattttagtatgaggtgccaagatgtggcattctttgtatttatcctactttgggcttgtagtgcatcttgaatctgtggtttaatgacttataccatttgggaaaaatctgagtcagtttctcttcagatcttgcttttccctcacttgcttttccttctctttcagtgattccagttagacgtgttagacctttcaccatatccgtttcatttacacttgtttcctgtattttctttctttttatctatctgtgcttcattctagatattttcctttaacctacattttaactttttctctttttttagtggctaactgtagctaaccacttgctcatttcttaattttgttcatttttcagctctacagtttcagtttggttcttttgtatatagtttcatattctctacccaaatatttagtcttagccattcatcatctctttgatcacattaagcacatagcagtttaaaagtctgtatctgttcactgtattgcctgttcctgtgtgtctgtttatatttggtggtgtttctttctttctttcttttttttttttttgagaggaagtttcgctcttgtagcccagactagagtgcagtggcgctatctcgtctcactgcaacgtctgcctcctgggtgcaagcgattcttttgcctcagtctccgaagtagctgggattacaggcatgcaccaccacgcctggttaattttgtatttttagtggagacagggtttttccatgttggtcaggctggtctcaaattcctaacctcaggcctgcctcggcctccaaaagtgctgggattacaggtgtgagccacggcgcccagccgtatatttggtggtgtttcttataattctcactcttatggtcttgccttttcatgtacctgattttttttttaataagaaaaatcaaagaaatattgtgaggcctaggataacgttttcttctgcagataatttatgtttgcttttggtatgtgctttgggcagttaccatcgtaaattactttagttcagtttcagagatttggatgattggacattggtattctagttcttgggatggccattctacttttagtttacccctaatcataggatataggttttaaggatctgaacgcaaataaactgttccattgtaccttcccttggctggctctggtcttcaacttttaattttctagctcttcagggaagtcaggactgctgactacttatttttaattttggactcctcttcaagaatcagcagaattcttcagagcaaatggcattcctagtcacctaatttctctctcttggtttcgttcttctcctggatcctagccctttcactgtgcctggcttcttcactgctttcctagagccacagggagcttgttgacattacaggctaccattactagagacagaactctgcattcctgatcttttgcttcttctgcagtgtagttgttttttaacttccatagaatgaatcaaacaaaatttatttaaccatacttcttttggtgattatttagtttgtttcagtttttccatattagaaatattcattgagtatctcaatacacccatttttacatgcatgttctagtatttctttaggcacaatcttcaataatgggattgttggattaaggtctttgttcattttaaatattaattaataatgttctaatgcctgccatagaagcaaaatcagtcaacacttccagtaagtaagaagagtaatttctctgttttcagcgtttgccatgtatttactctgaattgtcattcgccacattttctttttcatgtttttgttagaatttatcatatattgtctagatagttctttgtctattatagatcatacagatattgtctctgttgataatttatctggatcgaaaaacagaagctttaaattttgatgcagtcaaattcattcgtatatttattcatattaaattttatgaacccatcattctataaaatcgtctagatttctttataactgtttctcagattgaataaactagggctttcaattatcttaccttagacactcgatttttctctctctactttttctttgctccccttaatctctcagtatattaaaatattgctattagtcctcctgctttatatcacttgaacagtcaatcaggcaggtacattggatggttttatatttgttagtaatataaaaagatatttattgctgatattgccctcaagtctacttggtttcagcaaatggagttttgtcatacaaggaaaagtctttttctgggagtatggttggggtgataatactgttttctcaaaatggaagaatgcattatttgcgatttgagcttttcttgtttgctttctaaatctgaccatttaacctccctgaatccaaactgaagtaaaattcagtgaaaatttcttatgctgttcctatggatattacaaaattagtttttgttgtcttgtgctcatagagcatcctctttcaacatcttcattccccctaatttatttgtagtattttgctattgttttaaactatggtagctcatggaatataccaaaagaatactataggtaatattgttacttttagaaaatatcttttctttcttcgatacctgagtggtatagtccttttaaacatttcgagacaattaaatatttaattatttaagttctccaatggatattttttggtactcctaagtattcataagaagtcatctacattgtctggttgtatattgggagcaaaatttaagacagaaatatagaccccaaggtagacagttttcaattgagtgtgcctgaatgaatctgaatgtgataggattcagtttaataagattattttcagtgagctcattagagaaaagggatacccagttgaagctaggaggtatatggtgagtgagacaacttttcacacctatattgtcatgtatttggctgccgccaagggatgtacagagtcaaggttttagcagaagcatcacttcctcagccaaactttcctgatcttgaagtcttggtcacatcatcaggttcattttctcttagtatgctgtacttatcctgtaccacagttgtaattattaattacatgctgtttaatacagtctcttcccagaatataagctccaaggaggcaggacactactctatcttccattgctttatctacaaggtcttaccacacattcctgatacatacatagtaggaacacatcaatacttaataaaatgagaatttggatttgtgtttttttgaatttgagaaatgtcacaattctatctagtctttggctggtctggaatttttatttacagatgtctcatcagttacttttgttgctgctaatggtatttccctgttgcagatagtttgtcagtacttcctttagaatgtgtttggtgaaaagtagataaattcagattatccaattttaggagttgattttacatcttgctaaacacatttacaacgtagtataatacattctagctacatagcaattaaaacttaaaaccactcccaattaaaagggaaaagaaattgtggaaagggatttattatttattgcctgaacatctcataagatagagaccatttcaaatgcctttgaaggggtaatttcttaaaaccacaacatttatgaggattgttgtagacccttctacatggttttggcaaaaaaaaaaacctcactcaccaaacctatgaagctgtgtaacactggagccctgaatattcattctctagccattcgtatccttgagggttatcagcaaaattaggaaatatcagggagttttcttcctgaaccaaatttggctgaatgcatctggaacacgattgtgagtactacagtgctatcatgtagctcatgtagctgtcaaaccttatttgcgtgtaaaaatattagtaatgaattagtactagatgatttatgaggattttttctatttagtctgaattatattgagtatggttgagcaaatatgaaattcaatttattgaaaaactttattttttccttcttttagcaatacagtacttacatgcttttggtgtcaggaaatcctttactaatggtctagaatttaaatttgggattgattctatatttttcatggattcaataaaaagtaattgaaaaccagactttgcgaaaggagttaaaagtagcaaattgttttttaatagattacattatagaaaaattatagttgcagttaaccaaagagtatattgaaagggaaaaaaaaggcatacagttactatgaaaattgtcttcctttcagatattgaaccagtttgacttcagtatatatcattcaaatctaaatgtcatgatatttaggaaaacatgaaacagagaactaccagaaaattggaagacacacttgtcctttagctggtcataaagttaagttcctagaaggataatgatttatttacagtatcaatacagcaatcagatggatgtacaaaacctacaacattattacatataagccacttggtatatagcataggaaaaaactttgtggtagcaataaagtatgtagtaataaccttattaagttatctttggaccacatataaagaaaactaaatatacttgagagataaatgaaggaagattatggcagatctatctaaattaattagtaacttaatccctacttgacagatacaccgttcacctacaaaaacaaatgagtaaggacagttaagaaaaacagaaaaaatgtttttctaccaaataataaagtataaactctgtgtaaaatcacacaattcagtcattgtcctagcaatgggagcacagatcagtggaacaaaatatagtccagagataactggagagggcagtgacttttcgataaatattttaagggcattttattatttttatatttgggaaagtgtctaatatactactgtataatgtttgctagattaaatcccttattgtttttcagtgaccttgttttgtttgtgctgtgactgaccgatagtgttataggattctagacacatagcttctaattctcattgactattaagtatgtccttggctaaggggctttatctttctagcctttattttcttctagtttgaaaaattaaagatgagcataggattcttaaaaattctaggtcttgtgccatttatgcatctactacattcgagaaaaatagaggatttaaaaatattgttagaaggcacaaaacgggttgtgtttaacataaagattttccacttaactgaatgtccatacctttcatgaaacaaaattaatgtcctttgaaacattttttttctcaaagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtaagtgattcatttatatctgttttaagatgtttagaattggtatttatatttatttctcccaaatgatggagtgatttttccctaccattttattgaaataccttattgatgaactttggaattagactatttttgtagagcttatatatcttgatttctttggcttaactaagttagtaagcttactaagtaagtaactaagttagtaccagttttgtgaatgttgaaaataatggattttattctctaggtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggaggtatgcaagttgaattctattttaactgtatatgaactttaacgaattggtgtatgtttatgtttaacataagctttcctcttctagtgggctggtgctttagtcaaagatggaaagagattatatgaagcagaaaaatcaaaaagggaatcctttgggaaattatttagtaagtgttcattaataattttaattacttttgtaaaggataaaagtttttataagcttggattttctgtagcatacttcatgtatatgctgttaattgccattgatatctaggaaatattccttttaaagtgtatagaattgaatccattgttaaattttaaacttgaagtactgtcaacttttaatttaccttttcaaaaaccagagataattttttgccttaaataaagctctaaaataaccatattgttaatttctttatacagggaagtcttttttaagaaatcgtctgtttaggggactggactcctggcccccttccttttgtgtatgtatttattttctaaccatgactaaattccatatgttttaaaaccttttttccagaagtagagacatttatcagaaacttgcagaaattgttgtggtttaaaaaaaatcaaaataaaagtgtttttggctttaaaagccagttagcataaagctttaagattgatatttgtattcataattttttataaagaatcttcataacacaggaagataccttatactgcactgttaggattggtagaaatagattcacttggtttttttgttttcttgtctcttcctttttttctttccacccttccctcttctttcttccactgctcttctccctccctcctcctttacagcctccacctcctccttgcccttctatatttcttttcacaccacccccctttatattttgacaaatcagaataataaagcctcagttagacttcactggaattaaacgttagtttgatatgtttctaaaccattgttatctggggtcattaattgtattacatgagaagaaacgtttccatgatcaaagcaatatgggggcttttacccccatcagatgtactcttagctgtgttgttgttgttttggagacaagagtcttgctctgttgtccaggctggagtgcagtggcacaatctcatctcactgcaacctcagcctcctgggttcaagctgttcttgtgcctcagcctcccaagtagctgggactagaggtgcctgccaccacatccagctaagtttttgtattttagtagagacggggtttcaccgtgttggccagctggtctcaaactcctggccccaagtgttctgcccaccttggcctcccaaattgttcaggttacaggcgtgagccaccacgcccagccatgcttagctgttaaacatgtttctatactgcaggatttcttagtgttttaaatgtatgcattttttaatacataagaattggtgacatagcgattcccatacttatttatccgagaactcttttttatgaagagcatcttggcatctccacatctgcttgagtaatgatttaaaacaagtttttttttaatgcaactcttggcaattttataaataatgaattggtaggatttaccggttaatattttttacagaagctaaaattgaccaaaactttgtcttctggaaaatgtaatggaaaagtcaaggcaaaagcaaataagaaagtgttacatggaaaaaaaatacatgtgtgcattttaatatattagtggctttaacatggtaaatattatatatatacgcacacacttacatatgtgtttaccatatgtatatgtacatacatacacatacaggataggaatattgtaattcccataaaatgatgctaaaagcagagaaggggaggaacaagtgcatcccttgatcactagcagttcacgtcgcagtttactaaaggctcaggaaaataatatgccatatctttattgaatggtctttttttgtttcttaatcatttaaagcactttagtttgtttggtatagtaaatttaattatagtaagaaatcatataaatttgctgtctgtttttggttgaaaaaaaattttttaagtaattaatttttttggtacagactcaaaagcctcgaaagtttgactgtgaacttccagatatttcattaaaagatttacagtttctgcaatcattttgtccttcggaagttcagccattcctcaggtaaatgtcattagtattttcagttaatttataaccttaaaatgtttttattattctggagttgtgccaggtagtaccagtaatcttaagaggtgccaagataagaaatatttaagatagactggctttcctgtgactgctttgagaaatttctggggaataaaaaatgatggaaaatgaaggtaaagtaaaggaagacatgccttacatgtaattatttttttctagtagttactttttgcatgctgttgggaaatttctgactttttacttttttttttttttttttttttcttgagacggagtctcgctctctcgcccaggctggagtgcaatggtgtgatactggctcactgcaaccttcacctcccatgttccagcagttctcctgcctcagcctcctgagtagctgggattacaggagcccaccaccatgccctgctaatttttgtatttttagtagagatgtggtttcaccatgttggccaggctggtctcgaactcctgacctcatgatccacccgcctaggcctcccaaagtgcttggattataggtgtgatccaccacgcccggccctaagtttttactttactgattatgacacaaacttcttaaaatacttctggtattaatttaaaaaggaatgataaggctcttgttatttttgacatattaaaatatttggtagcagttatctactagttcattaaaaaatcagaagtctaattgcattgcattctgtttcagggttcccttactttgtgactttgaacctctacaccagcatgtacttgctctacataatttggtaaaagcagcacaaagtttggatgaaatgtcacagaccattacagatctactgagtgaacaaaaggcaaattcaattctttcaaacagttttcgtcattagtgtaaaatgtttgtgttcctgcagctctttaagcctttctttctgttttccaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaaggtaagaattaagtttagtctgtaattataaaattaaaatatcagtgattcgtttgtgtgtaatcacagtaccttgatttactcatttaccttgggtaaatgtagcaactagggtattttcatgaagtaaaaacttactttttagtcagtgtttcttgcaaacagaaataacagactaaatccatgagtggcttttaaaaaatgaatcagcagtttggattttcagagaaattttttgttgaaagtttgaaatgttttaaagagctctttgtttttccttttttaattcataagtttctctcttgatttatttgcagtttttttctaaactcttcagtagaaaattacttatattctctttaaatttagtatatatattaaagactaaaattttgttctgtatattgtttactaaaggctaaatcataggaacatgtagagtgttccttattgttattttcttaatacagtttcagttatttcctctgtgcttgaaagatgtttttaaactgcaggtttgatactgtggttgtggattggtggtgtttttacatgtttattattgttactgtctgatattactgccttttgatcacagaagatggtttttagtatttttacttttaatctgggtttaattgggttttgtgacccagtaaacagtttctagaacataattaatatgtcaattcattctatcatgaattctccaagtgaatacatatatatttcaacctgtgtcttgccttatcacttttatacaatctcttgtgattgtctgctctataatactcatatattggtatactgttaaacctccccttttggcttaaaattagaagctctttaggtattctgggggagggggcattagagggtttaatagaggaattagggtttgcatgtatgtttaaaagctggatgagagaaggttaacagagtcactgccaaaggccaggagagcttgtcaaagagaatcagagatggacagtacttaaagcagtaaaaacagattatattcagacactattgcagtatggaaaatagacctcattatagaactaggctcaattctgaatacagcatgaacaagttgagatttatagctaaggagggtaggggtcagtggatggaaaattactaagaggaaacataaggaataaggggaattttggttaaattgatctaacaggattcttactgaaggcaggccagggcaataaaataccaagggtggggacgataatttgttcagatattgatggagagatactctctaaactgagttagcaagacacttgatacagctggacagcgtaggcccaagaagaatagatgtcaaggtcgaagcctagaggagcctgattgaagtttagttcaggagagcccttttcaagctcaaagtgaaataagaggaaaacagaggctgaagcacccatgaaagctgatggttctccatggctcactgggaagctgctacaagattcaagaatctcttcaaagcaccagtctgactcaatctgcatcacaaaatggatagttctcagttacttgccaggaagctactgtgaaactgcatctggctacagccacctctggagaataaacctgtgctgcttttctgccttccaaaaccttgcacatcttcttttcattggcaaactggaagctatacctgggattttgggaaatgttggatctctgtattgcagtgcatatgagatcataaaagaggagcaagggcaaagcctatggaatactagacagtccagcactttataccccatttaaaactcagcatttagacagataaatgtcttttgcccatattgagcttccaaataaagacacttaaaataggaaacagcagttggattgaagacaccacctgaagaaattcattaaaatccattgtttgtctccatgtcttctggacaggacacatacttaatgttgaataagaacatggtagaaacctccctcccctgtgtcgtgaagtgagagttttaggaattttacttggccttttctaccataatagtccttgttccacgagtaagggaagcaacatggggattctgccagtttcttctgtctattccagtaacgattctggatctaaggatgtacagggtgagtatcccaaatccaacatgctccaaaatctgaaactttttgagccctgacatgatgcttaaaggaaatgctcattggatcattttggattttggattttcaacatttgagatattcagctggtaaatataatgcaaatattccagaaactgaaattcagaccacttctgctgccaagcatttccgataagggttattcagcttgttcctgtctcgatgagggaaccattgggcccaaactctgtcacatgagcaccaataatctcctcctcctagtggaccacagtcacttcagtcttctcagagccagtgtttgggtgaaggttagaattctcttggtaagttaagcctctgaatactagatctagagttttctgttttgtcttgtttttacagttttagtaggtctttaaccggttcattctattagggcctacggacaaccactaccacagatttctctgggtcaaaaccttctaattactgctctggctctgttgcttgtgatagagccacattatgtttctggtggtgaagtgccactaactggcctctgccactccagaagcctgtcattcccattaaattcattgaatttcagtgttctcatctccctctgctgtttcctgcagagcaccactacagagccttttaagcttgtattttgcaaagccttggtaaagaacatattctctgggacctctgagggtataagtaataaatcccttccagtatacctgcctttggatgccttccttgtagatcaggagtcagcaaacttgtttttttgtttgttttttgtttgtttgttttttgagacggagtttcgctcttgttacccaggctggagtgcagtggcgtgatctctcttcaccacaacctctgcctcccaagttcaagcaattctcctgcctcagcctcctgagtagctgggattataggcatgtaccaccacgcctggctaattttgtatttttagtagagacagggtttctccatgttggtcaggctggtctcgaactcctgacctcaggtgatccacctgcctcagcctcccaaagtgctgggattataggcatgagccaccacgcctggccagcaaacttgttttttaaaggtccagatagtaaaaattttagcatttgcaggtcacacacagacttattcatataatctgtgtgcatgcgtgtttaccatcttttaaatatgtgaaaaacaagaacagtggctctctaacttctgtcacagtatctttttacgctctcaaaaattgactccagactgattttgttcatagggattatgtcagtatttctgtactaaaaattaatggcaagaaattgaaacttagtcattttcaaataacctcattacatggtggcatacataagacttttttttttttttttttttgagacagagtcttgctctgatgcccaggctggagtgcagtggcgcaatcacggctcactgcaacctcccaggttcaagtgattctcctgcctcagcctcccgagtagctgggactacaggtgcgtgacaccacgcccagctaatttgttgtatttttagtagagatggggtttcgccatgttagccaggatggtctcgatctcctgaccttgtgatctgcccacctcggcctcccaagtgctgggattacaggcgtgagccaccatgcttggccatacataagattttttaataaaaactttctgaaatgaaaactagttagaagagtaccattgttctatgtatttgcaaatctcttaagttttgattgaagtatatgaaaaaaaatccaaccttatgctgaatgcaattggaaaaggaaaggaatatttaaatagccttttcagatgattgtcgatattcttctttgttactaaatcaaaattcagcaagtggtaatttctgaacattagtttttattgtggaatatgcagctattagtggattttctcataatcttaacatttattggtacatctcttgtacttttttactcatgcatgattttatagcgtcatgagttggtcatttggaaaacacgagttcacggagttaatgcagatcttccaaatgttaacatattttagagctagtagtttttactattcaagaatattctaagaaaaaacagcctcccctttttcctccccactttgagtgctttgtggtgaaagaaaacgactacaagtaaagtttggtgctaatggctttaatttgtgttcaggtaccagcagtttgatcatcagtgccaatatcaacaaggtgaaaaaggcaacacttggtgttactatgaaaacagttctgacttcacttgtcctctgaatgtgtttggttaaccccaggcttctatggatcactctttgggaatcattagcctaaagaaatggttggcaaacttttataaaggcccagatagtaagtagtttaagttttgtgggccaaatggcctctatccaaactacccaactgtaccattttagcaagacagcagtgagactatataaatgaatggttttggctgtgttccgcaaaaaagcggattggatttacctgcccttgatctagagtatctcattttgccatctcattttcatttaatgttggttattcttaagtctactttccaggcagtcaacttggcaaagtgttaatagccaatattgagtctggaatctgtggtcattacacccgtataaataattttggcctcactccacattgtccctcctcttgtaactgtcattagatctattcccatatgtattttccatttttctgccaaaatatattaaagattctgtaattgctttgcaattccttctttgttagatttttaactctccagagatctggcaatttgagtgtagcaatgagtatggaagtaattaaatggtgggagaggttgttgaaaaggatcatctcattgagaagaggactacctcaagtgaagggacactgatttcctcagacaaggtagaaaaaggctgttgcttccaggaaggaaggtttggtgggatttggaggcacagctgggacatgtctcaaagccttgccttccttagtcactggtttttcaaacaactacaagtgtgtactgttatgccatgtactgccctggttttccagtgttctattttgcactggcactgaggtcattactgctttcagatcagagaattaatctcagtttccatgttttatgggatttttttttcctctagagtcatttttttgtatcaggattgagcttataaaacaaccacttttaaatatttcaggattaaagggattaatactagatttagagtttacatgaatgttgggagaactaggagactggatagtaatctggtgaaggccaagagatctataatagaaagtcatctgaagcaccaaagttggtggcttaggaaactgatacagttctttgaagactttcgtcagttgtctaccaagacccccaaacaggtggtttacttggaagtctcttacgaatctcacattgcccacatgtttggctacaaccacctccagagtctctctcttcagcatcccaggtcaggtgtgggtatcttgcattggcaatctcaaacatagaacctaccgaggagggaattctggataatatccctggcttctctgtcatgcagaggaaacctttgaagaagaaagatgcttatgtgaggacacacagtccggcatatttccctttcaccacttggttctacatatgccagaagcaacactgaggggccagctgccaaggagaaacatttctaagatatgtatattagctatgtctgtagctcccacagtaagtcaataagaaaaaggcacataatctgttagaaaaatggacagaggatatgaagagatcaaagaagaaatacaaatggccaacatgtagatactgttcggtccacttgtgattaaggaaatgcaagatcagaatatcttctatttaatttggaattattaaagtttatattagttttgaaatgtttagttttgaaaatataggagaaagctttctcctgtacctttgtacaaagaaataagagtggaacgtgtgtatgtggtttgcgtgggttgggaaatctacctactacatgattgatggccttgctcccaggaagtagtgatgtggatctgagtgagtatgggtgggagcattttaattttgtaattctaatttcaaaagagatttttattttattatttttttgagacggagtctcactctgttgcccaggctggagtgcagtggcatgatctcggcttactgccacctctgcctccagggttcaagtgatagaagagatttttttgaaaaaacagtgaactaattgtttactaggccccattttaattcagtcagtgttaagagttcaagcatcaagacaatctagtttatgttcaatgtaaattttctagttgctagaaatatttggatataatacagtcctttgctagaactgacattttaatggtgggaaaaactgtcagcctttagagatgccttttttcaagtttccgtgatactaaagttcccagctggtaacaaatgtatctgcttccttgagtttcaatgtccaggcctctttaaagtattcaggtatgcaaagacaggattatgcaagtttcttttagttggacaacctttattgatgaatttcttaggtttctgtggtagtgttgttagattaaatacagtcattccctcttgtctagtttcgttttatgtgatttcgctcttatggtttcacttaccccatggttcgaaagtattaaatgaaataaacaattcctgagttttaaattggacactgttttgagtagcatgatttgtccagtgtatccacactgtgggcactctccacacattagtcacttgttagccatctgggttatcagtattgcagtccttgtgttcaagtaacctttatttaatggctccaaagcacaagagtaatgatgtcgacaatttggatatgccaaaaagaagccttgaagtgcttcgtttaagtgaaaagatgaaagttcttgatttagtaagaaaaaaaatcaaatgctgagattgcaaagatctacagtaagacccaacctatctgtgaaactgtgcaggaggagcccattcattctctttttgccatcacacctcaaactgcaaaagttaggaccacagtgcatatattggaaaaaatacagggtttgttactatctacagtttcaggcatccactgggggtctcggaacatattccctgtgggtaaagggggactactgtatttttctaactgaactgtgatacgctgtaaccttttcttcatgacctccctcccctctacacagcttcttgctccccatagaaagctaggcagtgatgctagttaaaacacaaaacctattttagctgttagcctttcattgctagggttaattcccctgatagcagggccatttcagatcctagggtaatgtaaaattaaagttgtgtggcggatagtcacttggaacattttctaatgggagcttcaaacaatatggcatagtatgtacttttggccggattaatacagccacaagaaacctgtcttcagtacaggataatgattatttttcatgtcataacctgtgcaatctttgcttttactttgagtcagtaaatgagataccctatgctaatcatctagtgttcttattctggttttggggatatggtgtttacagagagtgtcaggggtgtctatatctgtttgtgtacctggaactgtgtcctcttgtccctgtattatctcagcacagcactgaccctgaaatggagtaccccaagcaatccaaagatgcaggacacctagaaattataagtactgcctgtgcatggcctccccttcctctcttgcacaatttgaaccacactttttctagtacaattctaggatcctttatcatgttgaaagctctccttcaggcttctttactgtgccacatttcttactaatatcctttctcacaatagtcttttcaaagcctagattcacacgatatcattctctagaccaaacctttcaatgactttatatggtacttgcaataaaattcataacctttactgttcactatctgtccttcacatctccaacctcagtgctctcttgatttcctccttaaaacctggccttattttttattcctaaaagtttcagcttaccttagaactgtggagatttcttcaaggaagaaatcggccaagcaggattctttgtaaaccctgcctatacctatttttatcccaagcacttcattattagtagtctgagtctctttgtaagtctctttgtgttccttagtaagcctttgatttatgtagtatgtcagttttccagccatggagtagtttaaacttgcacatccccctcttcttcagccccaaaggagaaactttaaaagtaaatccttcgccttaattaattatattatggaatatatattccttcctttaattaactatattatgaaataggggattcctattccagcctttctgggaactaagtaaggagtctcagactttgatagagatattatgtttcaaactgcatattctgcatttggctgtataaagctatccctttggaggaaaggttatctgagcagcaagtttaagttattagatttttatcaggaaatttggaagcatgaataaaaggattccaataattttttgtatgattattgatatagtgtattcttgtcatataattagatgaggaaattacataagaaacatgtagagtgaacattttaaatacatgcccatattaattgcagaacacaccctgatttcaaaaacattaaaatatcatttaaaaacaaagagggacatttaagcctaaaaattgacctggtaaagtggtttttagtaacagcaactttttgaggcttagcatgttttaatactaatgggatttttcatctgcttcttggagaaacctttttttaatgctaaggattaagttgaaagtagataagattaatacttagaagttataattagaagttaatgagttattaattagaagttaaactaatcattaaccagtgtttgttcatttcttcttacattgtcctattctcatctctagcactttgtcagcaacccctaagaggttagtaagtcttgaggaaaatgagtatgagttcaggaatatgtagatttgttcgtgtaagcgcttttcagttttagctttgtgttacctacttgctagcagaaatgaaccaaagactattttatggaaattaaagcatttcaacatatgcaatctttaggtgtttcttttttcctaagtcattgtgtaaatttcatgtataggaatagcaaaactgacatttgaagttgagtttacctatctcttatgtgtatagtcccttaccagaaaatactttttccttatgttgcccaggcaggatttgaacttctgggctcaagcagttctcctacctcagcatgcaccactgtgcttggctgttgtttttttttgttgtttgtttgtttgtttgtttaagagacggggtctcactttgttgccaggctgatctcaaactcttggactcaagtgatcctcccgcctgggcctcccaaagtgctaggattacaggtgtgagccacagagctcggccaaagaataaaagaatggctactccatgggcagagcagcctcttgatttttatgtatgttgatataagcaaattatctggaatttatctgctatactgataaaaatcagtaaaccttgttagtgtcagcatctaatctgtattaaacttttacttatttccctttactttttagattcaaagagagggttcacacagatatctttcatgctacattattgagcttaaggaagataaatttcccaaatatgatatttggtatatttgtgtgtctgtaattttttttttaatttaatgctgtatttaatttgtaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacaggtctgtatctcttttcccatttcatttgagaactaaagaaggtagacataaattaacaaatataatttctttatgtagctgagggtttcttatatcttagatgtgatgttccttacattgatcctgttaataaatttcctcttgacaaaagcgtgtatttttaagaattttttttagtttttttactcatctggagaataatatttttcatgttaacatgtcacatgacaataccaggtgcttcaaaatgagatagtcttagattagaagcgagggaatgtaaattctgttcctggtttcttcgctacctatgtgatcttgggtagatcatttaacctcttgagaactaagattagttttctatgaaatgatgtttttaatttaaaaaatgattttattttttctctaagcttcaaattctctaaactttgttatcctaaattacattcagatcaacataaatatcttaccctttctgtaattcttatccttctgataggctggtggtagattaagatggaatattattgaattttgttaatgtacttactgttgttggtcaatagtaagaggtagtgcttgtgaagtatattggggttagataaaaaaccagatgccttgttagagagcttgtactttacctaaagtaccggacagcaactaattacaatggcataattagatttatgcttaatgaagatcacccactggaacatggagaaagattggagaactgcaaagcagtcagctggaagagcaatttggtagctactgctagaattcaggccagggataatattgcagtttggggtatacattttgagggatacatttctgaaactgcatatttatggttattgtacacatgtaatattatgtggtatttttccttttcctaaaatgttatgattaattagtgtctttgtggaatttgaaaaaatgtaaatcagagaacagaaagaaaataaagtatagttgaaacctctaacaattttagatttttaaggcctagggaaagaaagaagagcctgggaaaagggaatgagaaaagcacaaccagaaaaaaaagtgtgtggcttaagggaagccaaggaaagttaagtgttcagggaggaggaatagccaagttttaagtaagaattaacaatgaggaggtcagtagtaacctctctctaagaatctggatttatagattcttctctatgattcattctgcatattgatctctttatctccttgtgttgcattgtctctttgtgtgttctcttataagcacatgtacaatttctaaaattaagtaaagaatgaattaactgaaaccaaaagtatagtattgacagctgtctaatttacttcttcatgttttgatgtctcttttaatatttataaaataagagtgggagaaatgacttctaaggtaccttccaattttccatgatgtgtatgttaagttgtatttatttaaggttatttgtacctagctctgtataggtgatttctgagttggaactaattggttcttaactagcccccttttttcatatgccaattacaaattgtgatcttcctaaaaattcatttcaaattacagaaatggcaaaaatcatgaaaataaacataatggtttatatgtttttgtgtttattttctatatataaataaaatacatagagatggcttaatacaaagccatatcataaatgtttctttttgagagatcttcctgtatgctttgtggccagaaattgtatttaattaaatatttaatgaatttattaaaattttattaaaaatgctgtattacttttcctaaatctccctattgccagcattgttagcattattcattgatccaaggaccgtagagctcttaaaattttggaattagaaatgctgggcagatgagaagagtcagtttagatcatttcatcattcatctattgcttttacatttcaagaagctcaaaaatcttgtaagtaaatttttttttttttttttttttttgcctcttagagacagggtcttactctgtcattcaggctggaattcagtggtgcaatcatggcatgctataacctggaactcctgggctcaagcagtcctccctccttagcctcccgaatggctgggactacaggcatgtgccaccacacccagataatttttgtagagactcgatcttgtgttgctcaggctggtctcaaactcctgggctcaagcagtcctcccacctcagtctcccaaagtgctgagattacaggcatgagccaccaagtccggcctaagcaaaatttttatacagattcagtcatctttattaaagaaactgtgcagttaaaattgccagattgtctcatgagatccatgcaggcagttggatatgtgagcttcatagtagagtttataaaagtgggggagtaataagtctagccaatataaatcagcattccagtgaccattgcagatatccaaataagagaaataaggaagatagagtcatatctaaaatgttagggtggtgatcaaatgctaaagacaaaaggaaggtttcagaggcaggatgattactccaggaaaaaagtaagtgtctaacagcactctaagttattgatgcttctaattcttcaaaatttcaaaatctctgacagtaaatatatggacaataataagaaaataggatttgctttcaagagacttaaattggaaccaagaaagtagaacctttgccacagtatgttacattttcatttttaaaacatttcatgaatcataccccatcatctccatgtacaaatgtgccacagaaaagaatatttgcaagtgtattttctaagtcctagctgctaagtacatgtagataaatttaaataattattctcttgttccagaccaattttaacactgttttaacaagagagaaaatgagaaaagaaaacataataaatgatcttagtgataagttgaaaagtacaatgcagcaacaagaacgggataaaggtttgtactgttttgtactattttttttaattttttaaagtggaaaagatacattcatgcaaagtggtttttttaattacatgatacttttttaaatttgggtgtccttcagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacagtaagtatggctgttttcaactgtttttaaggctgttgcaattccatgagttataaagctctgaagagaggaaatatttttagcattactggttgtccacagcccatgtatctgaaagttgtgctattttaattctttaaactgtaagtgtgagaaaacattactgaatgaattattttggggtactctcatactatacaaagtatgtgcaccagaattatcccatactgccaagataaggatcatggcagtagtattgagccattcttatttacagggaatgttgacattttggggtccattacctataaaggggttattgtagtaatgaatatattcattttggtgaggaaaagcagggaagggttttttattattattattattatttgtttattcatatatagcaaatgtttactgcattacattgaaatcgtggcagagcttactggaatttagaactttcttaccagttctcctttgaatatagtgaaagaccactaaaattgtgcttacaattatatctatgggagagacagaattgggaggagaaagtgctcctctccaaaggacgttgcaagtagagtttgcatttctagttgcacctctgggatttcagatatgggaactgagattccaagggcagaaagtccagatcattatgccacacaaagaattatgcccagtgggtcagtgaacactacacccccatgtgagatgaagtaattcgaacaagtgattaccaaaagatatcatagaatcagcgtggtcccctcgttcaaacagatccaggttcaagtcctgagtctagcacctgcttgggaacttgagcaagtcatcatcccttatttttccatcaagataacagttatgataacaagacaacagttatgatacaccagcagggttgctttgggcattaatattttattttattttattttaattttttttttttttttttttgagatgaagtctcactcttatcccccagggtggagtgtgatggcacaatctcggctcactgcaacctccgcctcctgggttcaagtgattcttctgccttagcctcctgaatagccgggattacaggcgcctgccaccacgcctggctaatttttgtatttttagtagagacggggtttcaccatgttggacaggctggtctcgaactcctgacctcaggtgatccactcacctcagcctcccaaagtgctgggattacaggtgtgagtcatcgcgcccggccaggcattaaatttaatgagcacccgtgagaaggtgtggtacacagtaagaaaccagtaagtgcagggtccttcgtaccccacccctgcccactcagaggaacgcagttagttgcatcttcatataagcccattatctgcctgacctttgagaaactttggtaggggagttttttgtttgtttgtttttgaaaaataaaattacttaggtttctgtctggttgaaaggaaaataatagaaactggttacctttagactttgaaaggtataaggcttaagaatgtatattaaaaataaaatagaacaaaaaaagtaattcaaaaaagcaaatcaagaaaacatggttaagcaaatcaagaaaacatggttatttagcaaacatgaatgacataaatatgtccggacatgtgtgaaaaaagtgaaccaccgtatgaaaacctctttaaaaaaatatatccaacttcattctacatataggagaggtacctagagccaaatgatacagaaagtttactataatatgattcagaaagatatagaagggaaaaatataaaagcaattcaaagcaaaaggctttaaaaagctttaggaatttaaggcttttttgattgacacataaattatacatatttatggtttacagtgtgatgtagttacatgtgtacattcaaattagagtaatccatcacctcaaacgtttatcatttctttatggtgagaacattcaaaatgctcttttctagctattttgagatagcgcagtacattattgaacaccaaaacttattcctcctatctggctgtagctttgtacccgttgaccaacctctcctcatctcctctcctctgtactctccccagcctctggtaaccactattctgctctctgcctccatgagataaacttaagattctgcatattagtcagatcatatgtaggtttttttataaatatgaaaattgagttattcagaaccaaagtatcaaaaacagatatgacgaaagtggtactctgagagaactgtgtagttcctttatttttaaatgaattaataaaaacaaatgagccacaataaaataaaagttgtttagtagatattgggataaatagaaggtacaaataaatatatgtaatgaaaagagggacataaccttagttatagttttaaaaattacagagaacatgatacaagttaatctcacctgtgaattataaatacaaggaatcctgaagacaattttagcttatcaaatgccttgtggttttatgatgatatagtcatcatgacccagtggagtattttaggaatgccagagtaataactaaacagtacaatacctaaccatactcactgattacttgagaaggtttatagagtcatgtcagtagaagctgaaatgacaattgatataatgcagtgcccatttatttaataatttaacaaaatccttagcaaactaggagtagatgggaacttctttttatttgtaagtatatgggagagacatagcaagcatcgtatttcatattgaaacatttagaagtatttttcataaattcaggaagaacacaatgccagctgtcaccattgctattcagcaagacaataaataaaatttggaaacaactttttctgtcctcattttcagacagtatcctttacaaaccacaaagacctaaagacatattagaattaacagagtacatcagagtgtagatcatagatatatccaaagaggagtagtttgcatatttaccagcaaaagctgactttaatatgtataaaagatcccaataaaaatttaaaggaataacttacttgtaattaatttaacaaaaatgcgcaagacttcgtgaagaaaactaattttatgaagaggcctgaaagctgtacgtggaaagatagatggaaatggagtattattaagatatcatttttctcctcagatgtattcagtgatttaatctattactcaattaaaattctaacaatatgttaggttaaaaagtgatgtttgatgctagaattcatattgaaaaatgtgtaaaaataattgatagcatttctaaataaagatcagagagtagagatttgtcctgctaggtgttaagatatagtcttaaactacatagatagtatttaatgcagtacattattggtatagccacaggcaaatagattaatagagttagtaatcttgaaacaaaccagtggatatatatggaaatctacatgtagcattttaaatcagtttggtaaaaggatggactcctcagaatgggacattagaggcattgttgatctattggtgagaggtgagccatattttacattgtatatataaacaaaatgatagatgtagtaaagactaaatttttttttgaacttacagagtttcttaaagaaaataaaagactactctgaaatcagagtaggagagcacttggaaaacaataatcaatattacattgaaatttaaagcttgagtacaacagaaaacaaacagcagaagtctggtggttaatatttttaataaataaaagataaaaaccaaacttttaaataatgccagttttttataatctcttttaaaaaataggagagaactcttcccaacttatcctctgaggccagtattatatactaataccaaatcagacaaatatatcaaaagaagaaaatacatcttctataactattgacacaaatattatcggcaaaatactaatagatccagtctggcagaatacaaaaggaattccaattggctttatttcagaaatgcaaggttggtttaacatctaaaagtcaatttatgtcatacactatatcagtagaatgaaaggacagaaaaacacatgattatctcaatagatgaagaaaaagcatttgacaaaacccaacagcctttcatcataaaaacactcaacaaactaggaattgacttcctcaacctattgaaaggcatctgtgagaacccacaattaacatcatactcaatggtgtaagactgaatgcttttcccctaaaatcaagatgaagatggcctgctcttgccactgctgctcaacattgtacttggaagttctatcacgggcacttaggcaagaaaaagaaattaaaggcattggccaggcgcagtggctcatgcctgtaatcccagcactttgggaggccaaagtaggcagatcacctgaggtcaggagttcaagatcagcctggccaacatggtgaaacccagtctctactaaaaatagaaaaattagctgggcatggtggtgggcacctgtaattccagctacatgggaggctgagacaggagaattgattgaacctgggaggcagaggttgcagattgcgaccctgccctccatcctgggtgacagaacaagactctgtctcaaaaaataaatatataaataaataaataaataaataaatgcatctagattggtaaggaagaaaaaacactatttgcatacatagcctgatcttttattgagaaaatcctaaggtctcctctaaaaaaatactgtaattaacaaactagttcagtaatgttggaggatacaggttcagtgtgcaaaaatcaattggagctggctgtggtggtgcacagctgtggtcccagctactcaggaggctgaggcagcaggatcccttgagcctaggggtttgtgaacagggatgacataacaagaccctgtctcttaaaaaattgtcattctttctactagcaatgaatcatccaaaaatgagatttaaaagacagtttcttttctgatggcatcaaaaaggtaaaaatacttaggaatagatttaacaaaagaagttcaatacttgtacaaattacaaaacatggaaaaaagttaagacagtagggcatcctgtgtttactgactggaagacttaatcgccttaagatggtagccctccccaaattggtctgccagttcaacacaattcttatcgtaatctgaactgtgttatgttgcagaaaagggcaggctgatcctaaaattcatatggaattgcaagagtcccaaaatagccaaagcaatcttgaaaaataacaaagtctcacactgtttgactaatcttaaaatttgtaagcaagggtaataagacactgtagtgctagcctgactgtatcagtggaatagaattgagagtccaaaattagccctcgtattcatggtcggttgaacccttgcattttggttaaaggtgctgagacggttccgtgaaggaaatagctttttcagcaaatggtgcagggatagcatagctggatattctgatgcaaaaggatgaagttggaccctttcctcaccatatgcgcaggttgacttaaatagatcatagacttaagtgtaaaagctaaaattataaaactcttacagaagtcaatctttatgaccttatattaggcaaagcgtcttcctaaagaagtagcatgttgaagaagacagaatacctgccttgcatcaagttacttgaaatataatttggggattatacctgtagatgaattttaaaacctaaataataattgtttttctcttttctaattttatagcattttttaaaattttctaatttgtttttggatgttttagtgtattgggcaaattcacacctggcatagtaactagtgagtacatagcatccacttagtaaatctactgaagtctttagccactcaagaactacgactttatcatggattcactcacaaatattaagaagagtggttcttaatgcctgggaaaaataagaaatttaaagacatctctagataaatgcatacacagagttttacttattatttcaaaaggtttatagatctaggtctgctacagagaatatacaacattgaaattacatgctaactgaaataagctacttttgaaaatttatgaaaacccttaaattgttaaagtgatctgtattaatattttaatttctaaaatcttgaagaatgtaaagtttagaatttcaaactgaaactcaattattctcacttttagagaaaatattcatatgttgtctgaagaaaaacagcggataatgctgttagaacgagtaagtaaattatcttcttgaagtaccatgtttaatatgttcacttttggatacagttaaacttcattctggaaacatacaatagactatttgtgtttataaattaagcctttttatgattaacttatttttgtggtcactgttttgggaagtcttgtcattttatgatcttactagctaaacagttgacagtatttcagccctcccatttgttgtaatttcccaatgaatgaagtctgtatgagaggaaaaagttggtagtttttattaaatcaatgtgtaaagtaatagttttacctaatagttgagaattcagcaaaataacatgaatggcaattttaaacatctatttcaaaaacaaagtattaaatactttttagaaattggcaaaaacaaaaataagtaatgaagggagttatgttttaaataaagaattgaaatggacaagaaaaaactgataataaagggtttcctttattaagggtactataagatcaaattggtacacatttggcagatcattgttcatagattacttttcattctttaggcctataagattttcaacaatgcctttttttctttacaagtgtaattgtctgataaaaatccaaattcagaattgtacaacttcatttgaatatagcatgttttctattatgaaagggttatgtgatttcctacctcagcataacctgagatgtatgttacagatgccagatgtattctcttaggcacgacttagttaacaaagtctctggggatagatctcagatttttactacatatttatatattccacaggtgtttctaacgcatattaatgtttgacagtccttggtaaatgtatctaaaattgctctggttctcatttaagctagtagataatgaaaacatttggaaagaattcatagaaaataatatccccatcaacttttcatacccgaaccaaacatttttgtctgatgaaaactttgacaatcactgtttagatttatttgagtaggtacaaggataaaccacaggtctcttttttccacctgcagacattgcaattgaaagaagaagaaaataaacggttaaatcaaagactggtaagatttttcttcttggtaaattggtcttaacatttttaaatgatttgcattatatttcattatgaagatattccatcagaggatgtatgctttgattgacttatctatagtaggtttgttggtccgtgttggtcattgaatcctattgattttcagaatgctgaagtcaggccagagttatctcctgactgtagagtcagactttttccttagcgtgaaattaaataatgtcttggcgaatttacggctgtaggtctgaccagttgaagcacctaagattcttaaaatcatcaaaatcagttttgagttatgtttcataagtcttttgaagattaatatatttactcacaagtgtgcgtaattttaatacattgtatcttttcatgattttttttttttaagacagtcttgctctgtagcttaggctggagtggtgtgatctcgactcactgcaacctccacctcccgggttcaagtgattcttgtgcattagcctcccgagtagctgggattacaagtgtgctgcgccgtcacacccggctaatttttacataattaatagagacaggatttctccattttggacaggctggtctcaaacccctggcctcaggtgatctgcgcaccttggactcccaaagtgctgggagttacaggtgtgaaacattgcacccagcccttttcatgaatcttatttttaagtgaaagtgcctgaaaggcaagagatcccatgtggtactgtaaattgccctggtttttattgatttgttttgtttcgtttttaattaaaaaaaaaaaatcgagacaaggtctctctctgttgcccaggctgaagtgtggtgttgcgatcttggctcactgcagcttcaacctctttggctcaagcaatcctcctgtctcagctcagcaagtagctgggagtacaggcgagtgccgctgcacccagctaatttttgttttgttttggttttaggttttgtttttttgttttcgtagagatggggtttcaccatcttgtccaggctggtctcgaactgctgagcttaagcgatccgcctgcctcagcctccccaagtgctgggattccaggcaaattggaattgcctggaattttgctgcacccaaccaaactgccttggctttaacctgtgaatttaaccaattatttgaacagcccattttacagccaattatatgttttaataaagcaataactttattttttcaagttctattaattacagtttacaaggtagtaggaacagtttaaggcttctgttcagtgcttttgaaaagttttgaaatactttttagaatttagtttgtttaaaaaataaaaatatcttgtagtgagacatctcctttcttctttataccttaacttgaacagcaaaaatcacatattttgtagtgattatactgtgaatcattaattttatcacaaagacttagaagaatggtctatctcagacatgactcaatacgtgttttatgtagtatgctttatttatcctcaatagaatataagctctgtttggcaacgattttaatcagttttggtcaccgctacattcttagcatctagaatggtaactggtatactatagatgcttggcatatgtttgtagattaattgtgaacccaaaagtatctgagacaggtctcaatcaatttagaaagtttattttgccaaggttaaggacgagctcatgacacagcctcgggaggtcctgacgtgtgcccaaggtggtcaggacacagcttggttttatacattttagggaaacatgagatatcaaccagtatgtgtaagatgttctgtctggaaaggtgggacaactcaaagctgggaagagggcttccaggtcataggtagataagagacaaatggttgcattattttgaaactgtgattagcctttcactgaatacacaatttacatgtcagaggatggtagaggaattgtcacttatgcttcagtctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttattttcttttcacagaataaattgtctttcagacccagagagcatcacagtcacattcagaaaggtgtccaaatgtaaatcacactttcacatagaattacagctatattaacaaattttttcttccattgtcttcatttgtaatatataaaaaacttaagcttttaaaaaactaaagttgaattatggtcttaaaaatgatggtcaatcttatcttcactggcaggatatagaccatttgtctggataattttagtaagttgctatacagttttaggccttcctagttattatttgttgtgttatttctctttttaaaaccctgcattgtaccagatagcgttcagagggaagtggaggaaattcagagcatcaaaatttgacttaataaacaaaatatccttatctgtccttggtttgtgcaaccatgcattgggctcactttgcttgggaaaaataggtgtttttatcaccctttcaagcttcaaagaccttggtttccatgcttcaggtcttatgagatggtgtggataaatggattgaagcttgtttgaagaggagaacagtcccggctaagccatggctatagcttatcagctagcaagtaccatttgattgtgctcatcatcagtagaggaagtgggtggctatcacaaaattcattgtttcgtgattgttcacaaatttttttaaactgagacatctcagaagtttcattgaagatgagaaaagaggtttgttctcagccttcagaactttatgctcccaccccagtttaaccagagtagtagtgtttgctaggcaaggtgtcagagcgctggcattgcaaagtggttgactctggtttggtaagaagaatttactgacaacagtataggtttgaaaaaggaaagttttattagagcgaatgatgctgaagagtgtagcggggtgcctcagcaagagaggactgagcacgctgtggtgaattttcccgacgagcatatatggaccttaaggcaggatcttaaaggtagtttggaccaatgttggccgtgtaggtcatgataaatgattacatttgtagacatttttgtgtcttgatgtcagcaagggttgctcagtgagttttggcatgcatacattccagagatgtatagaaattctagttacttacaacatttttgaaagagacctgtaaccacatgctaggaaagtttaattacttctaaattcctcagcgttctgcctccagatggcctgtttgatggtcaccaggtgtctttgcttgctgcattatacttctaacctctgccttccaggctcaagtgatcttcccacctcagacttccgagtagctgggaccataggcgcttgccattatgcccagctaattttttgtatttttggtagagatggggtttcaccattttgcccaggctggagattttaaatctttttggtttttttgttgttgttcgttgggacaactaagttcctcttcaaagactcaacttcctggtcataagttgtaagattgtaaatcaaccccatccccttctcccctctgccttctccttttctcacaaatcgcacatttaccctatttggaaaaagtttaggtctaagctaaccgggatcagcttagattgtgtggtccaaccccagccaataggggaaggacacagaaacagaaactgcattagagataaaaccccttccttcctttgtttggtgttctcttgcaattgtgacggctgtgagcagcagccttctgcagaagtaaagttgccttgccaagaaattttctaagtgtgggtttcttttggctacactgagcacttgtttccaacattgttgtttttccaaaatgaaagattttgaatctaatgcattagaattttcaaagtcttcttgaaaaatctgtccttttctctgtgttttatttttaagattaaatatgtaatataaataaaatgtgattcaaaaatcagtttttaatctaaccaaatttactaatggttgaaataaaggaattattaatgaacataagaactatattagtttgggctctttaaagctggacacaggcttgaatgtgtataacagtgggtgaaatttttgcagtaagaatgcatgtggtactcaaattgtgtaagttcataaactttttttttttttttagatgtctcagagcatgtcttcagtatcttcaaggcattctgaaaagatagctattagagagtaagtattttagttttgtgagtatttttctgtgaaaaacattcactgaattgttaatgaaaatgtatttcagtgacagtaattcaggtccaggttcattgagctgagtgttttgcactcagtagtagtaaaagttttttactggaaagcaggatttttctaaattgttattctggaaacatttagattgccaaaactttccagttatagcattatgattaacataaatatccttgaagccttttcctccagttaacttttcagcatgtgctacctcttttaaatcccatttatctccttagtcttgttaatctatattggagagttttgatttgtttttaagttgcagtgtttcctcatttttagtttttagatttcattttattaatattctacaaattcataataaacaaattgtcaatgaaaaagtcaaactctgtaaaatatttgaagatatttattctgagccaaatatgagtgaccatggcctgtgacacagccctcaggagcccctgagaacatgtgcccaaggtgattggatgacggtgagggggaaacttggtttcatacattttagggagacatgagacattgaagatacaagttggtttggtccagaaaggtgggacaaatgaaagctgggagggtagcttccaaagtataggtagatttttaaagttttctgattggcagttggttgaaagagctgtcagtagaaaggaatgtctaggttaagataagaggttgtggagaccaaagttttgtcatgcagatgaagcctccaggtagcaggcttgacagataatagtttgtaaatgtttcttatcaggcttaacctctgtgttagtgttaaattcttgttgacttttcctgaattctaagagggaagaggacatgatgaggcaagtccaacccctgccttttgtcatggcctgaaccggtctttcaggttaaatttatagggcactggcctagaggaggaagttcattcagatggttggttgggggggcttcaaattttatttttggtttacagaatttatcaattgaatggtttaataattttcctgcactgtattaccccatagttaaaatttttctttagctttggttatttaaatggagctctggaataataaaagcattgttagcaacttatgaatagtgttcagccttttatcctgacaggaaggttgtgaaagttaagaccctttatttaacttcttgtattttatttctaaatttctaaatttgttgaccacatttttggttgtcagatatctgtgattctgacttttcatgtctcattaaaatttcagcttctctcagtgatttgaaagggcttagtggtatctgtctttaccagctgtatgtcatgtcaatgggccgttcattaatgttctttcagagactagagagagaggagctccaaaaatactgcctcatagaggccccatttcccatctccccattttaagttattagcttttggcatttagccaaaacagtgcctgccacatggttgttaggtaatcactaagtatttgtagggtaacttaataaataaaagacattaaaagtttccccagctgattttgatgatttattaggtataggatctaccaatttaaatgatcttgacaactgaaaaatatgagattgattttcaaggccttttgatgttttgaacaacagttctgaaaaaggctgtaaagagacaaacaccacttaagcatgtaattggttgtacccacttctctctttccctgtcttctttcgggcttataccccaaaatagtaatatctgttgacttgtttagacctaattaagcacctgacttctggacctagctcagttgctttttcttgtaaattgaagagcactacgcttggagacaagatctaatttttctttgacactgtgactgtatatgagatgtctctctgaatttttggtgtgaaatgaaagattaggagaaaaaaatcttgctatgactggataaactgtaatgggtgctttttctgcttttcatccagttccttaacgttagataatggaaactttattaaagaaatttttggtttttgacagcccctgacatcatcctttgaatatctgtgcatgaccagcagtcccattaggacctgggcagaatgcaaaaagagtatcatgtaaatgtgaaatttaatattgcattaatatcttaatatgtagttgagcattaagtatatatgctaagttttcagaatagggggattgaaagtaactctaagtcaataaaattgcatttctttattcagttttcaggtgggagatttggtactcatcatcctagacgaacgccatgacaattatgtgttatttactgttagtcctactttatattttctacattcagagtctctacctgccctggatctcaaaccaggtgagggtggtaagtgtcattccatgactaaaatataaacctggaatggaggaaattatataagtaaagatttttttttccctgtttaattacataagaattaagtcactaagagggaaccctgtgtaatctgcttttttataaaatctgtattatctagattattttcatggattccatttacaattcagaattaaggagtgtagcttatacaagggaccagttgatcagaatgtgcagtgattcggacatctcataaccctagcagttggataattatattgtcaaagttctcatgtacagactattcaaaattaatgtatgcttatttgtttatataaaagcattattttttggcaaaaaaaactttcttaaattataaaatgtctagtctatcctatatcatcctatgttcctaccttgtttatcattatactgttctatacacttatttttttaaaaaggaaataagctttgttaaaatatactaagtaacaatgtctattatctatttgatttttaaaatactaaaaaagaacagaatagatatcctggtgtacttagcctaagtagaattatttttaacactaaaacgaagtaagtccatttagattgatgttcctaatctaattggactgactcgcaacaaagtcaagtatcttatctatatatttataggtagatattttttttcgaaacggagtcttgctctgtcgcctaggctggagtgcggtggcacgatctcagctcactgcaacctctgcctcccaggttcaagcaattctcctgcctcagcttcccgagtagctggaattacaggcgtgtgccaccacgcccagctaatttttgtatttttagtagaggcgggtttttacctgttggctaggctggtctcaaaactcctgaccttgtgatctgcctgcctcaggctcccaaagtgctgggattacaggcttaagccaccgtacccggccttttttttctttaagacaagtttttgctctgttacccaggctggagtgcagtggcatgatcattggtcactgtagccttgaactcctgggcccaagcaatcctcctgcctcagcctcctgagtagctgggactaggtactatagatttgcaccaccactatgcccattttttgttttgttttgtagaggcagggtctcactttgttggccaggctggcaaattcctagtcttgaactaggccactttccccatgacaactccatcatggctatttgtggttggctgtttagagtatccatgaaacagtaatcatgtaaccatgaaaaatgagaagatagcttataacttactatttttacttagtactttttaccttgaaaataatgaacctgatatttcttttgtcttttatggggttttttgtttttcagttgtttaaaccttttatttgaatatgatttttaaacttagaaaacgtcgcaaagattaatatagtacaaagaaaacctatatttctttacccagattcatctgttaacattttaccccacttgcaatatctttttatgtgtatgtatctaagatataaatatacacaaatgtgtgcacacttttttcccccagaaccgtatgatgataagttacatcttagcccattacctttcaacatttccatgttcattttgaagacttcagtgtttaaatctgggaaacattaaaaaacttttttaaaaatgcacactgccattttaaaggctttcacaagtactgcagaaaagaatttatttatttagcagtcttacttaaccattaataaacccccgttccttttttcctttgaggaatgccagttgggatcatgctacccctgtgttgttgccttgggagagtgcggattaccagagtgtttttatgccttttgttagtggggctcattactcttctggcatcatacaagcatttatttttagatgattctttttggatgttagtaattggctgtgaagtgctagtttgctcttcagagaattcaccacatcctattgtccaggggcttttctgtttctgtcatgtgatcgtattcttcaggttcatttctgattatttatttgggatatctttcgtgtatatcttcccaaattatttgtatggaataaaaatccgtatgccttctttcaaaggctttagcctaaacacaatacagacagttcccaacttatggtagttctacttaaaactttttgactttaccatggtgtgaaagtgatacacattcatagaaaccctactttcggtatccacacaaccattctgtttttcacttttagtattcaataaattacatgagacattcaacactttaaaatatgctttttgttagatgattttgcccaactgaaggctaatgtaaatgttctgagactaggctaagctatggtgtatggtagattagaagtattaaatgcattttcaacttagatattttcaatataggatgggtttaatctggacataaccttatcataagttgaaaggcatctgtagtttattgcctgaatacttttgaagtcaactttaataagacagcttcttttctgatgaatttaaaaagagaatgggtaccacttggcttgtcacattttggctttatgaggactaggattatcctgtcttctctcacatttttcagctttccttcattcacacaagtactgcccttctagaattttttggttcttagcccttattaatttattgagtaccaactgtatacacactgctgtgccaagcactgtggcatacagatgtgagaactgttcacttgctgcctttgagaacttgtattaaaaatactgcccatcaaaaatgagtgttttgctttgaacctatacattttgtttgcttaaagaaatgggaaaggtcatctttattagttctttcaatagatggcactactgagttagcctagaattcctacatatttgttcatgatttgtatttagattattagtgtttcctgaactgttatttctgtgatttgacatatcatgtatatttaatgagtaacaagagctacgcacacattactggttgaaaagtaacatgaatttagttttgtaaattgttaagcatttcagtgatttcggtagtttttaaagtcttacatattcttccactcatgagagcttttttagtctgttttaattctggcagttatgtttccatgaataattataatcatactttcaaaaagagattaactatttaatttcattagcttcaggtgcatctagaagaccctgggtacttggaaaagtaatggaaaaagaatactgtcaagccaaaaaggtaaaaacgacatcatgtgatactaagcctgggaactgtaaagaagattttaatactgctttatatagaaatcattaccactgctgttcttggcctttatgctcatttcagttagagcttgaatttaatgagagtgagtttgaactggcaatttataagtattcatgctgcccttagatagtagagatagattaactacaagctatcaacatataatggaaaactactacgaagtctgtgttctatgactgttgggttgctagtgtaactaatttgcaagaaaaaaaatccctgcataactagagacaaaaagggaattttatttataaatacagttgatcttttattattttcatactctgcccccattgaagaaaggtagtgtaaagtatttggtggcttaacaaatggactgattgtataacaatatcagtgctctagagtcagtgaagtcttctgagcattcttcctgactcactataatttggggcctcaatgtacaaaatacgaatagaacttgaaccatatagtattgaggtttctttgatacttaaaacaatgatgtatggcccactttgtattatattctttagcagtggctaccaactttgtctttcctattcactcaatatattccctgttcgtgaggggtagatcttacatagtttgataaagacccccacatccctccaacccctcaatactcagcaatgagtaatatgataggagggtacttgtgtgatgtggtttatttatttttttgtttctttttgttttttgggtgtgtgtgtgtgtgtgtgagagagagagatgtggtttaatcactctagtgattccattttttctttccctcttaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcaca

SEQ ID NO: 36053 - DNA, 47514 bp, Homo sapiens
gcgcactccagccctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggtaaggctgcctcctcccacgtgcgcgagccgccccctccatcccccggccggagctgcaggagaacccgcgccaccctacgcccgcccgccgctgggtcccggtgctggggactgagggcccgaggttgctcgcatgctgtgcacgtgattcctaagcgcgtctggtctgtcccaggtatcgctcagcgcccctcgcgacccaggtgcacggcggggctggcccgggagcggcagctctgcgccttggcctcgcagggactcgctgtggtccccggagccgctcttcctgggatccaacttcgcctttcccatacctgaaacaaagccttgcgctttaaataacaggggagcttccctctcctctaggaggactccgagtccctatcgaagtttttaacctctgagacgggaggaaaaaacaaaaacccaaagcgtagaaagttcagaaaggccgagagaatgcttggagcagcttttgtttattttcataggttcgacaaagatttaaaaaataaaaccaagccctttccttcactggtcattcagtcaagtagccttgggattgctgcaaaactggctgagaaagtttaggaaccgtggggacttctgtttctccaccccttccaggtaccagctctgccctcggagggctgggggtggaaagtcttttctccctccctctagcgtaccccctgcttttctcatttacacaaatcctcagctcattagaaagataaaaatgtaattagctcattgttcatctcctcccggggagagcagctctgcaaaatgcagactttcctaacagcctgagggaccggcccgaggttcctctcaaaacccccttatgtttaaagagcaattcttgagggggaagaaaaaaaaatcctgggaagtcaaataaaatgaaatagatataaagataaaatatacacatcacagacctgacttctatagaagtaaattcaacccagaattctttagaagcgaagtttaggctctgaggtgtggagagggtcagggattggggagctgtaccccagctgcgcttagcacagacgcaggcttcctgagggctttttgaggagggcctttagggtgggggagaaagactgcctacacttagctcaccttaaagtgtctttaacctctgttattgatgctaaaagaggggagtgcagtcacctggctcctcagagtgaggatttgggcaggtgggggaaagggataccccaaattttagatgcttttgcttattctagggagggtggagatgggtccacagtgactgtcgttggatggctggatgggaacggcactgattgcccgcagtggccaggtctgggcaccgctgctctcagagtcaactctggtgttgggagtggagtgagggtagcggatgcatctgcactttgtgagcgagaactgagcagttacctggagcaaacaaagcgccttgtgttctgttggcttgcacccatcccctgcagcctgcgggaatttccttctccccttcctcagccagcggggattagcccagccctgccctgtgaggctgtgcccagccctgacctggagtccattcccaatggcttccgatggtctctttctgggaccgtctgcagacatgagtggacaccttagggggctcggctgcggaaaaggtgctgcagtccacagggaacatggggggattggacgggttgcctgaagaagagaggaaagaatccctcaccccagcccccaaaaggctgtgatgggatggggaaaccccataatcgctgtcttccggacaccttttgccccttggctgcagttccactggtcggcgcccttctcagcctggcttggaaccgtcctcactcacctccactcctcccagcagcgctcaggtagtcaccctcccaagacaggtctttgaggagcaaagagaaaagtggggagagggccggtcgggagtggggcttgggactggttttcccctcagtggttttggtggggggctctgccctgagatggcacaccaccctccccaggactgcaatccctggtgtaagggagccccacgtgatttcctgcgaggtccctgtggaggggagggtggggcgtgtgtgtgtgtgtgtgtgtgtgtgtaggtgtgtagagggcaggtcaagacaaaccagactactgatcctcataaccttatggcttgtggctgtggggtcgtaactggcactttccaatgagaataagtatgcatgcactactcttttattcgtttattctttatgcttttattctttaaaattaaaatgcattttcaaagcagtgtcatatctttgcatactggtttctgttcacacacttgggcaaattcagttttggattattggccagctgtctgtggtcatgtgttattaaggagaaacctgataatgagaaatgacttgacatttttcccctgcaaaggctgatacccaagccatagaagctcctgttagggaagaggcaattgctctttttctagggaagtcatttttgaatttggcacttccattagaactgtgaactcccaggctgatgcattgttgtttccctctctgcctggttttactgggtgaagttgtatgagccagcacattgggtttgattttgttgttgcttgggcatgttgtgcatttagtcagtgtggcagaggccacagagccctctgttccccagaaagccttccttagggctcccttttggtccccccaggaactggccagggaagattgtgggggttgtgtgtgagaaagggaaagagagaagaaagagagagagactgagaaagcacttgtgtgtgtgtggattgatgtatcacaaaaatcacttaatcctgattcagctgttgggctgtctcctccacacacccttaaatattaataaacacaaaacctttgctttttttgttcatttgctttaaacattattttaaatacaactgaaaacagcgatttagttccacctctcagaaggatgactgggtggatttctcctgcagaggcagcctgtagagccccaagacgcaccaatgaggcgcaggttaataccgcatcacacatttctctttctctctctggatcaggctgctccagagtcagccgttagaaaagctgagataggggaaagccgtggtaaaaacacacagagcccaccccaacgagctcctgccattctgagaggcactgaagtccaaatgtaattgacgggactgaggaaaatgtccctgagaagtgcagagccctccttggccgattggttcaggcgaacttcaagtgtccagaggagatgcagtgagtgtgtggagcgggcagagatgtgccctttatgtttggatcaccctgacttcactatttggtcaagattgtattcacagaacgttgctatgtgtgtttgtgtaactcccacttttcctttttcaaaataacctaaacaaggaaaacccaaaagcacagttcactctccttgtgcaagtaacctggtcctttccatattgtcacacttccttttccccatgtggaagcaaaaaccataatgcaaaatttgtggtaagttgtctcctttgtgagaattaccacctctagaacccagtctcaagttctgggtgcaaagcaaatttccagcatctgggctaaggacagtcatgccatcgtctgctgggagcgtggttcttaactgcactgagaatctggaaggtgtttgctcctgggtgcagagtaaaggtgggagaggaatgtgtcaataaaaactaaggatggggtctctgctgggccctgcagggaccctgtttggaagtagggagtggtctatgggccacttgtgtcctgagggcagccttgatctgggggtgctctgcaggtcccctcttctcttccacttagggagcctttgcctatttcaatgtctgagccataaggggggctgatggggagggagatgctgccacggaagccatggtggaggaggatgaagagcagtgggctccaagcacaccaagccccacctgcactccccgagtgcagggtcagcggtgactttcctgtgctcttcagctccagcctggcttggcctcctgtgctgtgcccgggggtggggtgcccctagaatgtgctcgtgatgttttcctagacagtcgataagctccaggctgcttgataggtgaaggtgatgacaatgatgataagccacttcagctcttggaggaaagcgccgtcctgctctccctctgtcctgggaagctggagtcctttacctccactggattttctgacttcagcagtatattggcttggaggaggcttctgccctggcctcagacatctcctcccaggcagtggagctgccttccaacgttatgcacgtctgcccccacaaacctcctcttcaaagcacttcacagttgcccaggaaagagcctctgaaggaccccttcctatccagccctgtcctcccatttggcagcgcctgttagtgccccaccccgcccgcctgccctggcctcctgctgcggtggcccttttggagaggaggtgttcaggggccgagagctggagtttgtgagtctggctgagtttctttctctcttggctcctggagacctggtcagagggatcagcaggctagctgggagtgtggaaatgggaagggggcaggaatcggaggatggtattgaaaggagaagggagaggatgggaaacaaacaccaggaagagatctctgtgggtttgtaagccagcttttcccggcactcacagcgccccacaagtcatcattcatgtgacctgcacccacccagcctcaggttatgctggcttaaataactgtgtcacatttagcagctctgggccaaaatgtttcaagaaacctgcgcctgctctggttgtagaccctgggctcaaggcttcttgttttcaattctcaggtccccttcagaagttccagaagacctttagccactttcagcctggacccagggccgatcttttccccaggggctgctcccttcctgctctgtaacttacagttccgtttctccctacttcctttcccaggcacaacggtgtgtcctccctgtgacaacgagttgaaatctgaggccatcattgaacatctctgtgccagcgagtttggtaagaaagcgtttctagctgcctctggaaggtttggaacctcctggtctgtgcctctgccagacggaggccctgctgatgtatctcgttgcagctttccatattctctacctcattcctctccaaatggctgcttttctcaggcagatgggagactagacagggtccagaaccggccagttttgatgaaggccatactttgccctcctttgtgggggatcgctggacagatttttgggcatcttctctaggcatgcagggaggctgatttggggacaggtcgagaggagcagggaaggacagcagctccttctcagaagctgcagggagtacaagttgccacctgctactgtgtctggttgggcccggttttttccggactggctctttttttttttttttttttttaacatctacccctaggtgtcagcatgactctgtccaggatttaaatggctgccctctgggtgccttcccagggaggggagagttcaatgcttaggggattcagagtgggggtcctcatcaggttccgcgaggcaaagaaaaatggacatccccacagcagggtggtttttctctcttcttcccaagtcactctccatcgaaagagaattctgaaccagcactcgcagctccaggagaaggaggagctggtgggggccagggggaggtgggggagatgccaggggccttggggccttccagggatggtctgttatagtctgacctgcagaatacctgaattcaccacaccctgagagtctctcctctgagaaaagtaaatgtaaacggcacccctttggagggccagctccctctctctcgcctctatctgacatggatgcagagaagtggctccggccaagccacactttcagaagactcagtgtgatgctgaacaacgtgtttctcataattcctgccttgtgtccctgagatcggatttcttacagaattcttatctggaaaagcgtaaagataggtgatgtgagtccattcggaggcatcccagtccatgttttcattaatcgaacatggtaaagtacacggaagggtcttgttcctgccctgtcaaagtaagctgcacacatgtgggaggacacatgcaagtcggagggaatcatgcctcacgacagggtcattctcagggtattgcaattgtggatgaagatggaagctggatgtagatggccaccagagctaaactggagagcgcgtatcctgtttccatgcatggggaagattgatgtgttctctgtgatgcagcagtgtgagttacttgtctgtttctgcattaactcaaattcatcagtgaggattccctgtatacctagtgctttctgagttctatagatacagattgagggtggaactcttcctctaaataaatgtaatacatgagtattgttttttaaaaaagacagaagttggaggattcagaccctttgccacataggctgaagaggcaagcctgggaaagaatttgaatctggcaaggttgaccttaaggtgtagggcaggggtctagagggcactcaggtaactcatctgggatggacatcttcttcccacggcagcaggcacctgccaaatcagccagcgttctgtacacagaagaggacagaggatctcatgtcgataaccagtcacggtttgtggaatctgagtgattagctgtttgggattgggttcctttagccctgacaatattttcctcttgggttcacagaacttttgggttcctcctggacctcagaggtcatcttatccagtcctcttatttgataaagaaggaatttgactttctcaactggagtccttttacactctgccacctgccctcctcacttaagagttgatgcacagccgctgggctctgccacggaggcgctgacctccttagtgtgcgtatggtgtatggcaggcttctttgagctggttgcaggagaaacctttttgtttttttgtctgtaatgttctcataaaacaatatatagggatttttttttctctctctctgtaggggctgagcttagctctgcccttcttagcaccttagagaatgcagccttgtcgagaaacgtgtttcctagctcagctcacttcaagtaagtgaggcagtcagccacactgatgggattcagttaggaaacaaagaaattgaacaatgcaagctgacacacagcagagaagaaagagaatgcttgactccctcctccagggatcaaactttgcattaagtggccctgacatccccagtgggaagacatcaggttgctggaaggctctctgtgagctccgggaacaaggggtgcatttccctgggtaagcagcaccctcgtccccctgccactgcatctgtggtctccgggagcctctgtggagctgggcatgtctgacccctgaccttctcggcatgcagtgtgctttaaccccttggcagatctgcttagtcactcatgtctccagccctgcactgtacctgctcagttcagggcacattttttccccaacaggaaaaaaacatgagcagaaaagcttgtgtgctgatgctcaggaatgcagctgatcagcctggatcaagcaccagatgtgggagccaagacttagatggggcaaagtcaccgcatcgaacatggcgaccagcctgcctgctggcttccatcagcttgcagggctctgctttttgttctctctctgcttttcctgctctgtgacaacagggtgccactctcgcctcttaaatagcccaatatagtatttgcgagccgccacactaatcatcctgctgttaacagctcagtacccacagccgtcttccctttgggttggtttatcccagggatatgaggatctgatttatttataattgtggtgaggttaattcctgcctctggccactttctctagcttcttctgcagtatctgtaaacacccgtaagctttcctgggggaaatttgcatggtgatacacttctgctaggagagttcagagcttccacttgtactaccttcttcagtgttttgagcttgagagttcaggtggcaatttcttcagcccagtattttctccctatggaaaaggatttctttgcccctagaaactttccttgccttctggaaggattcttttttccatttatatatttcctcataaagagaaaagctgtactatgcaacactaaggttagtcaaataggaaggaaaagaacatcagctttcacagttagcattagggagtatttcctagtagaaatattttcagtttcccgcacctccgtacctccactaatctgttctcactctgcctccaacttctttcaggatgtcttggctgtgctgctgtttgggggacagtgttttactctgacgggcagtttgagttcttgcagaaagtaggctcagcctttccaaactaaaccttgggtttcctcccaaagatgaagcaagatggctgctagcacagtcactgcggcacctgcaggctgcctgagagcaggctctgtatctaatgccgtgttttacctggtgggagatgcctgttaattgtgagacacactgttcagtttgtactactgacaaaacaaaaaacaataaaaaaaccatacttcttgcagaaatgtgcagaaaatctgtgtcttggaatgaacaaagtaaggcctatttgcactcaaatagtccctggcacagtgtcttatacatggtaggcataaaatgaaagtttgtcagctgactgtatgaatgacaggggatgtgggacgtggatgttggaattttttttttttttttttttttgagactaagtctcgctctacctgggctggagcacaggggcatgatctcagttcactgcaatctccgccccccgggctcaagcgatccccctaccttggcctcccaaaatgctgggattgcaggcatgatggacttctttttttttttttttttttttttttttataaaggagaaggctcttttcaaggtggatgtcggcaacttgtgtattaagttcaaggaaaactacatgccctgttttgggtgactgagcatatacatgtatacatgtttaaaagaagccccaacatccagaatctcattcagtcaaagtaaaattagacatggaaggaattgttactctggggatggaattgataggtggaaaacaactgggttttattgttgctgaagatacatattctatccacagatctgtacaaaatggagctaattgttaggatattttatgtgcgtaaaaacctgagattggcccattgcttagtgcactagaggtgtgagtcccagctgagagcctgtgtctctttctgagcagccttcttgtgcatgggaggtggggggttgggggggtaggcggtgaagagatggaggccgagccagtgtttgtccttttgcatctggcttatgtgttatgcatcatgtcctcatctttggatatgactatagactctcataagaaggggagtggagagaaggatttgccctcaagttcacctttattttctgaggtttttctggaggtgggtagagaaagagggaaaagggatgagtgggatgagggggctgttcacagctcatgtgaactgcccatttctttgggtgctgcgttgctcacctgtaccacttaaaatttttttaatggatacaaaatagttgcacatatttatggggtatgtttgatattttgataaaagcatccaatgtgtaatgatcaaactgggtaattggggctgggcatgctgtctcacatctgtaatctcaatgctttgggagggtgaggcaggaggattgcttgaggtcaggagtttgagaccagcctcaagaccccaggcaacatagtgaaaccccatccccattaaaaattaaatattaactgggcatggtgtcatgcacctgtagtcccagctacttgggaggctgtggtgggaggattgcttgaacccaggaatttgaggctatagtgagccatgatcacaccactgtactccagcctgggcaacagagcaagactgtctcaaaaaaaaaaattgtgtaattgggatatctaccacctgaaacactgatctttgtgttggaaatgttccaaatctagtcttctagttaatttgaaatatacaataaattattgttaactataattgcctagctgtgctactgaagactgtatcttattctttaaaaatacggaacacttcacgaactcacgtgttatccttgcatggtggccatgtgaatcttctctgtattgttccagttttaccatgtgtgctactgaagcaagcccctgtaccactttgccattgtaaagctgtgttgagttggataggacctcaaagatcagccagtccgtgccctcacgttactgactgaaggaaataagacaaaaaaataaaggagttaggcattcagtgacccaagagcactctacctggatccctgttactgcccaccagcacttccctggcatccaggccagattgcacacccttgctccttcccatcctctcacacccatcaagcaggaaggtagttgaggagcttcctgggaaggggcatcgggtgctcctttactcttagggtttgtagaatttaaatggactgatgtctgtgcccagcacacggaaggagctcagcaatcattggctcccttcttggtgggaaagccggcagtgtagcagaatggaaagaacacaggctctgggcgagacagacttggattaaatccctaccctataagctaagcgaccaccagaaagtctcttaacttccctgagcctggctcctcatcagcaaactatggatgagaattcctacgtgactgtgttgggagaattggatttaatcaagtgtggacagttcctggaatatggtggctgttcaatctgtaataattattatgtcttcttattggaaaaaaatgttttaggatgaaatttagcctaggaaggaaaattccagcactaatgaaatcagcttgttgggcggaaagttttttaggaagaagaatggaatatgctagttaattctctggttaatggaggattaaactgaagaagtcttttaaaaaacccatttggaagacctttaaaagctttaggctgctgggcacggtgactcacacctgtaatcccagcactttgggaggctgaggtgggtggatcacctgaggtcagaagttcaagaccagcctggccaaaatggcgaaaccccatctctactaaaaatacaaaaattagctgggcatggtggcaggcgcttgtaatcccagctacttcagaggccgaggcaggagaatcacttgaacctagaggccaaggttgcagtgagctgagattgcgctgctgcactccagcctgggtgatagagcgaaactctgtctcaaaaacaaaacaaaacccacaaagagaactgctttatgcagcttcaaggtgctgtaattcacaataacaataacaaacaactccccctcggaaagccaaaccctaactagaagttaggagatctgggttttagtgagatgacatccttatgtcaacgtaaacctggaagcctccagacagtgatgagggctgaatgcgggagctgtgactgcctggtgttccaggataggaccactgaagttttcatttgtgtgttttttagaaacactctacctaacgcgttctccttttaatttagcagggcctatgtttgagggacttcagagcccctttgtgctgttttacttcactttgttctccatttttctccagcgatatctctggggcacttttcccttcccctaccccaaccccaacacctgccttgtgatattcacttcctttaaccaaaaaataggctatgcattataatgcgaatgagcttttaaatattggtaagtttcatccagttttgcagaaatgtgctggaagccccaatctgtttttttttttttttccagaagaacaaatggccaaagaaatgtcagatcattgccctgccccgaccttagggcagccaattaaacatgccttcgctttggaaggcttctcaaaggcctatagattgtgcttgaaatctttgtttagtctttcaggaacactgtcacacggatgatttatcaaagaaagttgtttatctggcagtaaaataaactctgggcctgttcagactaagatttcccgtgaatttttaccaaggtaaacactactaactggcaggttgcaaactccgtgtgaaagccagacacatataatacatatttgaactacagctttgctgtgtatggggtctggcctgccactagtgctgtcactcccactgtgcccagaggacctggactgcagtctgtctggctgggtgaccaagaagagggacttgccccatagtcagtgtgtgcaagagccacccctgtagcgtgagcctccctgggtttgagtgcctcttactgctggcacctggggacttcctaattcaaagggggcaggctcaggatggttgccctccgcatcccacaaatagttggtgatgagttatgaggaaagtgaaccagaagcagccagcttaggtttctttgaaaatagacatttgttgatccacattggcagggggctggacgtattgactgatctgggagctggggccagggcatggtggcagggggtgaagtcatcttctggattctgctgagtgttaatgacagtggcaaaaaaaaaaaaatgctgcagatactcccccagtgtctctggctttgctagtgggtggctgtgagagacccatttgggaattaggtaagttgagttctgtgagtgctgcagcgcatatttaagtgagagggtggatggacacatgaatggtgatgatggggacgagatgaaatacagccttccaggtctttccagggaaggtactgtagtgaatttttttttttttttgagacagcctcttgctcttgtcgctgaggctggtgtgcagtggtgtgatcttagctcattgcaacctctgcctactgggttcaaggaatttttctgcctcggcctcccgagtacctgggattacaggcgcccaccaccatgctcggctaatttttttttctttttttttgagacggagtctccctctgttgcgcagactggaatgcagttgcgtgatcttggctcactgcaacctctgcctcctgggttcaagcaattctcctgcctcagcctcctgagtagctgggattacaggcacgcaccaccatgcctggctaatttttgtatttttagtagagatggggtttcaccatgttggccaggctggtcttgaactcctgacctcgtgatctgccctccttggcctcccaaagtgctgagattccaggcgtgagccactgcactggcctgtagtgattgttgatagtggttttttcagggagactgctggattataaactgcttgttcttacagtcccagccagctccagatgctggagtttccatatcacactagccttggggttcttcctgcagggctgagtttaaagatgattgtgggtagctcccataactcatgctgcacgctgggtccttctcatcccaactcctcaaagcggcaggagcaggaactggggactcctgagagaaggtgacatttgtgtctgtgtgggcttttggggttgggatctcggtgcatgtgcagagcttccatatacatatttgagtcttgaatgtaaaaggtgttggtctgttaggtttggggggctgtaagcatgagggctgaggctatttgacagcacttagggattgatgtgcaggtaatagatgcttactggcttggcagatatttggaggcataacagaggtattttctgtagggcaggaattaagggacatcatttacaaattctgaaaggatgtctgtgagttgtaaagagatgccaaaatagtactttggcagtggggagaaaacgagaaaccagcttccctaaatgatgttctttctcattcaggcaggattacgagggggattttctctctcttgttttctctagcccttccatcagctttctccaaaggacatttccttttgggactacctcagatgtgttctcttctctttgtgagctctttgaaaattttccacgtcggtgtcttccgcaatggatgcattcagctttggggaatggcttatggctgaaggaaatccccaactatatgtcggtggcaccagagctagaaacgagcctggataagcactttaaaccctgagagcagctggtgcctagagagcgcattccctcctgtggtactccatagggcggctgtgccagcccgctgtgctcacctctcaggctcatagacagtctgggcgccttccacttttcctttggtctcagccccatatggaggaccctgttcctgccctcgacacatttaagaatctggtggccaagtatggtggctcatgcctgtaatcccagtgcttcgggaggctgaggcaggaagattgcttgagcccaggagttccagaccctgtctctaaaaaaaaaaaaaaaaagtagccagatatggtggcacattgtggtcccagctacttggtgggatgtgcgtctgagcccgcgaggtcgaggctgcagtgagctgtgttcaggccactgcactccagcctgggtctgagacagggcaagaccttgtctcaaaacagaaacaaaaacaaaaacaaaaccccccacaaaacccccaagaatctggtgggcgagacaggcctttgccatgcttttttgtctctgctctttggtaacttcagatgcctttgtgcgtagttctagcactcaggactgaaggagggaggggtcttcggtggggcctggagaaattcagggaactttcctagagaagatgaggatctaactgtcaggctgaagattaatggagaaagtagaggagggcattcctggtgtcaggagatgaggacagggaaagggagtaaagactcaaaacaagtagtaattcttcaattgacgaaacctaagctggtaaataaatacagaggagaatgttggtttgtcatttgtcagttataacaactcgcttcgcattctatgttctgcttagccctggcccacagcgtggggactcaaaggctgcatcaaggcatgggagggggagctgctccttccaattcgcagctgtctgtgtacccagctcaaagggtgacgaggtcccagcaaggctgtacctgttcttgtggtgcagcagttggaatgaatggcccatgtgtttcaggggtccctcatgtggttgtggccatgggcctgagtcagatatgacacccagggagtgcatagctgtgaggggaaggagttcagtcaggtaagtacttgttgtcagccctgggcaaggaaggtgctgagaagtgcacaggcaagacttgagtcttgagagcagcctctcacctccacgtaacccgcagccgctgcttccactcacaggatgcagggctggctagaaggagtctcgacctttgttctgagatgtagaggcactaagagctgagatgtctgcacagtgccaaatgccagccggcacccagcctctctggttacagggtctttactcttaacacacattcatttaaaaacaggctcatgatgtgtgtttgtgcatgtgttttcttttgaaaatctaaccacctgcagaagacgtgcactcttgcagagatgattcaacaatcgttgggcttctactgagccctgcttagtctgtaccacatctgttgactagaatcaacatccaaagagattttagctgtgtagacagaagtgttgatatcatttcttcccagggcctgggaagagggaagtctccataattgtattagtttgttctcacactgctataaagacactacacaagactgaatactttataaagaaaagaggtttaattgactcacaggtccacatggctggggagatctcaggaaacttacagtcatggcataaagggaagcaggcacatcttatatggtggcaggtgagagtgtgtgaaggaagtgaagggggaagatccccttataaaaccatcagctcttgtgagaactcactctcgtgagaacagcatgggggaaactgcctctatggtccagtcacctcccaccaggtctctccctcaacacctggggattacagttcaaagagagatttgggtggggacacaaagccaaaaagggctgctatgggatcttcgctgcaaagaattctgcagctgtctcctccctccaagtgctctgaacccgagttaagccctgggtaaggaaggtgaaaactctgttggctatagatagctcttacctgcacacctgagtccaggagtggaagtttttagtggtgtaattctgcctggggtgtgttgcttttgaagttgcgttatgagtgggaagccctgcagtgagcctcgggctggccacgtaggagctggtgagttttggaggagagggtgagggtgtctgtattggggtgcccctggccacactagggtacctcgctgtccccactcctggggcctgtttgaggcagaagctttgggtttgtcacaggcttctccaaggtgcctctgtccgtgctccagccctggatcacagtgcctttgtgctgctcctcatggtgtttcctgcctcgggaaggaaacacctggattaacctaatttcatgttagtgtcagagacccagtcaaggctgactgcgtggtgtgtgtgctgggctccgcgctggtgagtgtccagaaaatggtcatggggtgtgattgggaagtggttctgctctaccaggccttaccatctagaggaggtcaggggatgcagagatgcccgtgatagagaagagctgggagccacgggagcatacagaagggagctggtctccaaggaaatggtcaaggggagctgcagagatgagagaccctgtgctgtcctccatggagctggtaggcatttgtcaggcagcaaaggtgggcctaggaagataatcccagtggagatcagaccaggagctgcgacgctgcactggggagtggcgaatctctttgtggttagctagcttatcagggtgtggtggtgagtatctagaaatgatgacaaaacaggcaaaagccagcttgtgcggcaacctgactgctttcttacagaatggagatttggccttgttggtaacacagagacactgggaacttattttaaaacatgactgtcttatatctttaaaaaagtcctcaaaaaaggccgggcgtggtgactcatgcctgtaatcccagcactttgggaggctgaggtgggcagatcatgaggtccggagatcgagaccgtcctggctaacatggggaaaccccgtctccactaaaaatacaaaaaaaaatagcggggcctggtggcgggcgcctgtagtcccagctactcaggaggctgaggcaggagaaaggtgtgaacctgggaggtggagcttgcagtgagccgagatcgcgccactgcattctagcctgggtgacagaacaagactccatctcaaaaaaaaaaaaaaaaaaaaaaaaaaaaaaaaaaaaaagacgaggaagaggaggagaagaagacaaagacctcattaatcaaataatgaagtcctaatggcagaactgcagacatcagtggtgagacattttggacagggagtctctgagtgagggtgggagggagagaggagccctggagccgcgtcccgtatgagagggctcagggtggtgcctgttgggtctgggcctgctcagggccacccacttgaaggagccctcgggaggtggctgatgaggtcagcacagctgtcctggccgtcagggaaggggccatctgctgcggtcagtgcccccgggacacctgtgttctgcgtgtgcagagcgggagccagagcctgtaatcagctcatacttaggtcaccgcagagctggccattaccaagagcagttgtcattaggacccatcataaatggtcctgacttttctctccagactttgttattgaccaggggcagcaggagcagtgcctccggagccagccccaaagcattgcactgggaatggcatttatgagggccttcagggctgggttagcccaggtgtctggagcttccctgaaagagggaggcaggagaggctgcagtgacaataagggacaaggggaggtgcatgtgtggtttgtgtgtttatgcctctgtgcacgtggggttatatctgcgagatatgggtgtctgtcgatgcctatgtgtagttgggggacacaagggaccacctgctgtgcacacatgtgtgtttgtgtctgtgtttgcctgtgtatgggtcagtctgtgaggtgtgggtgtagacagatgtgggtagtgtgtggtgtgatgagctgtgtacgtgtgccctcctgtgcgtctgtctgtgtgtgcatagcacatctgcctggtgagcctggctgtgctgggcagctgccttttccagctggcctgggcttcccagggacttggtctccactggtgaggcccgagggtcacttcctcccccagcacttgagagagacactgtctagagcatgctgctaatccactatcctccagaagagcttctgagaagcccaggagggatttctctgcattgatgccattatacaaactgagtgccatctttgtaagtttggggaacactcctatggtcttggtattttgtttattactttgagtgccaaatagacctcttttgtttaggtttcagtgtttgcagcaagtccatttagaactgctggttctctgggcaggagtcacttccttagaggattccagcggttagcagggattgacataaaggcggtgctgtaatctctaggatttaaagagtgcattggaaagaacacgtgtagccttaggagctgtacaggcgtgagcccagcgcctggttctaccacctactgtgtcagcgcctgcaagtcactgaagcactcggtggctcagtttacccacctgttaagaaacaaaaacaaagacttctgcgttagaagataaaatatggagtaagaaaaaaataacacagattctggagtcctggcatctaatttctgcgctgctactgaactgtttgtgactttggccagtcagttcaaatctctgagcttgtttccttaagcgagttgaaggggtcaccataggtgatctgtgagtgtcctccagctctgcagttaggtggttttggtctgtggcaaaaactctgtgacttgctctctaggtgtgatatcttggttggcacctcctgctccccaggcaaggcccctgggaacactggccttcaccttgggtgcatggggaagagaagtcgctatgtgcctgagagggtggagcagatgaaaactgagttggacgcattcattgaagggttgagttgggggtgcattggagggcgtaggaccactgcaaagggcagtgcattgcataaactgtggatcagtggtctctgaccagggctgggcactgctggacatcctggccccagcgccatcttcttgggctgatccccgcatttgcagcccctctcctgaatgtgtctctgagctgctgcttcttcccttctgttctcagaaacccagagatggatggcataggagccccttccgctgcatagggtaggagagagcctgctatggggaagcagtttggaagcagttactttctaaaactcagaactgagttttcattcctgccccacaatttactagtcgcatggctttggccaagggcaatgcttggaaccacagttttctcatttgccaaatgatggccatcatgcatcccccacagagctggtgtgtagacatgagagtgtatggaagagtcctggaaactacaaagtgcattgcagttttttttttttttttttttttttttttttttttttttggacagggtctctttgcccaggctggactgcggtggcactatcatggctcagtgcagcctcgaactcctgggctcaagcgatccttctgcctcagtctcccaagtacagggactgcaggtgcatagcatcacacctagctaatttttatttttatttttatttcattttatttttttggagatggagtctctgtcatccaggctggagtgcaatggcacgattttggctcactgcaacctctgcctcctgggttcaagtgattctctgcctcagcctcctgagtagctgggattacaggcacgtcccacaacaactggctaatttttttatttttagtagagacagggtttcaccatgttgtccaggctgatcttgaactcctgacctcaggtgatctgcctgccttggcctcccaaagtgctgagattacaggtgtgagccactgtgcctggccaaatttaaattttttttttttatagaaacggggtctcgctatgtggcccaggctggtcttgaactcctggcctcaagttatcctcctgcctataggcatgagctgccatgtccagcatacaaagtgcagttctcctctaacttgtcattcaccctgtggcggccagtcccagttgctctcttacagctccatgtggcatccctggaagggcttcctgtttatgtggaggctgtcagcatcccttgtggtcccttccctcaaagcatttgtgacacatgctgcactttccttaaactgtaacaggtgaatgcattttatagatataccaaattgaagccaggatagtaatggtaatgtatttctcagagaagcttaaaaagaacttcagaggttattataatacacacgaatctattccctcaccttctctgtggactcacagggagagcaaatattagctgaagaccctgagatcgaaagcatcaaatcagaaaggatgcttgaaaaatccaggcttgagatgtagagccaggctcacccctaaagagggaacagagcccacagcaggccctggtgcaggtgggatggatgcatcggggccaccagcctgcagtggcacatgacctggtgctcttacccactctccatgacgttcctccgagccgatgccagcatttagaatgagcgctcagcatcgcttcggccatggtggccgatggcagagattttgtgtaagaggagctgtgaggtgagagaaaacaagctggcacgcctgtcattcccaggcatttcccactttcctggggcctggccattctcttccctatataaccccttcaagtggacaagcctgtgtgtttcaggatgtccaccttttaggactgcaggtgtcaggaagaaaacagatgtgagggccaaggctgtgcagtccagcaaagggaagactcctgtgtggcaccggagaaactgggcttgaggaaatgaaaccttgttcagcagaggggcaggctgccttgttccgtggtagggtcccactgtagacgttattcagagacctggcagcctcttagctgcgatacctggaggcctgcactgggcaggaagccagaggcatgacccacaggactctttttcagcccttcagatgccacgcttggggcactcactgtgtgctttctggccactggcttctctccagaagttggctgtgttggtgggtgaaccttccttctggtggagatgtaagatgatctttctgaagaaggtggaggagccagctagggcccccatctctttaggtcaccagcagcgtatgaatcctacccttgaaatgagttcctagctgcccccgacctcgtgtgtggaccccctcttcagtgaagaaagggatgacgccagggtgtgtaaagacagaatcctggagtcgttccatgttgcgtgtcttggagaggaaggccagatggcctggagcattctagtggctgtgactctttgggaacggacctgcagttggcagcaaggagcatggacatggaatgaagtccaggcccagggctgaaccccctccccccgccccgcttcctttatccaaggaggagccactggccccacactccctctgcctcccttggtgttgattttcctggtgactttgaaaaacaaatccttttttgccttcacagttgtgtccctgtgtttgtgcggcgggggaggcggtgggaaggttgagcgggaaccgcccctgcctcggaacaggagtagaatccatgtattgtgttgggttttccctgtgactgacagctctttgcctggaggcttcttcgcttacagacttaatgtatctcctggcaggtttccttgttttggatgattactcgaagtcgggaataggcaagcccagggaggaacacagagtgtttctctctcttgggttcatcgtccccatccctgtccccccattcccgacgctctttggaagtggggtgatgccaggaatcgggtctgggccggctggcaactatgagcttctgctttacccacccaccccctccccccgcccagttccatagaatgaggaccctgggttggagtggaaacgttgcctgttcctcccatggagccctcagcctgagagttcctggggacccataccccaaaactccgcagagaacaccaaagggtggccacttctgaggcggctgggagggatcattggcacccccgaccctagcctgagcctggccatcccatccggtggagcctccatcccgctcgagctaactgagcacgcctgtctgtcctaggtccctgcctcaccccagaatgctcttcagaggaggcatggcaggggcactccctggcactcacgggggctcagcatttcctgagttggaagggttggggggctgggccacagccctgctgttgtatctgactgtggtcctgggaaaagtgaggccaggtgggctggcctcagggtccctggctcccggctttcctgccttactgcagccgcatttctttttaggaaacgacttatctgatagtaagctggggctgcacttcttccgcctggagtggggcttagttctctggtttttggcattttattctggcagggaagtagggagtggcttgcttgcatttgtggaagaaatgagggaggctgattgagcccatggggctggaacccgaggggctggggcatcacccttccggaaatgagtgtgtgaagggaatagtgcgtggggaacgaggggcggaggacagcagtggctccaggaagtcgggagtcctggttctggtgccagctcagatgctgacggctgaggggctgggggcttcattttctctctgggccccagttttctgatcggtaaaatgagactttggttagatggcctcttaaatcccattgtgctttaacattctgtgcatctatatgtgaagttcgtgtttgttaaacactcatgtgccacgaagcacaatttttctttagaggaaatctcacccggaactccattgtggaaaaccaggcagcacaggccaccaggtcggaagcggaggggactgagtgtcgggctggcttggcctccacttactcttgcggtgcatctgtggggcgtagggaagagtgagtgtctgacctgagggaagaagggcagagtgaactcaatgagtcactgactctgtactttctccctggactggagcatcggccttggccttgcagcctgggggtacccatgatggcaggccatgttagcctgccagcctgcacttgcctgcgcttaccagcagctcccagaggctttgcctctgcctcacctaagaatgctcttcagaggaggcaggggagacccctccccctacgccaccttccctgggctctgtagagcgagcaggtgtgggccctgcaggctgggctctgtggagtgagcaggtgtggtccctgcaggtcacttcatttgctgctgccctgagctgctgtcctggctgttgtcagccatgctggaggtccgtgggtatttgcagcccagcatctcctgagtggcagctccattgccagactgagggtccctgctgacgctctcagccatcacagagccaccagagcactgtgcccagtgcatgagtggggtttgctgtgggaggggccctccagcaatgtgggaggggctcagacaatgtgggagggggccctccagcaatgtgggaggggccctccagcaatgttggccgggccctggtgtgtcccagcctctagtgaaagagctcttcagggtgtttacctggcactttcttcccacagtgtggccggtttccataatagccactgtgctgcacctggagctgccgttctccttctcctcttccatctgagtctgggctaatgaaccagactctttcttattattcttggattctccagcttcccatcttcactcagtgatgaggctcctgtcagccactctagatgtgcaggcctaggtttggatcctacttgctgacaatcttaaagtttgccatggcaaacaggtaatgctggtgggagctgtaggcaatcccccagagagtcccctggcccagctaggacaccttgtgtacagcagtaggttggatggaacagtcaggctgagcaaagtaacaagctctaatcaactctttgtgttagcccaactcatcaatagatacaagaaaattggaggagtttggccgggcgtggtggctcacacctgtaatcccagcactttgggaggccaaggtgggtgcatcacctgaggtcaggagttcgagaccagcctgaccaacatggcgaaaccccgtctctactaaaaatacaaaaataagatgggcatggtggtgggtgcctgtaatcccagctactctcgggaggctgaggcaggagaatcacttgaacctgggaggcagattgtgccactgcactccagcctgggtgacagagagaaactgtctcaaaaaaaaaaaaaaagaaagttggaggagtttaatttttttttttagtttctataaaaatagcgttgatctgaatgatttttacaagttcagccgctgactttggcctgatcttctgatcacttcattggattgtctttaagtaaatcttgagcatggctgaaacagcaatcgggggcctgcacgttttctgtctagatggtctcacgggggtttcctatctggccaccagctctgtctaatgcagagaatgtgacctattcgcaggacaaggcctaaagatcatcctactcccattgtatgggagacacacacactctgaaagggactcggaggaggagatagatgtgacgcctacctggtggtctaattctgacacttgtcagggaaaagtactttttattgtagcaaagggaaggagaaacaaggacatgactgacctgaaacttaataaagatattgaaatctacatctagaaagagaggaagaaacaggatggagactcatgttgtccaaggtcatgtaataaaagcaagaatctaaattcagcagtgttcttatctgtgagatacgttggaatcttcattcttttggagtggaatgaagaagaatgagatcgtagatagccacagagagcttcttgaaagaacatagggaaatgaatcaaaatttctaaagctggagttattttggcccgatcagtgcaaaaaaactttatttgcttgtctctggcttttcttgaaggcagggcagtactttaaaattgtacagaaagccaggaaaataaaataaatgaatggatgaataaaacctaaacatgtatataactctgtacatatatttgtgtatataatatttttgaatatgtagtttcaaaaaggcaatgtgttcacattgtataaaataaaaaatgtccaaataatacagaattaaaagtaagaggaacaggttgccatgttcaaaatgctttcccatgcttgagcttatttttattttatttaaaattttattttatttaaaattttattttatttatttatttttttctatttcagatttccaaacaagcattttttgtgtgtttttggaggcagggtctttctctgtcacccaggctggagtgcagtgacacaatcttagctcactgtagctttgacctcctgggctcaagtaattctcccacctcagccttctgagtagctgggactacaggcccacacgaccaagcccgactagttaaaaaaaatgtagagctggagtcttgctatgttgcccaggctggtctcaaactcctgggctcaagccatcccccaaccttggcctcccagagtgttgggattataggcctgagtcaccctgcatggccaaaacctaatttctaacattacaaaacacagagctacaaggtgcacacatctgaacaccttgggtgagaggccctttgccatgcaggcaaaccagggacagtgagaggcagatgtgggaggcaaccaaacagctacccaaaaggcccttagcaacccagtcctatagggtgacgagaggaatggaggggccaccttttgcgcccttggccctgagtgctctgaaggtctccagctgtctcgtgaattgtcctagcagctcatttcaggctcttcagacaaatgaggaccctttgaaacttgtttatttgttgaccatgaggcacgacatatgcattcgccagaggtgctctggacaaatcacgatcagggtaggcgagaacaccagagagtggtcagcaaggttgggaggggatcctagatcttgagactgtgcctttcccagttggccatgtatatgaaattcatcaccctgtagggtgtgggggtttcccctgcacacagcattgcagctcctcaggttactgatcttgcttagccagggtgtgtgcagtatatgagggatggcttcacagtgaaccctcagtcaatgacagattgaccctgtgacttgtttatattatgcccctgtgtacacatccattcacaagagataggagccacaagggtgcttggatagcacctgaggacagactagctgcctccgcatcctcaatgtgtctcaactctttggatggcagccatgggcttaacccttctgtgctctgaagggactttgcctctagctatgggtgagtgcaagctgacatttgtctttcattttcccctgtctgtggctgcaacatcaatccccccatgctgagggagtgaggggcactgcactcccactccactggcaaatccttgaagggcctgcatggcccccgaatgtgcccagctgtgtaacagggcaaagcttgctggtgaaggctggtgaggtggggctgtgatcagcacccctgatgcaaactggaggccttggggaggaggtgcaggagagaggactcccactccctccctgcacggagtggaaggccatgaacgaggtaggagcacttggcaggtggcaggagaggcaggaaaaggaaatagaggagagggagctgcatacattagaggtggtcatgcctgctaggagctcacgggcctgtcccacagggctcagccttggcccccaaacctggatgttgactatcttcagtaggaagagaagcacggtccctggagagtacttggaacattaaaagaatctgtctgttgtggagccacttggtagagatacttagaaagcacttgccttctgcatgctaggaacgcttctgggagttggggcaggcgctccagaatgtgggccgagcacccgttcctgcaaagctctgtctatgtgtgccctgagtctttgcccatccagcagccttctgtggtctcctctagggctggggctgtttgtccctctgcaggtgctaatttggccccatgggtcagcagctcctgcagccacagggaagctttttgtttgtttcttctcaagaaatggcttcctgaagaagtagaaagggcgtgcagagttggggtcgtatgggtttttattgccgcttgctcccttcagctctcagaacctctgccccgtgacttgtgtgtaggctccagatggcttgagagaaaggaaagacccagggagggtctgaggacctggaagccggagtcagggcattcagcttgaggccggtgccacctggctgccttgaatgcgtgccagcggagtagggcagggagtgcgaattccagaaaatagaggtaaggccagctttgacataggaccgggtgctgattcctcttagctttttagattcttggctttggccagacctgtctcaggtcaagacacttttcagctttgagaggccagcgttcctctgcatcctgtttggtgtacattgtcatctcactggatgattgtgtgcctcgggcagggctttgccgcaccatcccccgaccctgcaccccacaaaggaaaactgtatgagctccgtcagccctccccctgcactcccctggacttgggagggaagcccagcgctgcccatcttatgccggggaaggtgtgtggcttgggcccaggctcagactggacctcgtgcccgccaagggccggagtcagagcaggccaccagggcccctctgtcttcaagccttcctgctattgacataaagcctagaaagctgaaaaaaagaaagagactattcaggtgtagaaagttggataaataggtagggtcagaaatgggaataagcaagaaccttgaactgtgcttgttgacactatcaggtccagagagatgaggcctctatttttgctttggagagaatcatgtgatggcgaggatgaaggattttggacataggtttttttttttttttgctttcttagctttgtactttggaactgtctatgatggatcagagagatgcttccctctctaaatccctttatacctagaaagctcttggagggaaagggggccagtgagacccttctctgcccccaggcctgaaaagcagctatccccagtagaaagggaacccccaagacagaggcctcctgttctgcttatgtggttcgttttgcttctggtagtgtttatatgttgtgagccaggcttcttggatcaaagtcccgctctgccatggactagttgtgggacttgaacctttctgggacagaaaggttctgctcccagacatctagaaactgggtgtcattattggagtatctgccttctaggctgttagaggtgtcccggagtgcatctactgataggtgggtagaccagaccccggcctgggcaagcactcggtgaccactggctcttgctgttgttgttagtgctgaagcggagttctgtgcagagagttccagtctggcgagtgagtctttgaacatccgggcagtggctgagctctttccatctctctgttcatttgtgtgccccacgtgtgtttagctgagccccctgatgtcaggcattgcactagtcattgaacagagattggatgcgttttgggccatgtcctacatgagctcacagaggggaggaggagaggtaggaacactcgtgggtcattctcatgcagagctctgctgcatcaatgttgaggcaaggagagccaggaaggccaaggctagactgggctggggaggcatcaaggagaagatggtctgtagctcggcctgaagcacaggtgacctgcacccccttccttcagagaggacaaaccgagaacatgataaagggagaagagtgaggtgcaactgctgcgattttgcagaggcattggactaactttgtcaggggtctctcagcaaaggggccagcagccccctaggcctctgctccccatctgtcacatgggatggcatgaagatctgctgattattatttgtggagtgtgtcaggtgtttttccggggctgtctttgagcttagacaactttgtgaccaagatggtgctcttgtgctactgtctgccctgcagggctggcctcgggcacatgcaagcaaggcccctgggggtggagcggcttgggcagcattgccatctgagaggtgggatgttcccattgtgcggtctgggcttctctactggatttcaaagacagggaaaggaaataggaagatgcagatgtagctcaccattgcaggcagggagactgaaatgaacggatccatctcaatgaatgaacacattcgttttgcaaatggctacgctgggatccagagaagtaaaatgattttacccaagtttatgctaaaggttaatggtggagtctaatccactaaaatgtgagtggtgggattggtcagctggggtctgctgactctccacttggggtccgttcctctgaaatgtgctgcctcttgctatccaagcttttgttttcttgattttgcaagcacccacagctctggaagagacctcagcaattctgtaagtagtgctgaccaccttgccctactccgctgtgtcttggacaggcctgtgccaattttgctggcttccacctgagctccagtgggtttggggggctgctctgggcctctaggatgtttagacgtcatccaagaaagagtccttaaaagataccactgtgaataaccaaggtgacaaatcaaacaacccaccctgtcccaaccctcaggctctttaaaccagtggttctcaagtgtgatccccaggccagcagcattaacatcacttggggacttgttagaaatgcacatttctggccaggcacagtggctcatgcttgtaattctggcactttgagaggccagggtgggaggatctcttgaggccagaagtttgagaccagccttggaaacatagtgagacaccatctgtacaaaactaaagaacatttttttaattaggtggtgtggtggctcatgcttatagtcccagttactcaggaagatcctttgagccctggagttcaaggctgcagtgagctgtgattgcaccactgtactctgacctgggtgacagagtgagacctggtctctaaaaataaaaaccaatgcagattcctgggccccatctcatggctgctgactcagaagctccaggggtggagcccagcagtctgcatttttaacaatcctccaggtgattctgatgatgctcactctagcatctctcagagcgagggatagtttttgccttttctgtagcccactccccatcttttccctcccaggagaccatcccacatttcaacttgccatttgggcaaacaccaggaagtagattggagaggaatgaaaaaccagtgaccccatggtaggaaaagctgtttgccttggcaggtttgcctggactcagagccaagattcaatcaatcctagtgatggactttatttaagtgattctcctattcttctttctctccctccagtgcaggatggtggtgagggtggggggctgggggtggaagaggctaagctgcacactgggaaggggaggggccacagttcttctctgatccactctgaggcccaagcccttgctccccaagatgcgtggcttcccagatgaaatcacaccaggcagcactttgctctcagagtggggttttcattttgcaccattagcttaactcagtggggatttaacacaatccaggaaatcaagcagttagcagcaggattctggatggctgacaccgatgctgctggtgtgtatgcattgatgatgctggcgagtgtgtgtgcatgtgtacatgagcttgcgtgtgtgcgttcatatgtgagtactggggagagggctctgcaaagttgcaatctctactctcctgcctggccaccttcctgaggtgtctggggtccagaaaacaggacaacttcaattaaataatttgtcccaaatgagccactcaggagcattttccacatctgctgttttttgttttgttttgtttgttttgctttgttttgtttttggagatgagagaaaaagaaatctgctttggatcttgttcttttagtttagttttttttgttcttgtgtgtaacgtatgtcttgtagtcagcaaatgcatccaagtatgcagcatgtggcttgtggtcaggggagagacgctgagttattgtgacaaagcacaagcccctttctctgctaaacgaattaatgatgccagacattggctcctgctgggaacagtggggtctgttaagctgccattgcaaggccattgtcagtaggacttatctgggccctagtgccgcaaagccagctcgccatggtgcccagaactctgctgagtgttggaaggaggttgtggttgcttgcagccaaatgccgtacccagtgctgttactgaatctcatttgcacaattggacttggggagggtgctttctgcctcagacctcagggttacccaagacatgtgtgatctggggctgggaggcaggaaaccagtgctctgtcttcatggcttagtgaggctttggtatctgagcagacttttccacctggaggctctgtggggtaggaggggtggagcaggcccatgcgactggtgcattggggtgcccgtctgtgggcctttcctgatcaaccaagctgggctaagccactttgtagagtttacagactggtgtggtggctcacatctttgagagcactttgagaggctgaggtgggaggatcacttgagctcaggagttcgagaccaacctgggaaagatgccaagaccctgtttctacacaaaaattaaaaaatcagccaaatgtgatgctgaatgcttgtagtcacagctcctcaggaggctgacactgaaggatcacttgcgcccagaagatcaaggctgcagtgagctgtgatggcgccactgcactccagcctgggcgacaaagtgagaccctgtctcttaaagagtttgccagtctcggatcacgaggtcaggaaatctagaccatcctagctaacgtggtgaaaccccgtctctactaaaaatacaaaaaattagccgggcgtggcggtgtgtgcctgtagtcccagctactcgggaggctgaggcaggagaattgcttgaacccaggaggcagaggttgcagtgagccgagattccgccactgcactccagcctgggcaaaagagcaaaactctgtctaaaaaaaaaaaacaaaaagagtttgccagtctcactgtgactagcttgccctctacttctcttgttatctctttgggaactttaggcccctctgaaaaagaaagcaatttagggaaaaagcaagtctcttaggaatcagagtgtgtggtctggtatctgtctctgggtgatttttttttttttttttttaacagcaccttttggaaaaaatggatccaactgcttgccccgtcatcccagatggctaggcccccattcatcccctctcgctctcctactggaggaactgctgtatgaatcataaagctctgggtagggaagcagggagcaggttccaggcagagctgacaagtgacttcacttttgagcatcggttgaaccagatttaacgtctcttccagttctaagtaaataatttgcattctaacccaattgattttgttatctgaaaaatgatggggattgactaaatcagtggactgcctccctcctcctcctcaaaaaagaaaaaaaaaggaaacaacaaaaagctggttgagaaagcagaattcttaatcaaaacccttaagaagtcctaactatatggccaagttgctccagctgaatggagggtgaagggtctggagatgtgaaatctctgtatttccttcatgatctgacattttgtggttcatttatattttatatacactgacattctttattagactaagttttttaaattttaaatttttgattcaacgtaaatatagtttaaaaagttaaattggaatgaatggtttttaacaaaaactgcatgcagttcccttcccacctctagttcctatgacctagaagtaataattttcaagtattttagtgatttcttcatattcagcaaactggagcaaataaataacatggttataattggatttcttatttttaatatttagatgttctttattgattttctgttattgaagttaaagatttatctctcttgcactgtctttccagtacaggtatatcacatttttggttaatattcagtgtttaatttattataattatgtaaatattatttgcagctgagccatgtagtgtactgcatatttatttcctttcttttacatcattttgtttttcctggagatagtaactgccccattttattaacccagttacttatgttcatattatgaattcagccccaagctttctggcagatatgcatcaggaaatctgcctgagttctctttcctaccattggtctgggctgatggagctttaggcttttttgttagacagggttcttcagagaaacagaaacaacaggagatgggagagggagttaattaggggcattggttcacaggattggagaagtctcacgataggctgtctgcaagctggagaaccagagaagccttggaacaatgcagcccccagtctgaggctgaaagcctgaaagcccccaggaggccactggtgcaagccccaaagtcccagagccgaaaaacatggagtctgatgtgcaagggcaggagaagagaaacagccattattgggaagggagggagagcagaaactccacaagctgaatacctgccttcttctccttgctttattctgactgccctcgcagctgattgggtggtgccagcccacattgaggtctgactcttcctctcccagcccactgactcacatgtcagtctcctctgaaacaccctcttggacacacacacgtttccagccttctcagcatccctcaatccaagctgacacctaaaattaaccatcacagcctgccacacagttgttcgggaaaaaccatcctaagccttccttttcctttcttaggttagacctttggtttcctgaatcccgtgtcttgtttaattctgcatttttttaaataggtaagtgagatgatgtacatgctaattagcttgatttaatcattccttctcttatacaaaacatcacattgtaacccataagtttatacaattattacttttcaatcaaaaataacattaataatgccttttttttttgagacagaggcccaggctggagtgcagtggcatgatctcggctcactgcagcctctgcctcccgagttcaagcaattctcctgcctcagccctcctgagtagatcggcccacaggtgcgcatcactatgcctggctaagtgtttgtatttttagtagagacagagttttgccatgttgcctaggctggtctcgaactcctgagcccaggcaatctgcctacctctgcctcccaaagtgctaggattacaggtgtgagccactgtgcctggctgataatacattttataaattaaaaaaattctgcatttttgtagagcacatcattgagtagtttcctaagaaaagatacatgggagatgatgttttaaaacctgttaatgcctgaagatgttttcattctactcttgcatgctgattgatagcttgcctcagtatcaaatttggcaattttaaaggcattgattcattatcctccagtttccagtgtctgtattgataaatccagtgcaactgggatactgatcctttgtattagatgtctacccttttctcttgaagattttaaaagttctttttgtctttcatatttgtaaatgtcatgattctttgagctgggtgttgtttaacctgaggactcatgttcttcatttctggaaagttttcttgtattatttctttggtattttctgccgtttgttttcttgttctctcttgctataatacccttttctcagatgttgaaactcttggattgattctctttttctttcctctgtttcccatctgtttgtcattttgttcatcttttcatgaaatttcttcaaccttatcttttaaaaaaaatttaaaaaatattcttgaaaaaattttttgagacagtctggctctgtcacctaggctggagtgcagtggtgtaatctcagctcactgcaacctctgcctcctgagttcaagcaattctcctacctcaccctcccaattagcaggaattataggcacatgccaccacacaggctaatttttgtattttcagtagagacggggtttcgccacgttggccaggctggtcgggtcttggactcttggccccaagtgatccacctgccttggcctcccaaagtgctgggattacaggcgtgagccaccgtgcctggcctctttaaccttatcttaaaaccattatttattgattttctgttattgaagttaaagatttatctcttttacactatctttccaatataattacatcacacttttggttaatattgaatgtttaatttattagaattatgtaaatattatttgcagctgagccatgtagtgtactgcatatttatttcctttctttcacatctttttacttgtcttgcattttatatttcttctcttatattttaaatttccaagtaatctttcccagtctctgaacattccttttaatagctttctgttcttgttttaggaatacaaaagtcttatctaatttattatcatttaaaacaattttttttgaggcagggtctcactctgtcacccaggctggagcgcaggggtgcagtcatagctcactgcagcctcaatctccccagactcagctgatcttctcatctcagcttcctgagtagctgggactacaggcatgcaccaccatgcctggctaattttttttttttggtagagatggggtctcactatattgcccaggctggtctctaactcttgggttcaagtgatctgcttgcctcagcctcccaaagtgctgagattacaggtgcgggccaccactcctggccatattatcattttttaaagttttttttttaaaattttattttatgtacagagagctagcatggtttctttcacttggtggatgccttggataatccattcagggaagctcacttagtctaacctaatgaagcctacctcctctgcatactgatggaaacactggcagcacatattgaggccataatgacaagaatgagaaccctggccgaatttttttggatggctccaggagagctgctggtgacccatcttgcttttaggagtgcaacaaggcaaaaagtgaaaagtttttttttttaatactccctgcattgtctctgttatctctgaattccttttcttccttttctgttttgtatgttacagtctctgccattcacatttggaggctttccttaaatacttgccagcccttgactgtccatttgaatttaacagcgagacatgacgttggaagctctttgtgtacatgcagggcctgtgatttgttaggcctcacttgagaattttgcagagggcccatatgtcttttcttttgaactattcttaggttgatgcagaagtaactacggtttttgcagttgaaagtaatggcaaagaccgtgactacttttgcaacagcctaatagtttctttagagaaaaaccactcaatcctctgacacaggcatataaatgtagtgttctaagacccgagtgtctcattcttcactttgcagactttcatgtaaccctttggtgttcacgcagcagcacctgtccggtcctcctctgtgtctagtataccccagcggcaggctgtgtgcaggttcaggccttctttttttcccccttttcttttctttttctttttttttttttgagatggagtcttgctctgtcacccaggctggagtgcagtgtgcgctctcggctcactgcaatctccacctcccgggttcaagcgattctcctacctccagcctcccaagtagctggaactacaggccttctgtatggaatgaagcccatggctactgctggagttggtgagggcagccacctggactcatggcccaggggagtaggtttgagtgtccatatgtaaacttgctgccaatcccaacattgacagcctctgtgatggagttcaggagtgtccgggggccccaatcaggagcatttgtgggacctggagtgcaaatgggcttgttttttactggcatccctgtctgtccctctttttcttcttttctctgcactttactggcatccctatctgcattttagcttttcttctcccttttaagccagattctaccatccatttgctttctgtcatacaaaatgttgatatgttcttttttcctttaccactttcttgcatgtgtttataacttgtttttttgactctaattttaaactgacttcaagaagagtgggaatgattgcacgggctcagtctaatccatgtggctagcgtgcctgcaagtgctccttcgcactcagtccagaagcttggtgatatggcttctctcttcttttcccttcccattggatttttgctctctggaatttgccctcaccactccagatcctggcctcctatgggttggcgtggccccctaatcacccagtgaagtgctctagtttcagactcattcttaagctcttcggcacttagggttgaggggtgtttcctccatttaaatggaccctgtggtcttcattgacactgggctgcctggtttcccagcggggcctcccgtggcatttacagtaactcttcttcctttcacctgacgaaggcgctctctagtatgtccctctttccctctgtactttacccttcattgctactatcatctgccatcagaggagttataagattgattcctaatgcaaccccatgccacctttccccacagacccttcctggattcctacagccattccacaggactggttatgaaatgactggctctgggccaatggttgccttacgttcaaagtcatgggtaggatgtctcgggcttgggagggttggaggcaccactcatagaagcagggagtcaggaggaagagacggctttgaagaatgtgagggtttgggatggtgtgtgatgacttcctcattctcatttcagcttcccaaataaggccaggcttcttgagggaggctaccaaggaagtataatttgtgagcaaaaatggtttgggtgactgcaagtagaatgaaagcttaatggcctactcaaatataatggattattttaagatttcccgagaaagacccaggcaggcccttgttgcagcctcaaattttgagttttcaaagtttctgggtctctgaattcttgctggcagctatgcctaggtgggagtcatgtcctacccttggaggatgttaaaattgttgcttaagaaaaaaaacacataatttttaaaatttttttgtttggttttagattagggtctagctgttacagggagctgagatccagggtccaaggtggtagtttagttttagccctatgctccaggcacagcagggtgcccaatcagggaagcatggagtgagcacagggtggggatagtgctggagataaactttgctgtctcccagaagtacccagcaggggctcctcagatggtcgatccaccaggcctgcagtcggatggtgccctgcactttacagacagagtactgagactcagagaagaacccaggacctgggactgtatccagctgttgccccagctgctaccttctgggcttctgtttgttcaccaccaccatttgcattgcaaattcaggccatgggcaacatcgctggggcccaggccctgtgagcatgatgggatggggtggtggtgatcagttccgggctgctcttgggccagcacctgccctcgccccagcagccccgggatgcatcatggtggggtctgcacacacacccacaaggaaaaatccacccgggacagctcatgatcttttcaacattgttggtagtctgcactcctaaaacaaacccttgaaagatggaaagatgttagtaatttctggccatacgtgccttctttcctgctctccccacctcaaaaaaagaaaggggccaagtggcaagacaagaagtaaagtctaatgtgtaacacattcccatactctgatttctcctccctggctgctcccccacctacgtaaactacattcctttacacggtcatggcaaaggaacattaatttttgatttgaattgtgattgaaagcaacacaatcagaagagtgaaatagtttccaatgaagcaatatcacttctaaccgggtcgtggtgtgtatggcaggaaagagtggttttggggttaggtgtgggttctgatcctgattctgtctcttacaaactgtggcctcatgctgttgttacttaacctgagtccttctccttgattataataaagtactattgatgccttcttaacatggttgctgcgagtattaaacaaggagtcgtagatagacatatcccattctcatctgcagagcccagcatgtggtgggtactaccttacaatggctcacttctctgcagacaagagggcgctcgccttgtcagctggagtatgcattagtttctcccatctctaataaataaaataaattaaaatattaaataataaagctttcacaaatgcagtttctcctttgccagagaagtctctttcaaccaggaggcactcttttgccatttcataagtgaagtcattttgaaatgtaggtgaaactgggaagagggtctgagctcctccctgtgatcttcttggtccatttaatcagtactccaagtttggggtccattctaaagaattttggaaccatagagtcagcatggacaacatgcagattaaaagtgcacatttagacatgggtttcaacttaggattagtgactttaggcaagccaacttaaccccctatgcctcagttttctcatctattagatgggaaaataattatgccttcctcctggagttgttagaattaactgaggaaatgcacggaaaatacttagcacatgttctggcaggtcacatgctttcataattgttagccactgtgatttagttcaggttaaagactttcctcagggtgtgtgggtggaagccttgcatcattaaaaagagggggcttggtaattttctattaaaaagagttcagaagatacgcaaattatctggtgactggcacctagaaagtgatttccaactcctttgggaatatctcgggctgaccagtcttaaaggggagttgattgtacccgcgacactgtgtgttcagtctgcttcgtttatagagcatgtccacgctcatttatcttcatcagcagcccctgtggagtcattgctacaggatgtggctcacaggttaacactgttaattcagtgtccattgggacagagaaaagagaaagcagagttggtgaatgggctgattttcccacactcctgggagttgagaacagaagcagccctggtaccatattggatttgaagagagctcatcacctggatttatcaattaggacttcaccagaacttgctctaatctgccagaaagtcaaagtagatttggattttgtgtaggtcttctcagttggcagaacattagtgctgcctgtcagtggggattagtggttgattagcgattgactgatactagcagtacctgctgtcttaccgccatagagacccagtagtagaaactgatttctcccatgctgtggttggacgttgatgtttaatgcaggaagcatgaccatttgaaacaacctttaactttcccttgctgagtgcacacacatagttctgcctgtcattttataggactcaattttcaaggaattgtaggtctttcaatgttaaaatactaaaccaataacttgctcttcaaaacaaaaccaaacaaaaagaaaccctcatggtcaggcgtggtgactcatgcctgtaatcccaacactttgggaggctgaggagggaggatttcttgagtccaggagttctgggcaacatagtaagatccgtctcttaaaaaaaaaaaaaaatcagccaggcatgatggtgcatgcctgcaatcccaggtacttgggaggctgaggtgggagaattgcttgagcccgggagtttgaggctgcagtgagccgagatcgagacactgcactccagcctgggcaatagagtgagaccctgcctccacaaagacaacaataaaaaacaaaaacactcaggattttttgtctttgaatgatgagatcaatagcatcagatcatgtggagtaaattgggttataggacccttttttctcttaaagcagtgcatgataactggatttttaaaaagagcaatgtgatttagctttgaaatttatttgaggatctcctggcaccgatggccattacagagagataccactggacaccacagaatagggggcggaggcggtggcagaatgggtaactgagaccttgattttttttttttgagatggagtcttgctctgtcgctcaggctggagtgcagtggtgtgatcttggctcactgcaacctccgcctcccaggttcaagcaattctcctgcctcagcctccttagtagctgggattatgggcgcctgccaccatgtgtggctaatttttgtatttttagtagagatggggtttcaccatgctggccaggctggtctcgaactcctgacctcagaggatctacccactttggcctcccaaagtgctgggattaacagaccttggtttttatggataaaactgcctgtttcttgacttgttacttgcctttcattttcttctccacctcagctgtacacttgggttattgttctagatgaaaagctttgttccacagtaaacactggagattccaaaagacatgagggaggatggccgacactgtaattgctgcttgggcgatggggttattagaagcccaaacctcagcatcatgcagtatacccatgaaaccaactctgcacctgtgcccctgaatctaaaattaaaaacatatatatttacaagaagaaagtataagccaaaaaataaaataataaaatgcaatcactttgaggatcaaaaaaagaaaagctgtgttctaaatgctttctcttaccctcttttctcttcttctgtcctctccatctctagcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatg

SEQ ID NO: 36054 - DNA, 47514 bp, Homo sapiens; identical to SEQ ID NO: 36053

SEQ ID NO: 36055 - DNA, 4800 bp, Homo sapiens
ataagctgggtcccgatgccgcgagcggaatctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcgggtccgtgaggggcgtgtggggaagccagtcggcggagcggttgtgttgaatgggagagggggcggggctaagacttgggcatcctttagggaagtgggcgagcgcctgggaataagaggtgttataggggtctgggatggaaacccttaagggcctctggcgtcggcggggcggggcctgatgctagcgtccgctttccagtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtgctcaccctctgggatggtggagacatcaaccagtctgactgtatacccattttgccggctgaaacaggcccagggagggatgggatttacccagccatcagaaagttgagagtggaaggggtcagacctaggccctgctaggccccgccagactccctttcctgtcttttatggagggtcaatggtgttctctgactccacaaggtactatgcctttgatgaggcctttgttcgggaggtgctgggcaagaagctgtccaaaggcaccaagaaagacctggatgacatcagcaccaaaacaggcatcaccctcaagagctgccggagacaggtatgcactgcatccacacggacacagcatcccatctacacttcactccctccctttggccactggcccagttccagcctctgattgtggcagcagcttcatacctagtcttctcctcccttcccctttcccctcctttttttttttttttttcgagatggagtcttgctctgtggcccaagctggagtgcagtggcgcgacctcagctcactgcaacctccgcctcctgggttcaggtaattcttgtgcctcagcctctgcagtagctgagattacaggcgcccgctcccacacccagctaatttttgtattgttagtagagacagggtttcaccatgttggccaggcttgtcttgaactcctggcctcaagtgatcatccgcctcggcctcccaaagtgctgacattacaggcgtgagccaccgtgcctggctccctgttgtgccttccaagctatcctgtactgtatggccagagtgacctttcagaatgacctgaaattttatcagacccctgataaactttcattggctcccactgcctcctgggtagcagctgcactccttggctttgacctatggactgtcctgttatctcatccctgcagacctctctaggcttacatttctccagccccaggctttcctttactcatgttgcttctacctggagggtactgttcttggcaatatctaccccttgaaatccaagacaagaggtgagatgccaccttctccacaagcctttttggtacgccaggaagaagtaacccttctgggtctttgatgcctttcttttgtatctcctgtgagctttctgtttatagcttagcatttgttttttattttttagtttctagggcttagccaggaaagtctcttccaactcaaacttgtgaagatctggagagcatggtgctaaaatggggttggatttagagataagattgagtaaacatttatccaaggcaagatacagcaggagttgctaagcatttgatttgataacaagtactaataactaatagttggttgaaggaataacaaatgctaaatcagcatctgctgactggataggtggatggggaagggagagatgttcaataagtggtttattgggtgagcgacacagtgtacactctgaccagtcctctcttctaccctaactgccctgcagtttgacaactttaaacgggtcttcaaggtggtagaggaaatgcggggctccctggtggacaatattcagcaacacttcctcctctctgaccggttggccaggtgaggagctagccacctccccatcccgcacactacttcctgggcccggaggctcgtccaccttccctaccccaaaccttctgacctcctgagtatgctgggggaatgattatcccacttttggtctgtactttttttttttttttttttttaatgagacggagtttcactcttgttgcccaggctggaatgcaatggtgcaatcttggctcactgcaacctctgcctcctggttcaagcaattctgcctcagcctcccgagtagctgggattacaggcttgagccaccgcacccagcttggtctgtactttggaccagactgacctggattcaaagcacagtccagcgatttccagctgggctgttgagaggtaccatatgtaaagcccatggcacagccctggcacttaggaagtgctcagtagatagtaactgttacccttatggtctcccactgtatccactagtaaacttgagctggaaccttctcttcgcacagatggggaagggtcatagagaagtgacttgagacacgtcacacagtgacttgaggcagagagaggccagaactcggacacccagctgaggttgcaggtgggagctgcttcctaagaaggaatttcaagccctaagaggaccctcctctcgtctgtgcagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccaggtgcctggacgcctccccatcctcaggacctgattccccaccagtagtttctcccacaggccctcagttcctggcatccgctcctgttcatggcccccacccaggctccccctgcccatagaatgttttccccacacacaccttgtctgcagacaaagggcccattgcctctctgtggcctggggcatgtcactccatctctctgacactccatttcctcttttgtccccaggggggaaataaggtggtgggtgaggaaaggcttaggctatcacaggaggggtttttatcacccacccccacccccttcatggcctcacagactcacagatggatgacatggacatggacttagacaaggaatttctccaggacttgaaggagctcaaggtgctagtggctgacaaggaccttctggacctgcacaagaggtgaccttgtaggggcccatggggcggggcctgcagtaggggcccaggtggctataggcgtgaccctgtctctctgcagcctggtgtgcactgctctccggggaaagctgggcgtcttctctgagatggaagccaacttcaaggtctgtggtcccatccagcctctgacccttggcatcttcagcctccagttcgccacccctaccgggcagctctgcccctgccagggattggccggcaggtggcactgctgctccctctggtggccgctgacgggagcagctcataaacaatggggacttggttgatggagggaggtggatggatctggggaggggcctgctcctcctcccccagcttctgtgctcagctgccaacttctggggcagaaagcagagctccaaggatccctgccccacagaacctgtcccgggggctggtgaacgtggccgccaagctgacccacaataaagatgtcagagacctgtttgtggacctcgtggagaaggtgagctgtcgtgctctctgacacccaacctggtctgtccctggcctatacaagtgctaagtattctcttgggcccgcagtttgtggaaccctgccgctccgaccactggccactcagcgacgtgcggttcttcctgaatcagtattcagcgtctgtccactccctcgatggcttccggtgagcagccctgtcctcctgtccagcttggctttgccccagcctgccacctgccaggacctcgcctcctgcagactcaaggttccccattctgctaccctgggggtgggaccaaagtctctggaccaaagctctggctctccctcttagaagctgtgtgatttggggcaggtttcttaacctctccatgcctcagtttcctcatgtacaaactagggttcatcatgagaagaattgtaaggattttctaagggcaaaatgaatgaaggtgtagaaagcacgcagggcagggcctccatcacggtgagtgttgtgaaaactcagctgtcactgttcatgttcttacagacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctccttgggaactgagacatatctcagggaatggtgtctgtgctcagcccatccaccagaagagtctgctcacaagcca

SEQ ID NO: 36056 - DNA, 8009 bp, Homo sapiens
gagcggtgccgcaccggccgcgggcgcagggagtattatgggctgtgggtgccgctgagcaagatggagctgtctgcagtgggcgagcgggtcttcgcggccgaatccatcatcaaacggcggatccgaaaggtgagccgccgcccggggcgggccgccgctgtccgcagccggggccggggccgggggccctcggggcgaagcggtcccgctagcccggctccctcgcccagccccgcgccgccgcctcctcgcgtccccgcatcctccccacccccacccccgtttttctcccctctgtttttcagggacgcatcgagtacctggtgaaatggaaggggtgggcgatcaagtgagtgtcgcggggtccgggggcgtcgcgggaggggaggcagcgggcaccggggcctggggtgggggtgcgcgctcttgctctcgccgcgtgcctgtccctctctggtcttcatcctgattttgtgcgtttgtgactcggcaggtacagcacttgggagcccgaggagaacatcctggactcgcggctcattgcagccttcgaacaaaagtgagttgttggggaagctggcaggggctgcgaggccgaggctcggctggggcgccgcgcggggaagcgggagagccggggagggcagcgcggagtggggcccgggaaggggctctttttaacctctggtgtttttcggccgcagggagagggagcgtgagctgtatgggcccaagaagaggggacccaaacccaaaactttcctcctgaaggtaacctggcccagccccagcagcatccccctctcgggcccccagccccggcacagcacggggcctggaagggagggacagatacgcggccgcccaagcgggccggccttttcagaggggccccagctgggcagggggtggttgtgagcccccccagaagcccctgatggcaggcctcagccagcatcagcttcaacaagagggttttgggactggggataatcctccctgttgaaaccaggggctggggatgcctttagggctccaggaaagggggtggctgaggcaggtgggggatgcccatgggaagggggcatttgtttgagctgttatgactgtgctgggagttggaacccagggggagagtgagtggggtcccacctcctggcagggcacaaggagaggatttgggggaccacctgcctccctgcccccagcttcccccgttcagtctttcaggatttgttcttcatggctcccctcctttcttggggatccaacttgaatttgacctcaaatcattttactttgaatttatcacccaggctgggccactaactttagggctctgagcctcagtttccccccactcccggccatttctgggggatggggatgtgggagtgagagcatagcatattagtctctgctagggagggaagaacttccagaggaagccatcttggaggatttgggtttttattttattttgacaaggaaaaacagagtctgggaaaggaagggcaagatggccctaggtggcaggcacggctgcaggtgggactcagtgggccccctgtcttcctgtagtgctacggatgcctcagggccccctcccacccgacagccggtgactttgtgggaggactctttttcggagaagagaagcagaagtgaaagaaatgttggtttccagaatttcatatttttataacccccaccctcaagcgacgcacatcctaggggatccagggagtaaccttaaccctgatgcttctcttggggagggatgggcggagcagctggaaggctggtgggctgtgtgacagcctctcagtgcagctggggcaccctctagcggcgaagcgagtatgaccatgagcattgatacacagaacgcctttttttcttgatagttcttttggttcctgagctggctgtgggcctaatacagggctgagcccccacatggattatctcctttaattctttcaacagttccaagaagtaaggagtattatccccatttcacagataaaaaatcaaggcccaggaagggaaagtgacttacccgaggtccagcttcctggcttcatcctgtctccttttcttcatcttgtgccttgagtagtccatgtcaggttaaagggggaaggcagacacacacaggaaactatgaaggctgcagagttggcgtggcaggggatagagacacagatagtaggacttttttatctggaccctaagaaacaggtagcctgagagtgatgtggatgtttgtgaggggctatggagattagcttgggctgaacacattgttctggggctccctgagaggcagtatggcagagtcagcaaattacactcagcgctttctgccaggaactactctgaagcaaacaggagcccatgagatagcttccatcctccctgtttcacgcatggggaaacagggccagaggtgtccagtaacttgcccacagacatggggagaggccatggtagagttcaggtgcttaaaccttcacaccatctacggtgcttgccaagcccacagagctatgcctgtcacctggtcagggtgcaataagcatgttggctacagttatttttaattcatcaggcagacccaggtcccactttcaaagagttctccatgtggggaggaagaggaagggtaaaccctttaaaaaataataatatatagaaagtataaagtaagaaatgtcaatgtatgccaagcatacattggaaaaagatcactgcttataagtccaccacccatgggtaggtctgttcagttatttgctgcgtgccaggcactgtgctgagcaggtgccatgtactctctgatcatcataggagtgcccgtagtaggccctgtgatggttcagcagataaggaaaggagactcactgagccagggtttctttccgggcctgccatttgcccacactctgcccctcccccaggaacagtccgtcaccactggactcttggaagcataatttcagaagtcaggaagctcaggcagtttgcagagggagtaaacactttctgagagtcagaaagtgtggggatgcacctgcagaatgtctgcttaccacgccaaaaaagcctgggcttttccctgcctttgtgtgggaaggggtctgaggggcccaatccctgggagctgggctggcagcattggcatgggcaggcccggcttcatgtgctgccacctagtggcggaagggactgttaaccaagcagccccaggaggccccagcctgggctgggaggaccacgtggagtcacagtcccttctcccatgggggtgaacgccacgttctaaatgaagacatccttgcttagccaacaaataagccagcaaacatctctcctgagagttgtgatcaaatggtaatctagtcttgtctgagaggcatatgggctacctccaggtactagttaagcatccaatgctgtggggagtgggaggtagagagacctcacaacagatcccaccctcatggacctcacagaccaaccgtggggacatggccttcttctcggtcccaaccatctcccacctagattgagggcagccatcacctaacaagcctccctgccccagtaggatctctaaaacccacgccccttgtggcaccccacacacaccccagcctctgtccccagcccttgctttcagtcctgtgactcctcgccatcttctcacaccactgggatcttgcccagaggactctctgcctctaccatctgtctgtcttagcaggccaccgcagcctctggaactgtctggggtgcagtcagggctcagtaaggaccaggactttttcctacttaggtgtcagggccgggctttgatgtttcattctccaagcctggggtctgtgcttctctgggctctgtggttctttcgctgcacgaaatcacttcatattcccactgcccaccgtcctccctgtgatagggcagctctccaggggagagtctgtgcgtgtgcagctgtaaccccaagcaactggtgcctggtgcctcagtaccttccttagtaaagaaaggactggccatgcagacagcttacatcgccttaggagtcccttagcctctctccatttagtggcatctgacaacgggtgggttggaccggaacctggggtctcttgagagccctgtggctttaaagagatttcatgcctggaaggacagctggaaggacaggcctgggagcctggggcagtattcctggctgcccacgacctctgcaccatcatcctgccccagaccatcttggcacagagaataggcagtggtcgggcccacttctaggcctgtccccaccaaactcacgtctgaccgggttgggttccagcccaggctttgggatgcattggtaccagttcactctgagccaggcactgggcagacaagtaaatgagacccatccagggaagtatggtggctgaggtgctggccagctgaggagacaggctggagccggaggtcagcctgctcaaaggcgagagagtacggggcattggggacatggtggctcagcaggacttggtgcgggggagcagggaggacccacctcctcctttctgtcaccacgaatgagtccgtggaggagtccccacttgggctggatctgccacagagcaggggtttagcaggggcttctgagcaaacggctgccctcccgacactgtgtcccaattgtcgacactcctccgtgtcagcaagggcagccatggagtggcccagggccctctgtggagctaacagaggtggtgggtgatagaaaaaacacagttttggaattgggcctggacaagggtgtcctgactctgaccttggagtcagaggcaaattgcttcatctctgaacctctgtttccttttctaagtcgaggtcatgaagaccagtgattatcttaaatgatctcgggatcgctggctgagaggctctacttagggctggctggcgtagggacatccaggggaggtcagcgggcagtcctgaggtcccacccacccctccctctgcccgcaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctccgggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaac

SEQ ID NO: 36057 - DNA, 8009 bp, Homo sapiens; identical to SEQ ID NO: 36056

SEQ ID NO: 36058 - DNA, 176200 bp, Homo sapiens
ggaagcggcgggcggggtggagcagccagctgggtccggggagcgccgccgccgcctcgatggggtgagtgcgcggcacggagttgggaggctcccggcgcggggtcccgggctcgtgtccccgcctttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtggagatgagggtagagcgggaagacccggccaagttaggagaagggttcttcccgggtcctccgcgactcgcaggccggctggggcggggcgcggggcaggggccgcggcggagggagcgcgggtgggaatgaatgagcagacccggagatgcaccctggagtctgcgccgggtcccacctgtttcgccccgcgcggcgcctcgctgcccccgcgtcggtgctgctgagcccaatccgcctcccggctgaacttggaggaggtggggagggaggtgcgagcgggagactccgggtggctcccaggacgcggggtccgctattgttcctcctctgactccagggagcccctcggccggcccaagggcgggggcgagacccctctgggcctgcccctgccccctaccttgttttccccgccgcagctcggggagaacggatgctggagttggggcagactcggggccgccgggacttcgggagtaaggaggacgtggagccaccagaaaggcgcccgccatctcccgcgacccctgcctggtggggggtggggggtggggtgtcgtcctcaaccaccttcgctgccttcttgggcaggttggtgtcggtttagtttctgcggtttgcagggttgacatcctaactcctttgagtttcgcatcccccttttgtggagggggctcagagcctggagaagcaacagacggggaattaaggcagatgcagcccagcacagcgtggaggggtccgaagtggcctcacgggggcctgagcatggctgtctttccaggctcctctttatttgccaggagcccagctaagcccaactttactcccagaaatgttgaggggaatctgcggactcgaggcccctcgcctcgggaccagcggcttctcttcgccgcagctcacgcatgatcggggtgggattccgtcttccttccgggagaggagaatgcccagctgcctgggatggggaaacgttgccggatctctggggaatgtggtctcaaggctgcaggggcctggcagagaggaactgtccatcactaggacatagccgaagctcgccttagcgaagagagtctcacctcctcgggctttgcacagagttggagaagaggtcgggaatcacagggaggctggattttggctgctctgtccccagcctgcaggtccctgttcgccctgtggctcggaattttattactgatgtatataatctgataatcttttcttaatgatgcctaacaagtgtgatttttttcccccttgggtttgtaagacagttgattttatgtgaggagattgatccagttcttatattttagccagtgcttgtctaacagagattgggagagctatcccgtgctgggctgttgcacagttttcatctccattcactgagatgcttcagtaatgaatttattgttttatggctttttggagatggtggtggtggtggtgtgattataaccctgctggaaaatcttattactgttatctgaattgaagagacagaaaggatgctgagccccctagggattccgtaggggaatgatgtagtgtcccgcccaccagtagtgaacctgacagtgaaattctctctccagtctgctagttttcaaagcatgttctaggcaggtacacgtactatcacctaggctttaaaagtgaagaagcagatttggaggttaagaacaactgggccttggaattaatagaatgcagtggacaacttttgcctctccttcctccaccccctccctcccttccttctttccttttttttcatcctttaaaaataaaaataagggccaggcatggtgcttatgcctgtaatcccagcactttgggaggccgaggcaggcggatcatgaggtcaggagatcgagaccatcctggccaacacagtgaaaccccgtctctactaaaaatacaaaaaataaaaattagctgggcgtggtggcacgcacttgtaatcccagctacttgagaggctgaggcaggagaatcgcttgaacccgggaggtggaggttgcagtgagctgggattgcgccactgcactccaacctggcgacagagcaagactctgtctcaaataaataaataaataaataagtatgaaatatttctaacatacataaaaacagagtatagtaagccattttgtcttctacttcctaggtttaatagttgctaatattttcatatttgatccatacctctccccccccggaaaaataaactataacttaaatatttgatctattcctactcctttgcctccatcctcaggtaacctctaatgtgaagttagcgcacacagttctcaagcatgtttggaactacactgtatccacaaaaaaatacatgtgagtttgtgtttaacattttacataaatggcataattctacctatgtatagcttgcatttttaacttactatgtttttgagatacatgtgttaatagatctttattcactttagctgttacagagaatcccagtgtatgaaaaaagtatagtatatttactcccttgccaagagtaagttagggtttctggtttttcactgttttttgtttgagctgcggtctcgctctgtcacccaggctggagtgcagtatcgtgatcactgctcactacagcctcaatctcctgggctcaagcagtcctcctgcctcatcctccaaagtggctgggaccacaggcacatgccaccatgcctggctaatttttttcatttttgtagagacagggtcttactatgttgctcaggctggccttgaactctcagcctcaagtgagccttctacctcagccttccacagtgcatgagccactgtgcctggcctagtttttcactgttacactttttctgctgagtgacactctatttccattttcatttttatttttatttctttttactataacagtttgtacaataaacatcctgagatgttttcttgtgcacacatttttctgttacacacttatttagttagttgctgggtaatgaagtttaggtaatattgcatttattattcattcttcaacaaatatttagggtgcttgtatggtcttggctatctgttgactaaaaaagtgaaactgattaaattctaagaagattacatagttggctggattatttttttcttttttctttctttgttttaattaagaaaagtgggactggtgtagtgttgcatgcctgtaatcccagcactttgggaggccaaggcaggaggattgcttgaactcaggagttcaaaactagcctgggaaacatggtaaaacctcatctctacaaaaaatacaaaaattagctgggtgtggtggtgtgcctgtggtcctagctactcaggaggctgaggtgggaggattgcttgagtcctggatgtcaaggctgcagtgagcctagattacaccactgcattgcagcctgggcgacagagtgagaccctgtctcagctcccagcactttgggaggccgaggcaggtggatcacctgaggtcaggagttcgagaccagcctgaccaacatggagaaaccccgtctctactaaaaatacaaaattacccaggcgtggtggcgcatgcctgtaatcccagctactcgggaggctaaggcagatgaatcgcttgaacctgggaggtggaggttgcagtgagccgagatcccaccggccattgtactccagcctgggcaacaagagtgaaactccaactcaaagagagaaagaaaaagaaaaagtggctcttcattgtaaaattgaagcatgagacaaatccatggtgctgtttgggattcttgtgcagaaaccttttctcagctactcactggccgtgtgaccttggattactcacccaacctcctcttcctcatttctttggtaagattaaggggtaggagtaagcatttacaaaggcacattcctgttctaagagtctgtgaaaatgttgctgtgttagtgacgcatttttaccctaatggtaaccactcaggctgaaaggagtttaaggcatttaaacacattggcgtcctcattccttcaaattgctgggcacattcttttttttttttttccctaagttcatgtcagacacatgttacacatgcaatcatcatgctcgtgaattctgcaaaaggatcaccaggcgtcttgcctcagagcctttgcatgtgctcttcccactacctggaaagcacttctcttagacgtctacatggctgtgtcatcccttcaggtgttatgttgagacacctccttccagtccagcctgcaacctcatccctgctttatttacctccaaggcacttaccaccttctagcttgccgtgtataggttgagtattctttattccagaatgcttgggaccagaagtgtttcagattttggatatttttaaaatttttggagtatttgtattacatggttgaacattcctgatccaaaaatttgaagtgctccggtgggtctttcctttggtgtcgtgtaggtgctcaaagagttttggactttggagcatttcagattcagattcagattcctggtttagggatactcaatctataatttatatcagtattctgtactagattatgagctctacaaaggcatggggtttgccactcttgtttactgttgtattcatggtgtctagaacaatgttgacccctagcaggtaaacagatgtttgatgaacaaatggatatgctttttgttgttattttttctctgtggaatttcgcctttaacacttactggatatcctaaatggtgctggtatgtgcaccatatctcatatttacagattccttcagggtaagaaaacttatgtcttctagggaaaccactccttttaaatctatgtgatttatcctataagccacttaatgtcttcagactttttttctcccaacattttgcctaatcctgaatttagaggaaaacataagtaacacggtgcttggaagcacacccatctttccttttgtgataacctggtttccaatgcgatgaatgtggaagatgcataaccagtagatgctgactgtattccacacgacatctgcagtaacaggccagcagccatcccaagcaacatgaagcacactgcatttctttcttttttcttgagatgggatcttgctctgttctggaactcctgggctcaagtgatcctcccacctcagcttctcaaatagttgtgtctacaggcgcgtgccaacacacctgcctagtttttcttttactttttacaaagacaaggtctccttatgttttccaggctggtcttgaactcctgggctcagaaggtcctcctgcttcagcctcttgaagtgctgggattacaggcatgagccactgcccccggtccacactgcgtttctaagaacaaacagtgtattttgttggattgttgcagagtgtacatcatcattgccctgactttgtgcttttatctatgaggatttttttggagggggaggagggatgtatttttcatgatggaaggaaaatgagaaccttaatctgaagatgttggagcaactaatatgtagaaaggtccctagatatactctaagaattgccacatcgtacagtccttaattcatggcacaaaaaacattcactattatagcactaatgcattgtttcagtagaagccaactgaattttttctaccttgcatgatgagtataggagttgacaaaacaaagctaaatatatcagaggcctcttggatgcattttatatggtgatagggaaaaggagtctagattttttttcccagtgaactatattaggtatacgatactgatgatatcctttaaaacattactagaatactgaagtacaccatttacatttcttattgtatcctctgtaataaaatgatattgaaagaaatcagtatattatggatccagatagggttaaactttaagctgaaaatcataaacatagaattatatgattattagtaaaatgttgcacaatttaaacagattttttttttttttttttttttttagacacagagtctcactctgttgcccacgcgggagtgcaatagggtgatctcggctcactgcaacctccgcctctcaagttcaatcaattctcctgcctcagcctcctgagtagctgggactgcaggtacatgccaccatgcccggctgatttttgtatttttagtagagatggggtttcatgttggccatggctggccaggctggtctcgaactcctgacctcaagtgatccacctgccttggcctcccaaagtgctgggattacaggtgtgagccaccatgcccagtttaaagatatttcttccctttgtagttagtcatgagctgaaaagtacaggtggttcaacaaaagataaaaattgttcatcaaatgtcaattttctagctccagccatctacaatgaacaaaaaaattagcctcgtctttgacatcaggcccactgagagatatcagcaaatctaatcagtattttaaaaagtaacttttggccaggcatggtggttcacacctgtaattctagcactttgagaagctgaggcaggaagatcacttaagcccaggagttaagagaccagcttgggaaacatggcgaaactttgtctctaaaaaaatacaaaaattagttgggcatggtggtgcattcctgtagtcccagctactcaggaggctgaggtgggaggatcacctcaacccatgagatcgagggttgcagtgagccaaaatcttaccactacactccagcatgggcaacagagtgagaccctgtctaaaaaaataaataaatacaaataaaaagtaactttactgacttaaccatgtgtttaaaaacaaagcagtaccttcttctgtttaactgaaggaagcatgccttgttcttcaattttatattctatgtgtccagtagagtatctgccacacagtaggagattaacatctctcaactactcctgcctcagaggtcattaagcccctcatggcggtcatcagatatagagttgtcctagtctagaggagaattaaacaataatcaaaaggcagaaatcagcaacaaagtgcgaagtcgaagttcagaagatgtgaaagaaacacttttcctccttatccactctttgcggaagtttgtgcattgtgtcttgattgattcaccagctgggtttttgtgatcagtgtcacctcatctaaccttacttgcgatctaggccagtcccttctgtagtgaatggcattcactggaaattagtcttgccgtataattccatgaccatatgtcacaccggggcaaggggacacctttgggaagttcttcatgatttgctaatccctgcttctaaataagcagaatctagttgtgagaaaaggtggttgtagtccaagaagcttactgtacagtggaaggaaatacatgggctctttttttttctttccttatttatttatttattttcttaaattgacatttaggccaggcacagtggctgctgcctgtaatccaagccctttgagaggctgaggagggcagaccacttgagctcaggagttcaagaccagtctgggcaacatggcacaaaaccccatatctactttaaaaaaaaaaagtatatttatattgcagtgagccaagatcacaccactgcactccagcctgggtgacagcgagacactgtctcaaaaaaaaaaaaaaaaggaaagaaaaaaattgacatttagtgaacaccaaagcttattatcaaggaaccagtttcccttacacttatttattatattaccttttaaagctcaacttaatttttcatatccattttaggtattgttatcgataagatattctgttttcttatgatctagataagttcaatttgcttaattaatttatttattaaattttttatttccatgggttattggggaactgggtgtttggttacatgagtaagttctttagtggtgatttgtgagattttggtgtacccatcacctgagcagtatacgctgcatcctatttgtagtcttttatccctcactcccttcccaccctttcctcctgagtccccaaagtccattttgtcattcttatgcctttgcatcctcatagcttagctcctacttatgggtaggaatgtacgatgtttggctttccattcctgagttacttcacttagaataataatctccaatctcatccaggtcactgtgaatgctattagttcactcctttttatggctaagtagtatccatcatatatatatatatatgtgtatatatatatatatgtgtatatatatatgtatatatatgtgtatatatatgtgtatatatatgtgtatatatatgtgtatatatatgtgtatatatatgtgtatatatatgtgtatatatgtatgtgtatatatatacacatatatatgtgtgtgtatatatatatatacacacatatatatatgtatatatatacacacaccacagtttctttatccactcattgattgatgggtatttgggttggttccacgtttttgcaatcagtttgcttaatttagctgttcttttcaaagagataataactctaaaactaacaagcagcatctacctcttttcactttcactaagtctgtccagttccttttgctggctgaagtgatagacactcagaaaacaggcagtgttaactgatggagaataaaaggccagagaagcctccttttgcactagggcagcacagagtaaagtgttttccatttttttttctttttttttttttttctctaagaggaatccatttgcaaaccagagaaaaccatccagcagtgattcttaaatattcgtgaggcatagatggacacttgcaaatctgatgggggttttggaccattcttccttggagaaactgatgtatgtacaatgatgctataaattcataatttttatcagtctcatgagtttcatggaactccttgccctaaggccatttataaacctccttggaatacccaggttaagaacccacaatgaccacctctcaaagtttgagaatacaattacaagggctctatttttctatcatgtgccgctattccccaccccactgccacccacagttcgaaaacctatcatacatgagtgaaaagtaataattgtgggttttatactctcaatttgaaaactagtcatcggttgctatgtcaaccagtcaacatactattgaccatttttaggatctatttctattggatgtaataaaatgcaatttatatgcaatgaaaaggtggttttgtaatatgactatttcacagagacctgatgaattctaaggatgagtcttaagtttctcaccccaaggagttgggtctgttctgtcttcagcttttggtggcagcagtttcccagttttgctgttaacaggaaggaatggagatgtcccaggccccacctgacaattcttgtagtctcacaggagatgtcctgcgccccacttgacaatactcctaggctcacagtaggtgtcccaggcaacccctgacagtactcctaggctcacagatgtcccggccccccgacagtactcctagtctcacagtaggtgtcccaggcacctcctgacagtacttctaggctcacaggtaggcctttggctgctcagcccagtgggggaaatatccccaactggctcttcactttgcctttttcttcttggccccccagcctgatgtggctgtcttgatggggacctgaagaagacagggccacacttttagttgaggaactgaccctcagctggaagcctgctcttctggaggaaaacatgcttctgtgggaagtattgtgcatgggggaagggactgccacgtcagctgtactcagaactgctaatatcagcattcaccttgggtgacgtcctcaagccatttcagtcaaaaaccaagcaaaaagggctgtggatctgcctgtaacaggctgcctgcctgacctgacagaagctcttcagatgggtcattgtaattgacttgagcaccttctctgccataggcactttgctgctggactgtcctcgaataaggtcagggctggccgtagtcattgtcaggtttcccattaccagtatgtgttgatgggataattgggtattagaagatctctggatgaatgacaagccctgccctcggggacttaagagttttagccaggttagatatggtcgcaatctgccacagtacaaggcgactgttagtggtgggaatggggtggcggtggtgggagggaattcttttcacagatgaggctgaggcctagagaaatggccccttggaaagggacagttaatgagaggcagagatggatgagaccctggtactggctgctcagcactgcacttctacacattatacttttctgtttctctcacaggtcaacagtgaccttgagactcctgtatgtagctaattataattgttatttggaattgatatcatttttctattttgagaaaatgttcacgtttctctttttttctgagacaggatctcgctctgtcccttaggctggagtgcagtggtgcaatcttagctcaccgcagccttgacctcctgggctcaagcagtcctcccaccttagcctccctggagctggcactacaggtgtgtaccaccactcctggtgaatttttgtatttttgtagagacagggtttcatcatgttacccgggctggtctcaaactcctgagctcaagcaatccgcctgctgtggcctcccaaaagtgctgggattacaggtatgagccaccatgccctgcctgagccttttttattattattattttttttgcattggaaaaaaactatttaaaacataggcatagaaattatagccaataacggtatatttaccatccagaatttccttgggctacttttgatttttgaggaaagactcctaagtcttaagtgcagaagacttgtatagacttggacaattcacctcgaagaagagggtaaaaattgggagttccaggggaggccaatggcattgagcagcagcacgaaggtcagaaaaggtgcaggacccaggcccttggctgtgagaaccgtgtaacaaatgtttgtcaggctttgttggtgagctcacagattccatgctgaggctcttaatctgacaagaatgctcaagtaatttgaacatctcctcccatgaaagctgacatattggtgattgatcctttttcaaaaatgaaaggaattacttctgttgccgagacaggagaggcatacacagtggcctcttctcagccacccagaggatgtgggaacttgtgagacaggaggctcatggacaaccggctgcattttctttcttctctaggaaagacagccaagacaggggtggactcacgcgtataatcccagcactttgggaggctgaggcaggtggatcacttgaggtcaggagttcaagacgagcctggccaacatggtgaaaccccatctccactaaaaatacaaaaattagctgggcatgatggcgcacgcctgtgatcccagattctcgagaggctgaggcatgagaattgcttgaactcgggaagcggaggttgcactgagccgagagtacaccattgcactccagcctaggcaacagagcgagactctgtctcaaaaaaaaaaaaaaaaggtgggccccacgaagggttcagtgtcctttatttaacatgttaggaggccatagcaccaggcaaggtgctgagtatttcatctttctgtctccaagcacaggcccacttcagacccagtttctatttatcatgggtgcaagttgattcaaatgctctcacaaccttcttgggtctttgtttaaagaaataaaaaaatttcttagattttctttggagttgatatcatttttctcttttgagaaaaacatttcacattttttatgagcttttttaaattgggaaaaaaaaactatttaaaatatcggcatggaaactgtcatcaatatccatatacttaccatccaagattttcttggagtgtgttttttgaggaaaaactcatgtctgccgctaacttcatgatgtatacagccactcagcaatcttgataaattcctaggtaattaggttcttttttttttcttgagatagagtctcgctctgtccccaggccagagtgcaatggcatcatctcggctcactgcaacctctgcctctcaggtttaagcgattctcctgcttcagcctcctgagtagctgggactacaggcgtgtgccaccacgtccagctaatttttgtattttcagtagagacggggtttcactatgttggccaggatggtcttgatctcctgaactcgtgatcctcccgccttggcctcccaaagtgctgggattacaggcgtgagccaccacacccagccagtaattaggttctttctgtgctatacaacttttcacagtgttgggtgtgctatttgtttccttttgcaactgcttttcttctacagtctctaaaagcctaatgagacaggcacacgatgcactgatttcctccaggtgatacctatctcaagcctgtctcccggccaatctgttgatggctttgttactgtttgtgccttgtttggcaacaggctttctttctgtctcttgtttaaaccaacccctgattatttttaagtgcatagtccctacaacaaagggtatttgattctatgcctctttgaccaaataaattgaaagtaggtgtttatatccactgtggcaaaagaaacaaggagcagctcaccctgtcctggtgataagtgctacaggctcgggtggcaggccgctggctgtgggcgcttttgtgtgtggcttcccgaacagtagcactgtgcacctctgccccattcttgtctcactgggtgatgtttttcaggattccatttgtataatatcagtgtttagattgtcctgaagaattgcagtattttcttttttatagggtagagagagttgtgcaggatggaataatttcttaaggaacagaaatgtcctaatgttagagaagtacataagtatctaaacgttctgcttttccaaattgttgccaagacatggaaacctccatctcagtctgctgtcagcccaggcgaacgtaaaaatagccacttcacttgtctataattctctttatattttctctgttattgactttgtatctttagcaaagctatatggaagaggatttgttgactccgtgaatttaataaagttattccttaagcatatgctctacatgtgagaacaaagaaataaagatgctactccattccagtgaggcaggggtgcgtgaggacacacagccagaaggaatggaatgccttttgcaaattggtccattcgtatttcctagagggacctctatgtgccagcagtaattctgaggactcgttccgtctttgaaggcaactgaattttttctattaagtactaaaaagattggtcagttggccagacttttaaaaattactggtgttgtctcacgtgcagcccagtgtcacgtgttgggcttggaacttgaaccttagtttaatctagcctcctctatttataagctatgcccctttggctaaataaactttctctgctgcaatttcctagtctggaagctgagaataataacagtagaatttaattctgaagtgcttgtgggcattaaatgagatgacattcatttataataaaataatttaaaaaataaaattttgcaaagtaatctttaaggatagctattgtggctgttattatcattgctaatgtcatcatgctctttatcaccctgcctttaaggaactgctgatatattggccaacatgattattcctgccattataatctatagcaataaagagaggttgccccatatgttattgttaacacatctgccttgcatcttctgttcaatttgcaactgtttctctgtattagcattctccctatttacctttctattattatgtcattgtgtaatgtgaacgatgtaaagatgtagttcttttattagtccccagtcttatcttattccagattgcattaacaaggtcctcagtctcaccagagaacttgtgttgcttcaaccgtaatctagacacagagtagtaacgtcttggttaaactgaaaatggtagctcttagcatgaagcaatggtatagttaattccctattgatgtttttggaaaattttcagacatgttttctgaatagtatataacagggtaataattttttgtttttgtttttttggttttcagcctccactacagaaaacttggggctaggataagctaacacagtcttactttgttagatgctgtacagcaagtaaaagctatagcttcttaagaacaataaggaggataaacgtagccccatgggtgcaccttgtcagccctaattgaggatggtcttttggcaccaggtaaagggggtgagaatacaggagagtccctgagtggtaaactagccctttcatagcagacatcgtcttctcggcagcaggataatagttgagtttgcacacactaggagtccatcagcctttgagtgaaataaaattgtgggttaattatcccttctacgtgtggcagagtgaatcttttaaattactactttcattgtttaattattaacctccagtatttgttagacttgttttgtgatcttatgatagtaagtgaatgttaaagctgggagcgtatacattttctgcttaattttacatctgctttgttagtattaataataagatgctatgtgcttgaagggaaaaatcttaatcattactgtctaataaaaatgcaagcaaaccactaatacaggccacataaatcatagtaaattatctagtggccacaataaaaagttttttaaaaatgaaattaattttaataattttatctagtgtatccaaaatattatttccaatatgtaatccatataaaacttactaatgatggagttgacattcttttttactagtgtttgaaatccattgtataaatcccatttacagtgcatctcaatttgcactagtcatatttcaaatgcacagatgccacatgtggctatagtattggacagtactggtctaaataatatgtcttcttataaagacatattattcttataaagaagacatattataggtcctgtaaccccgctccacctgacatctagaatgtcctcaataaatgcatatttgattaagctccttcttacccagttaactaggattttgcccttagctttaagcatttctgtagataattacaatagcttcatcacaaactaattacacatgggataatggacatttgagttttgggtttacaaatccatatctctacttttgtgcaagtgcattaacccatgtggactttttatttaaaaaaaaactgaatgattttgtaggctggggtcctatggtccatatttctgtatcacctgtatacttggcttctagttaagattcagtgcatatgacatgagtaagaaattagaggcttcttttctcataaattgtaagttcttgagtagccttaatgctattaccgtgtaaaactcttgcattagatgcaaggtatgtaggtttgtggatatgtgtggggtgtggggggggagcatattcagtctttactggttaatggaagcattccccatccttcatgttagtgctgtttgctttttatgcctgcacacagaaagtggttgaaaattgaaagtctagggtttcaaatttagttaacaggagtttgtctttatcaggcaggaggatctagctgcctccatagcccaggcatagaacagcctgcagtgttctgtgacagaaaaatatctgaagggcttttctatttgtagtgtggcaaatccaggctggcatggcccctggggagtgatgccttggttaggtggtatctcttccaggtgtcttgtttagaataaattagggtgacagtgtgttttcatatcataccttcaccactattcaaggattaactgctattcatcattaggcattgaggtctactggtccagctgagccccagcaccccttctcaccccataccccagggaaacttccccaccgtctgtccttctcacattgtttctgcctatcctgaaggttttgtttttcctattcctccttagcctgtactcaagggaaacaagcttccttgtttccctcctttgtactccctcagttctgtggagtcaagtcccaggagagcagagaagatagggtccaatgctatttccagaccccaagcaccatttcctcttagacccagctgttacagtggctttttatttcttgagggtttaaaaatcatttaatgctattcacttatagttaattgtgattgttttcattgttggcctggtttctataggagacccaaagagcagtacttactttcagaatggaaatagcccagaagactcacacttgaattgccagcaaggtctccttcagtgactgcactgatgttagaggagggtaatgaatggaggacttatgaggtgaggctgtgtgagggcaatggggcaggacagatccacaagcagtgaatagccaaacaagtgaatgataaacatgccctccttaacctgcagattcaaaggggacattgtaggtcatcctattatatatttcacttctgtagcttcgtgaagtaaatttagctgctgacttcaggaatgggctgagcagaccgaaatgcaacctgcaattgtgctgttgaagatctaggcacctcttttactgtggcatctgagttgggtctctgtcacttgcaacctaagagtactgacaaatactttggtgcccgagggcaagtgtcagagacccaacttgaaatagcttaggctagaaggggcgtgccttgccttatgtgaccccacatcctgtgccaaaagagtgtggctatagcagggcctcagggatccctggaatcagcacccctcaaccccattcccacccctgcctctgtcccctctctcaaaccagctagaactgggtcttgggcagctaccaggctcctggtttcccaattctcacccagagaggaaggtctacctcccctcccccaactctaaaaaccccagagtctctgaatagccctgatgaggagacatttccacctctaggggagtagctattaccagaatgacctggttggagtgggtggggagggtaggagggaaggctgtgccctgttgatcagaccacttatggatccactactggagtaccaggccacagcgttctgctcaaggaaatgggaggcctaccttcatgtgagccagcaccccctctctgttggactgcagacaaaaaaaaaatcctttttttgaatacacagtgtttgagtaatgtccaaatatgatagttgggacagcagaaataatttctggactttccttccactcccttctagggcatcagagttcacagaatctatgtcattaacatatttatatattccttattctgaaaagtattaagacactggatgcctgggtaaggaaagagattcacaagccaagtgacaccactgcgatcattgtaaatgacgtctccaacattccagaatgtgagagtccaagtttccttatttcaaaactgagtcaaagaaccaatgaatatgtagtaagccaacttctggcaattcattctttctaggttaacaacagggattaaatatagccatgaatagaacctgttctcttactcactctaaagatatttttcataaccaattcctttgtatatgggtctcccttttgctttttgaatcggatcttttgttttttttttttttttgaggcagaatctccttccgttgcccaggctggagtacagtggtgcgatctcacctgactgcgacctccgcctcccagattcaagcgattctcctgcttcagcctcccgagtagtagctaggattacaggcatccgctaccatgcctggctaatttttgtattttttagtggagacggggtttcgccatgttgaccaggctggtcttgaactcctgacttcaggtgatccgcccatctcgggcttccaaagtgctgggattacaggcatgagccaccatgctcagacttcattggattttttttttttttttttgagactgagtctcgctttgtcaccaggcctgagtccagtggtgtgatctcagctcactgcaacctccacctcctgggttcaagtgattctcctgcctcagcttcccaagtagctgggactacaggcatgtaccaccacacccagctaatttttgtatttttagtagagatggggtttcaccatgttggccaggatggtctccatctcttgaccttgtgatccacccacccctgcctcccaaagtgctgggattataggcgtgagcctcccgtgcccaggccactggatctttttaagaacaacttcactgagttagaacttactttctgtaaaattcactaattttagtatacaattcaacaacttttagtaaattaacagaattttactgtcatcaccaccatctagttttagaacatttccctcaccccagaaagatcctttatggcatttgcaattacttcctgttagcgttcccagccctggacaaccaccaatctactttttgtctttataaatttaccttttctggatgtgtcttagaaatagaatcctggccaggcgtggtggctcatgcctgtaatcccagcactttgggaggcacaggccggaggaacgtttgaggccagcagtgcaagaccagcctgggcaacacagagactctgtttctacaagaaatacaaaaattagttgggtgtggtgatgcacacctgtagtcccagctactcaggaggctgaggtgggaggatcacttgagcccaggagtttgaggctgcagagagctatgatggtgccactacactccagcctgggcaacagagaaagactctgtctcttaaaaaaaagaaaaaaaaaaaggaatggaatcatataatgtgtggtcttttctgtctgactttcacttaacaaaatgtgtttgagcttcatccatgcttcaccatggatcagcttgctattcctttttattgctgggtagtattccattatatggaattgccacagattatttacctagttgacaaacatttctgttttactttttccacaattacaaatgctacttctataaatattcggtctttgtgtggacatatgttttcatttctctcgtaggtgggaatagcattgctgagtcatgtggtaaatgtacatttaactttgtaagaaattgtcacactgcatttcacaatgactataccattttacattttcaccaataatgtttgaggattggatctctatgtttaaacttgatgggcccttttgggtttcaagataggtgaaacttaaggaatggactttggaggaagatgtgaaggggcttacccatacacggtcacttggggtcagttgctgggcactctgtgaggtggtttttctcttcagaggtgaacacggtggtgtgtttagacggtggtattgtaatgaacatcaaaagataagtaacacagaacaggacaagcattttagagatcatcttaaaaataacctcgatttaagggataattgcatggagtttcttagtcctagagtgatttttatattccagaggtagcttgttttgattaagccatgctttttaaattgaatggagttagggcaggaggtaaccttgggacttttctttggtaggcttattggagcatgtgagtcgtggatttgacagaccagaaagtagtgctgccagaaccacagccaattttgtgtcagtcagtgccgctggctctggctgattcatagactaagatcaatcctggttgatggcaggttttattctcaaaggagaatgatatatttggtttccaagagaaatgtcgtctcctggataaaggcaagttgtgaatataggagatgaatggtctcaaaagagttttactacgtgatcattatgatacagtatctaaatgacatttatggtttaaaaagaatgtgctcatttattttcttggaaaaaaatctgagattttaaagtattttagaaaggattcattgccaagatgacattattgttatgtctttccccccctaactttatctgggcagtcttttaacaaacctgtacctttgttaattcataaaagaaagtttacttgtttattcattcataacgtatctggtttgctgaataaataagatttataagatagtaatcataaagcagctttgttttgtatccccctgtctgaaagttataattgtgaggttagtatattccttgtctctggatgaaatctatgacatttctatttttttttttttttttttttgagacacagtttcactctgtcacgcaggatggagtgcagtggcacgatctcagctcacagcaacctttgtctcctggcttcaagtgattctttgcctcagcctccccagtagctgggattatgggtgcgcaccaccacacccggctcatttttgtatttttagaggagacgaggttttgccatgttggccaggctggtcttgaacttctgcacccgccttgcccttccaaagttctgggattacaggcgtgagccaccacacctggccgtttctttttttttaaaatggggtctcactctgtctcccaggctggagtgtagtgacaatcatagctccctgtagcctcaaactcctgggctcaagtgatcctcttgcctcagcctcccaagtacctgggcctacaggtgctcgccaccatacccagctaatttacttttatttttgtagagatggggatctcactatgttgcccaggctggtctcaggctcaagtgatcttcccatcttggcctcccaaagtgctgggattataggcatgagtcactgcacccagcctctgacttttctgattattcttagatttttaaaaaaagttctgcagtcagtttcaactgctaaatactcttaattcagaatttagagtcctcaatgttggtgaaaaagtaatcgtggtttttgttattttaatggcaaaaactgcaattacttttgcaccaatctaataacaataaaaagttgtaatttgatttaaagttaaatagctgtcccttttctctttgtccctacttcaccctgctacccggcctcctgcatcttcctatcacagtttgaaatccctctagggatcgctgtatggtaaaactgggggtagggcagaggaagataagaagttagagggataaaaaattttgttttgttttgtttttttttttgagacacagtctcactctgtcaccctgcctggagtgcagtggcacgatcttggctcaccgcaacctccacttcccaggtttaagcaatcctcatgcctcagcctcccgagtagctggaattacaggtgcctgccaccacatccagctgaaaattcttatttgactggtactacagcatgatagtgccatgttctgagtttgacagatgtttgttttacttttaattgtgggttatttctgggaatgttacggactgaattgtgcccctccaccccatttctaagtcctaacccccagtttctcagaatgtacctgtatttggagataggacctttgtaggggtaattaaggtaaaataaggtcatatgggtggactctaatccagtatgactggtgtcctcataagatgaagcaattaggatgcagacacacacagaagaccatatgaaaacacagggcgaaggcgtccatctacaggccacgaagaaaggcctcagaaggaaaccaaccctgttgacaccttgatcttgggctttattttgtgttgtttaaactacccagtctgtggtactttgctgtggcagccctggcacaccagcagaggggccccttggagatctccctcttctcactccattcctggaccatcactgcagacccctcttctgcagttcccttgttgaatgtcatgtgattgcctccagtttgttgcttctccaccagggaatccgcttccctctgccctctttgtccttccaatctaccctattacacagaatctaacaccacttatttccctctattgtgagttgcctactcatgctccataggaaacacatattaatgcacaaataaactccagcactcaggctgataacaacacaacagcaagctctccttcatttccatccttgaagcataggccagtttctctccattttagatttttcaggtgtggatcagacacccgtccaacctcttcagccctgtaagcctctcatgaggttgagtaggtgtggtaggaatcattgcatagctctctctaaaggaagaccctcccacaatccacacacattctgacccttttagacctggatgtgagtaagagccctgttaccagttttcagctgaatcctttgaaaatttgcaccatgggctaaaatgactgtggtatgtctgtgtttccagcgtaaccgtagtgctcattcattcattcatcattgattcattcaggcagtgcaaagtttcactaagtgttgactatgaagagagccttgctgaggccagaggtgaaaccctgaccctgctaggatggtcgttttctgtcttgaggagctccctgactagaaggggagtaaggtctcacatgaaataacacagcagccctgttgatttgtggggggaatccctggcttgcccatagttctagaatcaggctgagaaaatctctgtcctaagaatttgcctccagggtactagctgatgatccttgctctcctctgaccctaacgttgcattattgaaaatggtcagcatcttcaggtaggcttagcacgtgactggggggatgctgcacaaggacagcagtaatgagaaggaagggggcaggtgggaaggaaaaaggaggggcatcctggtaagatttcacaggccaaatgagctgggtttttaaaaaccttagtgcttttctcttgtacatggtgaaacccaattactatgttgcgtttgtacaaatatcccaatgacgctaacccgtgtcagagagctcaccctcctcagtacacctgggatccacgagagccttgctgaggtcagagatgaggtctaaagtctatccaagcactttatcctatatctttgttctgcgtgttcacctgtaaaacatttattgattatatgccaatggccagggctcaagttcaggcaaaatgaaaatactctattccaaagtaagtaggtagtctgagatgtaaattttcaaatcggcttaaaactgataacacggttcttgaatctctcactcacacccagggtccaaaggagtcagactgggggagggtctttctttgcagagaactatgaagtgattcctaccacccctactgtcttagtccattttctgttgctataacagagtaccagagactgggtaatttacagagaaaagaagcttattgggttcatagttctggagtttgggaagcccaaggacatggtgctggtccctagcaagggacatctggtggcataatgtggatgcgaaagagaccacaagagcaagcctagctcacttttataataacgggctctggcaagaactaattcactcccgtaataaagcatgaatccattcagaagggtagaaccctcatgacccaatcattcttaaagtcttcatcccttaatactattacattggcaattaagtttccagcacatgaacttctggaggacacattcacaccatagcttacgggaccacttggggagattgaacaggtgtcagacccttacctggaaagtctaagaaaggagtcccctatcttgtgagagagatggacaaaatgccctttcctccttcacctgtccaaatcccgtgtttcctttaagttcagttagaaccctgctcccatttaggaagacttctctgatctttttctagcacttcaagattctcactctttgaatttctacagtatttaacacctacttataagatgattttttaattattctttattcatatcctcagttagtttggagtcctctgggcctactcatataagctgagtgtttgtatgtatttaaaattctgtctttctagaacagtacaaatctgctgtaaagtaaattgggcaagagggaacagtacccgttgggccctgcttcccatttttatgttcttccagaagcagcaacataactcacagcatagcccttgtctgagaggcagagattgaagcagcttccacccactgggaggagtttggatggcgtgaggtactgtgttgttaaggtaccttcattaggaaggttggtctggagagacctttgacagaatgtatttgttttgctggattgagagaattgaatgtttatatagctttggttaaaattccatttttgttgcagagagattattgtctgaagaaatactcaagcacttgagtgagaagaggtagatgctgacaaggagagaaggagtgtattttagtttcttatgcttgttcagaacttggtctgtggtatggattttaagtctgatgtcctttttaacttggaagaaaatgtcctgaagtctatttaggggcacatgttagttagtgttctggtttggctgagaattctgtagatgtattcctatattccgtgatggaatattattattatttttttcgagatagagtctcactctttcatccaggctgaagtgcagtagcatgatcatggctcactgtagccttgaactcccaggctcaagtgacccttccacctcaacctcctgagtagctaggactacgggcatgtgccaccacccccggctaattaaaaaaatttttttttgtagagactgggtctcgctctggtgcccaggctggtcttgaatgcttggtctcaagcagtctttccacctcagcctcccaaaatgttgggattacagatgtgagttgctgtgcccgccctgctgcatttcttttttcatcagtctagaggtttctaacctggaattttctttctttcttttttttttttttttgagatggagtttcgctcttgttgcccaggctggagtgcagtggcacgatcttggctcaccgcaacctctgcctcctgggcccaagcgattctcctgcctcagcctcggcagtatctgggattacaggcatgcgccaccacgcccggctaattttgtatttttggtagagacagggtttcaccatgttggtcaggctggtcttgaacttccgacctcaaatgatccacccgcctcggcctcccaaagtgctgggattatgggcatgagccaccgtacctggctaacctggaattttcttaatcctaaagagtggagaatgtaatagagattattaagcttttaaaaaaaaaacagctttgttgagatatcattcatataccattcacttcacctcctgaaagtgtacaaatgaatggtttttagtatgttcacaggttgtgcagccattacagcagtaaatcttagaacattttcattacacccaaaagaaaaccccatatccattgtaagggtttttttttttaaatactcaaagaagtttaacttttttgtttgtgataaagctgtacaggctaatatcaaggttttaaaattcaggctaggattgggagttaaattatttttttaaagggaaaatgaactgataataaacaatgttacatccagtctttcaaatgagatggaaacaagcatgtacatctctgctttgctccatcctcatttatcaacgtaacatccattctgtgatgagtggtggccagtgatgattggtggccagtgatggatgccatatttcagggacttattttgaattaaatgggtaataaactgactaatatttctgctcagtgggtaggtgtgctttattctgtttgaaatgggagaacttagttcagagaactttttccatagatgcatgatcctttttggtacatactcgaattaggctgttgtgcagctaattcagctttgctgtatttcttttgaagtaagcatcctgatttaatggcttttccaaggactgcctttagtgtggccttgctaacctgatagatgtcactttactcaacataggttgtagctcagcctgggctttagaagtttgggattgaaaatgagactgtaagatcccagttggcccaaggaaggcgagtccgtttactcatgattcatcttgaggaagaagagatgctgagacagctggcacctggcgttattccaggggccacattactttccgccagccatggcttccaggtgttagatcctttcatgaataccaggaaagcagtgatctattaataactttaccccagctacagttcatgcttctagagttaccattgtgtggatttccagaacttcttttcctttgacacttatctttatcattgtggaattatgcccatgggccacccagctctcacacacccaaagccacggactctaggaagacactcagtttggcggttaatcccttcccttgggaacttttggaattatcactttatttatctaatcctcttcaaataagagtttgtatacttttcactgcatgcttaaaaaaaaaaaagaaaagccaaagacaaatacacagaaaaactaacacaacacccacgaaacccccatgacctcaaacaaaaatcttacccactgttgcctaagactttgtgctctctgaatatgtgaacgaaggaatgctttgagtggctctgctgtggggaactgcacagttttgggttatccaatatatggccttcttttctccctttcctgctggactgatttgtcctgtttccttagttattagtacttccacaagaagggggaaggaattaaatttgaagggcgattcccacctttttttttttttgagatggagtctcactctgtcgcccagggtggagtgcagtggcgcgatatcggctcactgcaagctccgcctcccgggttcacgccattctcctgccttagcctcccgagtggctgggactacaggcgcccgccatcacgcccggctaattttttgtatttttagcagagacggggtttcaccgtgttagccaggatgatctcgatttcctgaccttgtgttccgccggcctcggcctcccaaagtgctgggattacaggcgtgagccaccgtgcccggccggcgatttccactttctagcaacagttggcgtagaaaccctggcccagccagcgacagttagccagcgacagttggggaatatctgtttatcgttatttctactttgattcctcaaaaggtgattctgttttgacgtgaaaaaaacaacccaactttggtttatgaaccagcccaactctgacaagtgtgttcctgttccgcctacatcagttctaggttctctaacttcagtgtgcagaagattcaaccaaggaagttcctgggctctaccccttgagattcagttttaataggacaggggctaaaagattgcatttagtccccaggtccttctgatgtggattaactaggggctgactttgagaaacactgccctggaatgtgcacttgctattcaggtaccagcccagccttttctgtgactaaatgcttggcagttaacaatgtataattatggtgtgtgtcgtttccaaggcaacatgcatctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaagtcagttttgtttagaataattaggatgtgggggaatgtgagaggacctggcaaggcttctgaaaacagtggttaactgtggtaaacgtgtgcctgctattcctcagttctcctctgggatggtgctgttaaaggtcacctgttctcacttgcagtgggcttgacgtgacatttatttagcacttactatgtgatggaaactttcacatagattatcttgcctttttgacctaagtgtattttcatttttttttagctacatgcgaagttttcacatcttgtacatttccaaatttaatgaaaaaggtagagtctgtacatgtttgctgggcacagtggctcatgcctgtaatcccagcttttagggagggagaggccagaggatagcttgagcccaggaattcgtgacctgcctgggcaatatagtgagaccccattcgccacaaaaaaggaaaaaaaaaaaagataaagtctatacatgttttagcacaggatttggctttttggttttagttgtaaaactgtatagggcattgctggatggaactggaggccgttattccaagtgaagtaactcaggaatggaaaaccaaataccgtatgttctcacttgtaagtgggagctaagttataaggatgcaaaaacatacagagtgatacaatggactgtcaggactaggttgggagagaggtgagggataaaagacaacatattggttgcattaaaatctcagaattcattgctaagaaattcatgtatcaaaaaactacctataccccccaaactattgaaattaaaaaaaaaaaaactatatagggcagtgaaaacattcagccactagtcaggccttagggtctggttctgaatctcatcatgaataggctttgtgactcaggcaagtttctaaacttgtctgaggctctgttgctacttctgtgaaatgaggcacttagactagatgagcaatcttgacttttgaagggtggcaactaccttgtagaatccagtgaaaactcagaaccttcctccctgaaaaatgtaaatgtatacttgctaaaagataattacattccatttccaggggaccacagacccatgttaaatgaagtgattgcttaagattcagctcaactcagaattgctgagtcccacaagaccctgagagtcttgcattgtttagagaggccccctgaggaatgagctatttgatgagggaggttttgttgttcctggcatttttcactaactgccctgtgcattctggggaggggagacgggaacaaacactgagaaaaataaatagggaatgagtggcatctggaatatgaactgttttcctcatcacttttcacaaggaggtggatggcatgattgcagcacagaagatatgttgaggaatgacttgaacatagagatacagcattttgtacagtgacagttaagcagtaacttagacttgctctacttttaatgtttgagaactcactgatatagaaatctaagaaggtccagttcagagaagcagagaacagaatggaagttaccaggagcaggggtggggatgtgggagtggggggttgggggaggtggatggggagatgttggtcaaaggatgcagcgtttcagttaagaggaatagatgaagagatctattgtacaacatggtaattatagttagtgtattgtatacttgaaaaattcctgagagtagatttagagtgttctcatcacagtgaaataataagtatgtgaggcaatgcatatgttaattagctcaatttagccattctacaatatatgcatatttcaaaagtcatgttttacaccataaaagtatatacaatttttatttgtcaattaaaataaatattaataagaaggaaaaaattaaggttttggttaatttgaaaatgtcagaagcttctaggaagtatatcgtaagtggaaatatgttatttaccactcctcagctgttaactgaccaccttcccaacgcaaccctgctctgtctccttcccatgacccaagttgtaatccaatcaggagagaataccttatttggaaacctacatatgtcctttttttctctgcttaggtgttgaaaagtctcctctagagctttggaaggctgaatgcactaaacatgaagagcttgaaagcgaagttcaggaagagtgacgtgagtatgcggtgactcacagtctggctgttccttcttctccatggagctgcagaaacgctcctccccaccttgataaggcgctgttgggttaataaactacagacactcaagtgctcttggccccagctcagggtagcttctgtagatggcatgctctaggttccttgctgtttgtgtgcatagctttcaaaaacaatgtttttttatttttatttttaattttggggatctgtgccttgtagagaaaggaaccgtcacattaaacatcttcaaaggaagaatcagtaaaaacctcaacatttctaaagttgccagaaatcctgattcagaatgtcgtttttagaagaagctagtctctctcatgcgggtggtttaggaatgacatattagcatggttcatctttggctttaggaaacgtgttcaactctctgttaagggttttgtggtaaaatggtatctactgctgcccgtacctttcctccccccgaattccagggactcgtactcatttgttatctaaccaatccataaaagactctggattggaggaagcagttatgatgtcagagttatgaaataaagtctcccccaggagaagagggagaaaaacatagcagaggggttgtacacgataatatttttttaaaaggtcaccccataaacccttctatgatcccagtcttgtattagctgcattccagatactttgagcagagttgtggagtgggagaaattaatggaagggaattagatggaagccaaggtatgtcactctcaaaatgggcttgttcagctatcatttcaggcgaggtaattaaagatgaacctggattttattgctttgccgtgaattatattttgacagcttggcacagctgcatttttgcaataaatggaggctgtgtcttttatggctgatatgtaacttgcatacctacttctggctgaagcttatctcctgaggctgcatcatgacatgtaacttactgccctgataaaacccaggctagatgagatgcttatgggatgatggtaaaataccgacccacttaaagaaagaactgggaagcgttatgaaaaaagttgatcttaccttcttatcctttaggtaaattaaataaaactcatagagtgcaaagagacttcgacaaagacagaaaactagctgttggccagagtgaaagtcctggtcatccgacttccgagaaacctccttcaacctcatcgtctgctggctgtatgttatgcagcctacatatctcccgtggctttcagctaaggagaaaaaggcaattaaatggaaaatgttgcccaattcagcagataggggtttctaaattttgtgaccaggttaacaaatgtctttttctattccaagggaatctaggtagctttcatttacataggttaagattatttttagcaaaatttcatcagtctagacttccatatatatatgaacaggggcccagaggaatgataggcacataaacttttggtttaaaaatcaaaaactggtggcagtagggagggtgttgctggaatctagttagaaaaactgaaatatttccatgatttaaaaaaatccactgtaataacactagtaaaagctctgggatttggcagcagaaaaggctatgattttggcagttagtgctaagagaagaaatgttgagaagcagacctgggggaggagagcctggggaggaggaaattggtataatggagcccaacaatttcaaatggctctccacatccaaattgtttccccaagcacagaaccgtacagctaaatggagggaataaaaaatgacaacaacaacaaaaacatttcaaagcctagtttgttaatcaaccatatgataataatgctaataataattaaccattaggaagtattaaccaaatgtccagaggtatactaagcttttcatgtgaaattcatttaatcttgccacaaatcttatgtggtgggtattactattaagctcattttacagacgaagaaactaaggccttagggacatgcagtcatttgtctgggttcttagaactttacgttctagaaccagtttttgcactaaggcagtctgattcaagagcccatgtttcctgaaagaggaattttgggtggaaagtctattttaagaaactaggcaatctgctggcacggtggctcactcctgtaatcccagcacattgggaggctgaggcaggaggattccttgagtccaggagttcaagagcagcctgggcaaacatggtaaaaccccatctccacaaaacaattaaaaaattagccgcctatggtggggcacacctatggttccagctactcgggaggctgaggtgggaggaaggcttgagcccaagaggtcaaggctacagtgaattgtgttcacgccactgcactccagtctgggtaacagagcaaggccctgtctcaaaaaacaaaaacaaactgaacaatctagggagtagctttaaaagcgacttaaactcggacctaggtttgtggctctggacaagtctcttactcttctgaacctcagattcctcactagaaaagtggaggaaatgatattagccccgtaagactggggtgacagttaaatgcattaaatgaatgttggccgggtgtggtgactcacacctgtaatcccagctacttgggaggctgaggcagaaggatcacctgaggttgagagtttgagaccaccctggccaacatggagaaaccccgtctgtactaaaaatacaaaattagccgggtgtggtggtgcatgcctgtaatcccagctacttgggaggctgaggcaggagaatagcttgaacccagaaggcggaggttgtggtgagcaagagatcacgccattgcactccagcctgggcaacaagagtgaaactccatctcaaaacaaaacaaaacaaaaaaacaaacaaaaaaagaatgtcaaaaatcttatggcctggtgctcaggagatgcttagtaaatatttgtttcttcctcctaattagcaacccgtaataaaaagtaggattcaaaaagtttacacggtctggagggtagaatactctggtaacagttgctgctgccgaacagggaaactgagagctggggaagagaggcttgtttttcaatgtatgcctttgattttgaagtttttgatacacgtacatgtgtatcatgcatatatatgtattgttaaggaaaagcaagcttacaaacatttacattcagttgaatgaagcaaattataatttttttttaacctgaaatgtgtggtctgtctcaaaatattttaaaccattgggcatcatattcctgcttgtctttgtgtgagggaaaaggaagaagaaaggattctttgtatttctggggggtaggaagaagataatagcagatcaggttctcgcgcttgcataaagaagacaggtgacccactggtgtgatcgcatttcagccagcctgtgtctgggaggtctgtggccaaattggtttgtggccactgtgagcaacacccaggagtaaacataggatgaaagtggcccaagggggcctcctatggatggccttcaggtcactctgtgacccgagaaccatcacttgggtaaagattgaatgggagtgtcgtttccggaagacttgacaactggcactgtgtcaaaggcagatgtgagtttggtagggaatgagcctgactctgcgggctgtggttagacagtgacattgtccggtggttttgattcttaaatctatttgggaccctgcagataacccacagagaataaacagcattatggaatttctatggtggataaccttttttacttcgcatttataactttattttgggagttcttaaacttgagttgttagatagtagataggatacaggagaaatgcaaatatggttgttgtctttaaaaggttgataaacctcggtgggaggagaaaaaaacatataggaaataactagagcaaaatacaagcagtatagaatatagatactcaaggtatctttaagatgatatagctaactagttgttaagttataaggcctggtgataaatgctgcagattttgagatggctgaatcactgggaatgggagaatttggggagctttatggaggtggagcttcatgcaggccttgagggataggtaggagttggaaggatggttgggaagagggggaaaggtcagaaggtcaatcaggggagacagcttgcagcacagcgggttaactcagtctcaaaaatggcccttgacatagaaaatagtaatattaatagttcaggagcccaggagagtacctgtggcatggccctgagtatttaaagaagaatactatataaagttttcatcctagttttaaaaatggatagattgacttttatgcttattaagcgagcgcagagttctcagtcatcattatttgtatcttttatgaccatagcttgaaaaagtggcttctttacctctttaaatatttgcagcagctagtatgtggttccacatggaaaaatgagctgtcgtcatgaaaaatgaggccaaaaaggctgggatttccctttgctaataaaatgctcaggcttctggaatttctttgtagatgccaatttttagtgacttgagtgaaatgggtggaggttgagggatgggaaatggggttgaaagatctttgtaacacatcttgagaaatgccactcaaacgtgatcgagggcttcacggtttactttgagggtgtgtgcttaattttacgaaagatttattcccaattatatatttcattgtaatagggaagtagcggacattccattaaaaaaatcaaaacagccagtttaaagtgacagtctccatgagagattaaattgatggtatacctttacatagcatctactaactactgtagctttcagccaaggaaatgcacacaccccatgaatcttaaagaaccaggcatatcctgctcagacagaggtttgagtttcttgcctattaagataacagttggcggtggggtgtggtggctcacacctgtaatcctagcactttgggaggccaaggtgggtggatcacctgatgtcaggagttcgagaccagcctggccaacatggcaaaaccccatctctactaaaaatacaaaaattagccaggcatggtggtgcatgctcgtaatcccagctactcgggaggctgaggcaggagaatcgcttgaacccagggggtggaggttgcagtgagctgagatcacaccacttcacttcagcctgggcgacagagcgaaactccgtctgttaaaaaaaaaataataataaaagataacagctctcatgaggatcaacaaccaactctaccaacgtatttttttcaaggagtttttagtcatttataataagtttttacaattgctcactcctcctttcgtcaccacacatacatgcacatacacacaatgggagtatttaaaatccaagtctctggcgtgaacctgggaagcggagcttgcagtgagccgagatcacgccactgcactccagcctgggcgatagagcgagactccatctcaaaaaatataaaataaaataaaatccaagtctctctgtagacataggaactatggccaaatctattttaagctaagccttttttttttttaatagacataattttaaaaaaatcagcaatgaccccactgggtggaggtaggagactttactaaagttctagagagaaatttggtcaaatttgtgccgtgctacgtgttttctaggtcttttcagcctgatttaaatggagaatctgctcactgcctgattttgcctggtattagtttgctaggactgccataacaaagggtaccacaaaccaggtggctgaaactaaagaaatgtattgtctcagagtttgggaggctagaagcccaagatccaggtactggcacggttggttccttgtgagggctgcgagggcgaatctgttccatgctctgacctagattctggtggttggctggcagtgtttttggcttgcagaagccttgccccgatctctgctttcatcttcaggtggcattctccctctgtgcatgtgtctgtgcccagattcctcctttacataaagacgccactcatactggattagggctcgctataatgacctcattttagcttgattacctctgtgaaaaccctatctccaaataaggtcaccttctgaggttagggggagaattaggactccaacgtatgaatttttgggaggacacaagtcaacccttaacacaactccatgcccttccatcctagaacagttacactgaagccctggcatccccccactgagctggcactgtcatagaccttagctccactgttcatccttgggactgttttcagcatctaagagagtgaggctggagcatcacagtttttcagtgggtgccactgcataatattaatagcaagagtgaacacgtatggatggctgaccttctattacaggaataaggagttctcatgtactgaatgctcactaggtgccaggcactgtgccaagcccctttgcatgctctttgtcatttaatgcttacaaaactctatccagtaaagaccattgctacaatgcatttgatagaggaagaaatgaatgttgaggacaggtaagtaacttggccaaagtcgcacatttggtaaataacagagagatggtaactctcctggtttttctggatgggagagtgtcgcatgctgtcaaccgcagcacacgcttgctaacaggttgctggttcctaaattgtgaagcttcaaactgcataaaatagatgttacactgttgctctaagcttaaataagacctccacagtgattttacatcaccacaagtccatccatagtggcaaagctcaccaatgtcagcattattcctcctgtgacagggcaagattctttgtttcctgagagccaaatgcatttcatttctgaagggaggaagaacagatgctgcttctgctcttccagtggtgccagtaaaacatctctgtctacgtggagctccactgtgggctaaatgggtcatagctttattctatttaccccagaccataattctcagttaaacacaatacttttccagctagaaaccaatatgaaaccgagggcctggcccttaaacttggggaaatctcctagtctacacaagcaatgagtcatttagaccattatctcttacatctttattctgcattaattacctgatcattttaaatgaaggctgttgttgtcctacatgtttttagtttgacaaattcttctatgaacttctccttgggactgaaacagaaattgcttctgaatcagcctgtggatattttcagttgagtttctacttaaagatctttgctgtgtggaggtggttattttcaactatatggcaatacaggggccagcgttggccaaaggctcagtatgtccataaagatgaggttagtgactagacttggctttctttttgtttgagtccctccctccttttaaaaaaggaaagtcagtgtgtcctggtcaacttgattattcaactattagagtagtttttattgtattcatgaaaatgctttcactttttgggaagcactgcctgaaaggatttcatttttattttcttaggaggctgaatgatctgatggtctctagctggctcctgcctcctgggctgcccagtaggctggttagctggaaagtgtagaggtttataacgtaagaatagaacaagaaaaagtttaaggaatcacatattctccttggatatgtttgttctaagatgtatttcccaatgctgagaatgtttctgtagcaacttttcagatttaggctatggttttggaaggggttttgatgagattcaatgtgaactcatgagtcttttcattttgtctgggtgtgtgtatgtgtgtgtgacagagtctcgctctgtcacccaggctggagtgcaatggtgtgatctcagctcactgcagcctctgcctctggagttcaagtgattctcttgcctcagccttctgagtagctgtgatcacaggcgtgtgccaccatacccggctgattttttgtatttttagtagagagagggtttcgccatgttgcccaggctggtcctgaactcctgacctcaggtgatttgcctgccttggcctcccaaattgctggaattataggtgtgagccaccgtgcctggcctgttcattctttgaagggttgcttcataactgagaagctgcagggtccttctgtgaggtcccaatgggtgtactaattaggtatatgataagctgtaataacaaaataccctatacagtagttctaacaaggtagaagttgttttcttctgaagtaaatgtttaaaatagtctaagagccagtggggcagctctgctccatagattaacccaggaaccccagcctttctctggcgtcctctgttaccctctagagctgctctgtgcagtgtgctagccactgcccacatgtggctcttgagcatttgaaatgtgctagtccaaactgaggtgtatactgtaggtgtaaaatacacactaaatttcaaagacattgtaccaaagaaagactgtgaaatatcataataattttttataattacacactgacatgctactattcaggacataattggattaaatgaatagaataaaatttatttcacctgtttctatttacttttttaatgtggctactagaaactttaaaatcacataagtctttggacagtgctgctctaagaaccagaaagaaggaaagtgaaagtaaagcagaagcactttccttttttttttttttttttctgtgacagtgtctttcttagtgtcttcctttgtggtccagtctggagtacagtggtgttatcatagctcactacagcctcaaactcttgggctcaagcaatcctcttgccctggcctcccaaatagctaggactacaggcacataacaccatgcctggttaattttcatattttttgtatagagacagtgtctcactatgtttcccaggctggttttgaactcctgacctcaagcaatactcctgccttggcatcccaaagttctaggattacgggagtgagccaccacacccatctagcattttatttattttttattattttttatttttttgagacggagtcttgctctgtcacccaggctggagtgcagtggcacaatcttggctcactgcaacctccgcctcccgggtttctgccgttctcctgcctcagcctctgagtagctgggactacaggtgcctgccaccacgcctggctcatttttttatttttagtagagacagggtttcactgtgttagccaggatggtctcgatctcctgacctcatgatccacccgcctcagcctcccaaagtgctgggattacaggcgtgagccaccacgcccggccgcattttactttttaaaggatgtgaaactgaaggtgcacaaatcattgccctcacagggaactggttagagcttgccccaacctagctgcaaggaaggcaggaaaacatattctcttgctggcagcctcgaaaccagttaagcctcaagggaaaggggagaatggatactggggatgattgactcagccacaggcagtttccacagaaggtcttgtttgagacttggatgataaaggtgtgcacaaatgttcttaaaccttagtgacttttacagttttgactctttttacgccagaagttaactattgatggctgctttcccaggacccattgtcctattggtagaagtctgttgcagcatgctgctgtaggtgaagttaaatgcttttcagtgttagaaatggaaactgctggctgggtgctgtggctcacgcctgcaatcccagcactttgggaggccaaggtaggtggatcacatgaggtcaggagttagagatcagcttggccaacatggtgaaaccctatctctactaaaaatacaaaaattagccaggcatggtggcatgcacctgtagtcccagctactcaggaggctgaggcaggagaatcacttgaacctgtgaggcagaggttgcagtgagctgagattgtgccactgcactctagcctggccgacagagtaagactccatctcaaaaaataataataataataaaaaggccaagtgcggtggctcacgcctgtaatcccagcactttgggaggccgaggtgggtggatcacctgaggtcgggagttcgagaccagcctgaccaacatggagaaaccctgtctctactaaaaatacaaaattagctgggtgtggtggtacataactgtaatcccagctactcagggggctgaggcaggagaattgcttgaacccgggaggcagaggttgtggtgacccaagatcgtgccattgcactccagcctgggcaacaagagtaaaactctgtctcaaaaaaaaaaaagaaaaaaaaaaaaagaaatggaaactgctcttgaatgttaacagctggtgacattaggtaaccagtcaggcttttccttttatgtcctgtaatatattggtgacctgatctgataaggtgtgggatgaacaagggtttgtttttaagtacaccattttaccgtcataatcttgaggttgcttacacagatagggactatcatgacctgatctcacagcttcattgaaaagtttgggaatggtgtcagcctgtaagtttatgttataagcttagctttaagttactctttaaagcagtgtattcagtcaatatgtaatttataaaattgtgcaatatgaggattcttcattatattgattagtttaatctgaacctacatgacatctgactctcaaattttaggcctagaattctgagcaaaactttagaacaaatctaaaagaatattaaaaatggtagaatgtccacttcctagacatgtaactttattaatataacctgtgatcttattcacatttttggttgccatattgtccttttggttcatattgggtttattgctgattcttttctcccagtgttgcttgtaaagcctcccttccccacccctcccctttctccctccctttcctcctcccctcctccccttccctccctttctcccccctcccctccccctcccctcccccctcccctctctgcctcccttcctccctcccctcctcccttcccctcctcccttcccctccctctctcccttcccctccatctcctcccctccctttagttttctcacctgtaaactgaggctgaggccagcacttccctttaaagcatcatcatgaggattaggataaaatctggcacaaagaaacttctcaataaatggcagctgctgatattggttacccctggtgcctagcacagtgcctggcatttgtagtacctaaaattgtgtgtgtgatggatgaatggtctcaaaacgtcccatctagttaaggtcttatgactgacacacatgaaacaattaaggcagtgccaggtttgtgccattcacagtgactctggtgtgtggccattcaacatcgcaggagtttagagaagacttcatagaaggtgagttaggggctgagccatcacgattgggtaggttgggattaacagaggaaaccagtactaatgagtagaggtggggtgaagagactctaatggagaaggatatatacatgggcaaataacagaaaatcaagtgtgatgggaggtatgggcctctctatacgtcattgaaagcctggaatgggtggggtgggtgaaatagaagaatgaggtttcaagttgattacattttcactgtaggatgatttggggttttgagagaccgtaaccagaaaagggggccaggactagggccagggctaggctggtggctgctgtggggcaagaacgacgggatttgagtgtgcgtggggatgaagagcaagcagggagggagcctagattccctgctgatacaccaaggaaagtctctcccttgcactgccacaccctgtcctgccgtgccagccaagtgtgagtgcccctcatctcctgagaaatctggcgtggccttagcatttcattaggcaacttggtgggaagacacactagaaaacatgaaaggtgagatctctttgattaaacaagaatgtttgggtacaactatttaccactaaaatacacttagctactaggcatcattctaagcaacttaacaaactgtgatttatttatacctctcattagagaagtgctgtatgtattcccagtttacagatgagaaaactgcaacatggtatcttgctatgttggtttccaaaagtggctgtaacaaagtaccctaaagggagtggcttaaaccagaggtcagcagcctcagctccttctggggctgtgaggaagaatcagccgtgtctctccccagcttctggtggtttgctggcaatctttggtgtttcttggcttataggagcatcatcctgatctctgcctcatctttgtatagcgttttccctgtttgcatgtttgttaccaaatttcccctttaataaggacctcagttgtatgggagtaggggcccaccttattcttaactaattacagctgcagtccccctatttctaaacaaggttacattctgagacattgggggttagggcttcaacatatggattttgggggaaacacgattcagccataactcttgtccaaatcacaaagctaaagtagggtgcagaacttgcacctgggaactctgggtgcggagccagtgtcctgccactgctggtgcacacgggtgtttgctgtcaggagaacaaaatatgatgattccagccggccaagtaaaggcctggacttgaatttcaaattcctcattccaatttccagtggaaactgacagatagtaatcatgggtaatctttgaccaaaacatgcttcagtgacagggacgcctaggagccaggtactggattagctttctgaaagcttctggtgctagagataaggagggtggggagaggggcggagaatatggaaatcaaagcggtcagacttgttttgagctgggtggggcctggagaagaggcccaaagcgcaaattgggaactgagacttcaggtaggtatgttttaaaataacaaaaagtacattttttgttttaaaataacaaagggtatgatttagcctaggttggctgtgcttgtgaaggtttggtgcacagttttcccctgggtggtggtttctgatgctgggttcaggtctttgggagttgtaggtgcctggtgaataactggagggcggactgttttgtaagctctggtcagtgttcagtgagttaagtccagcagtcattggagtctattgctgtagactcttgcctttttaggtgcatttggaaaatccacctaagccctttccccatggtgaacaagtggctttaggtggcaagtggcagtcttggacacagtaggacatgtgggatacttgtccttgctctccctgcagttccagcccagttcctacactagtcattgtgttgaatgaatgagtgactaaatgtaaaatggaaatactgacagtttatcgtcaacaccctgtggcccctctctgttcagcatttaccactttatccatgtaatggacagaaataaaaggtcagtagggttttctggatgtgtttcctttaggatgctctgcatgccctcttggccatgtctgtgctgtgtgaaattaacaagtatcattggaggccttggcttgttacctacaatctacctgtgtgcttattttgtacccagactgtgaaattattttgtatctatagctcattagctcaagtggttgaagaaccacactaaagagccacagttatgaatttagaccttgtgtaggctaattaactagcctgtgttccttgggcagaaaattacctaaatttagacccaatttaactgactggcatctgtgtctgtggtcaaaaaagagactgacttcttaagagcattgcaactccttaccagaaacataagaaaagacagtccttcggtcctggttttgatggggcagctatgtcaacctcatgtaaaggacactattgaggacgaaactctgatttttttatcttgcacaaattcctatgtagggggtctggggagtcatgccctacaaaccatgaattcccatcagatgggttttatttaaccctatatatcatgacttattttccaacctgactctggcataacattacgagacaaggaagaaaattaaaatattttaccctaaaatatgtttatttgccatattttgaaatggccctgcaaagctccttctttgtggggggaaaatgtgcatctgtaaagaatctctgttaacatagttacatctttttcttccagaccctcccaaattctaaagagattaagatctgaataggaaacatgtgtcatctgttccctctaaggacagccactgtaagacttcaaaagaactttggtctccacaatctttatcttaacctgaatgttccctttctaccaatcccaagtctttagacaaactcaaccaattgtcaaccagaaaatgtttaaattcacctacagcctggaaggctgctcccccgcccgccttacagttgtcaaactgatgtatttcttaaatgtatttgattgatgtctcatgcctctctaaaatgtataaaaccaagctgtgccctgaccaccctgggcatatgttctcaggacctcctgagggctgtgcacaggtcatggtcactcatatttggctcagaataaatctcttcaaacattttacagaatttgactctcccttttttttttttttgagacagagttttgctcttgttgcccagcatggagtgcaatggcatgatcttggctcactgcagtctccacctgccgagttcaactgatttatcctgcctcagcctcccaagtagctgggattacaggtgcctgctaccacgcccggctaattttttgtatttttagtagagacagggtttcaccatgttgcccaggctggtcttgatctcctggcctcaagtgattcaccggccttggcctcccaaactgctgggattacaggcctgaaccaccacgcccgcccaagagttcaactcttttcgtcaacactatgatttcattattcagttcttacacatttgtgagtcatttatccatagtttgtcagaaagactctagacaacctcctcctagctagggaagaaattctccagaatggtcaaccaactctcaagacagaaacaagtctcaattccagcttggccaacacagtgaaaccccgtctctactaaaaatatgaaaaattaggctggtgtggtatgcgcttgtattcccatctattcaggaggttgaagcaagagaatcgcttgaacctgggaggtggaggttgcagtgaacctagaacgagcccctcacgccagcctgggcgatcaagcaagaccctgtctcaggcggggggcaagtgagcgggggaagaaacaggtctcaaatatttaatcaggttaaaagcagtgaatgttcagtatcccaggctctgttaccttaatcaagcccattatggaccccgttcacattagcatctcacttctctactacaaacctgtgctttataaacaatgctcgggttggccactgttataattttggacacacttaaggaaagctatggcaagtaaatagtctttttgtttttttgagatggagttttactcttgttgccaggctggagtgcaatggcataatcttggctcaccataaccttcacctcccgggttcaagcaattctcctgcctcagcctcccaagtagctgggattacaggcatgcgccaccatgcctggctaattctatattttcagtagagacggggtttctccatattggtcaggcttgtctcgaactcctgacctcaggtggtccgcctgcctcggcctcccaaagtggtgggattataggcgtgagccaccatgcccagccataaataatctttaaaaaggaatttattgtagtattatttatattaatgagaaacaaagtgtaacccagatgttgggagtaaacaaattgttatatccacagagaggaaagttttagagtcattaaaaatgttaagcttaaaactatgcagcaactgggaaaatgcgtataataaaataagtggagagaaattcaagttacaaaattgtacattacattataattacaacatataaaaaatgcatatggtatacatcaacacctcttcttagaaatactagggaaataaggatgggcataaatatttagctttaaggatattcagcataaaaaagacctaaaaattagaaaccacttaagtaaaaatttgttgagtatattttgggtatgtattccacaaccatttaaaatgttgcagaaattcattaaagaaagctgttttatgtattattactaagagacaaaagcaagttctagacatgcttgtgatgcttaaaatgctttcaatgtgtttctatttcttaaaaaacaacttggaagatataaacaagggtgagaagtctccaaagacagatccaagttttgtggagcctgaggtttatataaaaatctatgggaatccttctttaaaaacatcttacttttgcaaattttacaacaacaacaacagaaagaatatactatgtgagcatattggtaggccttgcaaggggccctgaggtttaagctttagttgctttatgggaaattttctcctgggctgtaggtctgcatttcgggggcatccagcacactgcttcagattctagcagttaccttgtaggcactcagctgataaagatacaagcctcgtaaattgccctaaagaacaagctcctttaatgtgatggttcttttatttacctcaattgagtacatccatctttgttgtagttcagtgttctccgagtgtgatgcctggaccatcagtatcagcatacttgaggaattgttagaaatgaacattgtggggctccaccccagagctacctaatctgaaattctggaagtgcggcccagtgatctgtgtttcaaaagcaccttcccaccttaggggattctgatgcaaattgaagtttgaggtctaatccggctcagtcgttgccagccctcattacaataccaggaaagcttcttaaactactggttactagcttctgcatccagaggctctgtgtccaatgagagagaatgttaactcaccatggcaagcaaataatttacagattatggcactttgaatagaaagaggtttaaatggatggctgtagagatgaacacttccgtccgggtactttgtcctgtttgtctttcctaaactcctccagatagtcagtatccttaattacttgactgaatagctggacagtgttttctgcacaggtccacaattattatcactaagagttagtttggttgattagttaacctcaaattctgtataccctacttaactatctttaaacccgctgacgttctgtttccttatcagcaaaatataaattttagaagagtacatccctcttagggatattgtgaggattaaataagatagaaatgcaaaagatattattcacttccccttttccagatactctctaattctgttcccagttatatactcctatctatcaaatctttttaaaaaatcattatttcttccatttctccattcgataagcagaatctcatgaaggtttaaatgatgaagaaattgttacctttatttccttataggatgacttcagttttcttgccacacttacattccgtaggaagttggaaaaagaaatactctttctgtgaggatgggacaaagatgttagctttgtgctatccactcttctagtcactagctacatgtgtctgtctagcatgtaaaatatggctagagctactaaggaactgaatttttctttatttctttcttttagagacagggtctccctttgttgcccaggctggactcgaactcctgggcccaagcaatgctcccacctcacctcctgagtagcttcggactatggacacatgccaccatgcctggctaattttatttattttcataaatttaaatttaaaaacagatactcaatgcaaatattggaaaatgcttaagtttggaacaacttgggtatgtgaatttgttttttcaactctaaatctcctgaaatctaaatagatgtcaagtatttgcaataaaaatgtagcatgggaattgagatgtacagtaagtttacaggatttttaaaacctagtatgaaaaaaagtaaaatatcccaataagagttttcatggtgatttcatgctgaaatcatcatattttgcctatattgttattttaaaaatatattattaaaattaatttcaccagcttatttgtactttataaaatgaggctatcaggaaatataacatgtggcattatattatatatctcttggatagcactatgttagatcctaaaagaaaactgaagtggaatgatactggttacatactgctctcttaattaacataaacagatgtgagcctttatacccaggagtcaccagcccccctgcatttgcctttgtggacagatgtgtaaccagtttccttttttctttttattttttttgtgacagagtttcactcttgttgcccaggctggagtgcaatggtgcgatctcagctcactgcaacctccgcctcctgggttcaaatgattctcctgcctcagcctcctgagtagctgggattacagacatgcaccaccacatccgactaattttgtatttttagtagagatggggtttctccatgttggtcaggctggtctcgaactcctgacctcagatgatctgcccaccttggcctcccaaagtgctgggattacaggcatgcgccaccacgcccagcccactttctgtttttctttaggtttatgcaaacatcccctgtatttgctctctgtcctctgaagctgctgatttaacatcactgattttccgtatggagcatctcaatgaaatgcatttttaaatgctgtgattttggactttctgtgttttttttctgtgaaggttttcctggcataggaatgtaattgttctgccctagtgttattctctgtccatagaagggagttaccattcttggaactcagatttataaccactttcttattttcgtaatgcctcctaatatactttttaaaagggacttaaccttcatataattcagttttccttaaaatgtttaatcacccactttagcagccttggctttgtgtgactcatggaatatgtgtatcattttatttttaaaacttactcattaaactgaggacaatgaagatttcttaaaaggtaaatataaatagaatgtcacttaaggattattttctgcttttatatggtttttcccatattttgagggttcttgctcaaaatatctcaggctgactaatgaattttaggctgatacttagacattcatgttaacatttgaaaatgatactcgaacccggagtttgggacttaatggaagaaatgttttatttcggaactttattacattgatgttgggcctattgtgtgattatactgtatcacaggagattgcaggctttttattcctgatctgtatagtttattctttgttgctgcctcctattactgcaggaggggttttctctgcttgaaacaccaagttatctggaccattttaagggcacagaaataatacttgtgccctttttgtatatgcctcatgtgactccttgaccttgaactttgtatgatggatggcatttcatgaaaaatagcccttttctaccccagaaaagtttttcatcttccttaacaagaggcaataactgagtcaagaccatcaaaacttgcagctcttgccctaccccgcatcaaattgcagcatattgagagatgataaatatgtaaaacatgaagccagagaggcaaagacgtcagctcaacattttactgttactttcagatagcatcaaaacttggcacatgatgttgtggacagaaccgcaggctatatttactgatcttggttctgccaattacttgtgtgtgactcctgcaagtcagttagcctccctgggtttccacatgggtgaaataagatgctcttggctgggcacggtggctcacgcctgtaatcccagcactttgggataccaaggcaggcagatcacctgaggtcaggagttcgagactagcctggccaacatggtaaaaccacatctctactaaaaatacagaaattagcccgacgtggtgtcaggtgcctgtagtcccagctatttgggaggctgaggcaggagaatctcttgaacctgggaggcgggaggttgcagtgagccaagatcacgctactgcactccagcctggcgacagagcgagactccgtctcaaaaaaaatgctctcaaaagtctcattaagctttaaaattctgtatttcctgttcaggtctctttccaagtccctctgctcctcatccatctttgtgtccactgataattgcttctgtaagagagtacaaaagcagttcatttatttttactggagttgtgcaaagtcccccaggcatctgggggaaaaaaaccacacatcttaattgaagtgtattcaagtctccccagtacctcgtcaaaatttatcatcttctactcttctatgacatttcttgtaatctctactaattgagaacaaacaacagggaatctggtcctactgtaagttatgattataataacctttccttgaaatagacagttattttttcacatttccttaagcacatggcagagctgtagacaggaaatcctcaagcctctgaccctctctccaaggggaaaatcaaagctttgaaaaaatggcagaagaagaaagagagggaatgttgatacaggggcgggaaaagagaaagaaaggaaggaagtgaaagtctatgtctttatgtgtctactgtatttatgagtttgctttgtttctaaagtggagtaaggaaaggttatcatgtcaagaaactagatcgtatgaaagctaagctgctcctgagtgttatctaaatataaagatataatttaatatactctttagaaccacatttgaaataataaaacctaagtataagggaactttgggtttttgttttttttttttgagaccgagtttcactcttgttgcccaggctggggtgcaatggcgcgatctcggctcactgcaacctctgcctcccgcgttcaagcgattctcctgccgtagcctcccgagtagctgggattacaggcatgcgccacctcgcccggctaattttctatttttagtagagacagggtttctccacgttggtcaggctggtctcaaactcccgatctcaggtgatccgcccgccccagcctcccaaagtgctgggattacaggcgtgagccaccgcacctggccaaaggaacatatttttaagaagtctgcagagttctgacagtataatcatgtcagcagttaaaaaattgtcaactaattagcctgcgtcttttgtgaaaacaacaaaaaaaaatttttagcttaaatttatttaaaacatattccataggttgtgggtatctttgcatttatatatttggatgttttgccaagttataacagtgaaaataaaatgtcagtagttaaaaaaccgtgataaaatttaaaaccatgggggtaattgattataaaagaccattatgccacagataaaataagttgcctgagagcctgcctggagccattagttaaaacattgccaatctaataatgatagaactgggcagccatggtggctgatgcctgtaatcccatatctttgggaggctaaagtgggaggatcgtttgaggccaggagtttgaaaccagtctgggcaacatagcaagaccctatctctataaaaactttagaagataactgggcatggtggtacatgcctattgtgctagctaggcgggaggaatgcttgagcccaggaatttgaggttacagtaagctatgatcatgcttctgctctccagcctaggcaacaaagtgagaccctatctcaaaaaaaaaaaaaaaaaaaaaattcattcagaaattcagtttctaatgccaggcttgcctgtaatcccagcaatttgggaggccaaggtgggcagatcacctgaggccaggagtttgagaccagtctggccaacttggcgaaaccccgtctctactaaaaataaaaaaattagctgggcatggtggcatgtgcctatagtcccagctacttgggaggctgaggcaggagaatcgcttgaacctggacgacggaggttgcagtgagctgagatcatgccactgcactccagcctgggccacagagcaagactggtctccaattaaaaaaaagaaaatcagtttttaaagtaaactttcaaaagtctgtagctactttgtgtcaattctgcacaagatgggttttcctagtattggaattttggagggtctgcccctctctgttgacatttggaaaaaaacaaatcttcattcatataatctcagacagttcttaaccccactgcacattaacattacctggggagcttaaaaacaaaagttattcctgttcttcacccaactcccatacaactgaatacaattttctggagaggagctgggttgggtattacttaggctctttggaagattttcctgagcagaaaatgtttagaagcactgatctaggataataagcaatcatctaggagggaagccgtgtagatattttgttttgatctcagaggcataagaatgaattaaccactcctcattcccccagagataatgtgtggaaaaacttgttttcaaaccatcccgaagaaaagcaaatgtgatttaaggccagattgtttccaagtggccttttgcagttcctttgttctgcattcagactgagttgtgcgtggaaatagtttaggtattagtccatgaacatggaatttgaccttggtaaggaaatacatcctccgctttcctcactaaccaattgtattcatttgttagggctgctggaataaagtgccacagatgggcggcttagaacaactgaagtataccttcttgggtctggaggcgagaagtctgtgtagcagggccatcctgcctctgaagtctctgtaaggaagagtccttccttgcttattcctagcttctggttttgctggcagttgttggaattccttggcttgtaggtgcattattctagtcctctgtccttacatggtcatcttctccctctgtatgtatccgtcttggtgtctaaatgttcccctttataagaacagtaatttcttgtagtgagactggcttgttcccttcccatggcataggctctctgtcagatattacctcagtatgtgaaagaacttgcatgcctcttgcttctcaaggctggattggactgactctagggcccttagcctcaggcatttgctgaggggccactaagtgggtggaagattagattttagtgtttccaaactttgttgatgatgagaatcacataagttgcttgttaagaacagggattcccaggtcctctccttgaagattctggttcagtaggtctgggtagaaccagggagctgcatttcagtgaggatctccctgcaccatccctccaccacccagctcttgcaggtgattcttatcaatgagtgagcttcagaaacattggactaagtgacttctgctcagcatgccaagactgtaaagtttctgacatgtgttcttccagcagaagagatttctagtagactattcaatatctttcctctcctttcttagtaaaagaaccttatcttttatttgggatgcagtgaattcagttaaaagagtttcctagccttctttgaactacgtttgactgactaggtttgacctggtcaaagagaagtgatggggggtgctatggactgaatgtttgtgtcccctcaaaattactctgttgaaatcctaatgcccaaggtgactggtatttagagatgaggcctttgggaagtgattaggtcataggtttcatgcgcgtccgtgtgaagagacaaccaaacaggctttatgtgagcaacatggctatttatttcacctgggtgcaggcgggttgagtccgaaaagagactcagcaaagggtggtggattttcattagttcttataggttttgggataggcagtgaagttaagagcaatgttttgccggcagggggtggatctcacaaagtacattctcaagggtggggagaattacagagaaccttcttaagggtgggggaaattataaagaacattcttaagggtggcagagattacaaagtacattgatcagtgagggtggggcagaaacaaatcacaatggtggaatgtcatcagttaaggttatttttacttcttttgtggatcttcagttacttcaggccatctggatgtatatgtgcaagtcacaggggatgcgatggcttggcctgggctcagaggcctgacaacagggatggaaccctcatgaatgagattattgcccttattaaaaaggccccagagagctacttcatcccttctgccatatgaggacacagcaagaagacagctgtctatgaaccaggaatcaggctttcaccagacaccgactctgacgtgatcttggacttcccagcctccagaagtgtcagaaataaatgtctattgtttaagccacccagtctgcagtattctgttacagcagcctgaactgaggtaaaacaggtggaaggccctgtcaaagcatccttgtatgctgctgaaagttacaccgcctcttttccttattctattttttttccttttattctattttttttattctatctgagatgaggaattgatggttagcatgcttgctgccgtcttgaaccttggggtgatcttgttaagtcagtggaacctatagattgagggagccccaatttcaaatttccttagggctatcatgccagctctgggctgactcctctaagcctctctttatttgtgtagacttatctctagttaaaaccactttatatggggtttccttttatatacagtagaacctaatctttattgatatatccccaaatttggaactttatgagtttcgtttaagttataaacatcactaatcaaatcacctaaattctgtcttcaaggtacatttcctgagcctaaaacttgcctttctttccttaagaggaaaaggaacaatttggagtttatatttaaaaactctctgagttccaagatgattggaacaagtctcaatgggaggaacaggtcaagtcacattgtacctttagtgtctcctggtgacaatgaaagggagctttcagttgacacgtgcatgaaggaaggaaggagtgctgggtgagaagcagcataggactagaggaaagcaagagagtgattgcttttcgttatactttcctacttttcaagtctgtttattgagggaattcagttgtaatgatgtgttgaaagtgctttttaaatgataaaatgccttatgtatgttatttactgagcactgagttatatataaggatgttcagatacactacgacagtttttccaagtgacaactgctagatattaacaggtgtcataagcaagaaaagtttgtgacaaacgggtttgggaaatgtcatgtcaggtctctttattacaggacttctcagtgcctttaacgtattaatgtacattgtgagtatcaaagaaaaaggaaggttgtggggaaggggatatgccatgcggtattattttttaatattaaaaatatgggtgtcttgaagaatagaacaaccttggagaaaggcagctttaggaagaattatgtaaagatgtaagaatacatatttagtacctactagatgcaaggttccagagcatacataaaatgagacacattgtccttgaattctgaaaacaaacactttttatgggttggtggggcgcaaaacatttacatgtggaagaataatatttaggatagaatctaagtgccacttgtacccaacattgtacccaataggtaacttttcaaccttcattcagtccctgtcttctgagagcttatgatgtagggctggtgaggatggtggataaggatgaggccaaggataacatggagtgggattagagaacacaggcagtggtgaagaggttcaaagaagacaattgtcacacccaagagagggattacggaggggaaggagagactcactaaagggaggatctcacaagataggcagaatttcaagagagatgggattgaggtcattttgtgggctgaagctatcctcctacttcagcctcctgagtagccggtcttgaacttctggactcaacagtactttctaatactggagttattagaaaaaaaaacaaacccaaaacttaaaaaggaagacccttatccttcactgaggatctgtttcttttttaaaaaaattttaaacattgttttataaagataatgtctcactgtgttactcaagctggtcttgaactcttggtctcaattgaccttccttcctcttgactcccaaagtattgggattacaggcgtgagccgccgtacttggctgaggagctttttaatgggaaattcttagatggcttcattgtctatgggtgtaatttcctgagacagtcctactatcctggtctttattgctgtatttgaatttcttttcttttccttttttttgagatggagtctcgctctgtcacccaggctggagtgcaatggcacaatcttggctcattgcaacctctgcctcccggtttcaaacgattctcctgcctcagcctctgagtagctgggattacaggcatgtgccaccacgcctggctaattttgtatttttagtagagacagggtttcaccatattggccaggctggtctcgaactcctgacctcatgatctgcccgcctcggcctcccaaagtgatgggatttcaggcgtgagccacctcgcccggcctttgaatttattttcttttgagtaataggtacagttctactgttctacatgaagaatgagtttacattcttcacataaatttctaagtgtcaacttataaaagctctattaccatatttctaatttttttctgttcattaatgtcattttagacttctgtttgatggtttctgttcctcaactcattgttctcagaatagcctttgaaagtcacattaaacacagatgagatgtgcaaaataacttcaaatttttagagaagaaaccacataaaggtggcgttgggttatctgggacagggatacggagggaagcaaaactaagtatatgtgccttctagtgggcattccagcaaagaagccagattgattttctatttgatttcttctgagtggtttcactccttgctggagtcaatgtcatatgatcttgatcatttgccaatataagtaagaaatctaagtgtaattattggacaggaagggaagcaagaactcttcagctttaaaatccaatggcatataataataattaaccctgttttgtggaataaaatatcagcaggaatatttaacatgaagcatactgtttcccaataccttcgttgcattgtcaaaaagttttagccccaggattctgttttttatttactgtttctgtccacctctctgctaaggaacttgttggtctgctgattctattaagattagcattgcagtagcccaaccttgaaaacagctatgctggaaggatcaatgactctagccatcaaagtggacaagggaagggaacctcacttgcagttcctcggtctacctgcccacctcagcttcagggccttttgatatggtgggctagaggaggtccaaatgctggtgggatctcaacctcacctggtgtccaggtgcttgacaccatcccaagaaggaattcatgagtcagaaaattgtagaagtatggagatttattgcaaagggaaaagtacaccctcaaggggcaaggggagcgtgggcatactcaggagagttgtgcgtgtgagggggtttggggctgctacctttatgggcttcattcaccaaggtggggaatattcatgaaaattcctggaaggtggtggagatttcttggaactgtggtgtcaccgtttttataccaaatgtgggtgttcctgaaactatcatggcactcgtgggggagttgattaagtatgctaatgagtgcataatgaggttctaagaggaacctaggtcagatccagcatcattttgggtccagttggtcttagccagcttggtccacgccccagtatttcagggtcttatcagtccctagcttctgcaggtaatttcaacagtttctttttactagtcatgtgaaactcctgcctggaattttctgttctcctgaaccactctgtattattcctgtctcgctttgacttggtgttccctgccccaaaaggctctttgcctggtctctgcacagttgctacctaaaaagtcttttcctgacacctcccacccctcgagtaaaatcacacattcttctggcttcctattctttcattttaactttttaaatacttctcacccttcatgtgttacctgtttgttcatgatgtatttgtttgtgaactgtcttctccctagagcagtaccctatcaggacttaggctctggggatttcactgctcattctccagcctggcacataagaggtggtcagtaaaactgtcgaatgaatgagtgaatgagtgaatcacagttaacctcagttataaagatgtaatcatcagtcttcccaaaattcttacaatactggacactttaaaggaaatgaggcttttttaaaaaaagaaaaagcatttcctggcaggaatttatgtatttgtatgcaatatgtgggtagttacagtacagtgcaagaaaaacaaccatatttcctgtcctctaggaatttgaaatctgtaaagaactctaacattggaaatgcctgataacatacatctgcagttatttgtggcaaaagacaaggcaaataggcaaatattcggtattataaaaaatgcacagatttcaaaggacaagtataggtggatttacatgcctacatcttttgaggtgagtggaaatttgtacatgataatctaggtgaggctgaggctccctggctgtgacagttccctttgggctattcccctgtacctcctgggtcagctgatctgcctccatccagaaaagatgctgaggaaagtcaggagtggtcagtagcttttgtcatgtgggtagctaattacaagttttgggttaattttttttttttttaattgagacagagtctcgcttttgttgcccaggctggagtgcagtggtgcaatctcggctcactgaaacctccacctcctgggttcaagtgattctcctgccacggcctcccaagtagctgagcctacaggtgcgtgccaccatgcctggttaatttttgtatttttagtagagacagggtttcgccatgttggtcaggttggtcttgaacttatgacctcaagcgattcacccacctcagcctcccaaagtgttgggattacaggtgtgagccactgcgcccggtcaagttttgggttaatttctcaaaatgtcttctctcgcacgtttcttatcttttcactcttttctcctgctttctaggtctttcttctttgagaggaaagggagagaccctggttaggccagaaatccatggagaagagttttcttcctcttctgccttccactgtggttggtagattttcaagattttagtggagattgatggaggatcctgcaggctgcagcctcatccccctcacaatgtattttttgtaataggtgaaatgctgcttctttattatggtcaggagaaatgttctctcactgctggtggccagtatataaatcttaacttgtatgtttatatattcagcattatgtatgtgtatgtgcgcatgtgtgtgtgtttgtgtgtaatggattttagttgtgcatttagtaggataaaacacatgcatttctttcatttatgacttatactgtgactaattgtggttcattttaagactatttattttaaagagttaccgcaaaaaagtctttgaattgttggcatgctaaagttaatgataataagaatcaagattttgaaaagcacacttcttaatttcttctttcctcatttaaccagagctgaacagcttacaagtagaaatcatgggttttggtatatagaaatataggcttaaaaatatggatgcaattttaatacaatgcagttttatgaggcggaatatcttagttgtttgaccctaaccgacttcattaggatgttgtaattcccctcctttaacttgcccattttgggcgggggggaatccttgtggaatgcagtgattcaagagcttaaggacagcaagagagcaggggtagggatggttacaaggtaagacgtgtagtccctgagcaaggcctccttaaggatgtgaattctgattactgcaactgaagaagacagatgtgggaagagagtgcaaatcccagtcaccccacccatgcccgtcttttgctggctgaggggtggctctgtgtcttttgctccacatcccctgtgaatgtgagggcaaagaactctgctgaagttgttggtcttttgtcagaagaaggctttaagtactggcattctttcctcatgagcacagatccggctcctgtttctcagggagggcagtgaacttgctctacattcctcatgggtaatgaagttgttcccaagcctgtcaccaccacatccttccaaccctgctcttaagcttctttttcagagggaagcagaatgtttactcagtaggacatcctaaaggacagaggcaaggcaaggagaggatggagaaaagctcattctcttttgaccacaatcactgtcactggctgcagggtgtggaaaatgggaaggcacagtatatcatcatttcctcaggacggaatgctggccagtgcccgatgggaacaacagctagcaaattagtgaattgtggctgcccattatttaagagagaacacgtggtaaccaccttcagtaaataaatgcagatgaatttggtgatttacaactcttgtgttttcttgtggtaacacagttgtccaactgatcaggcatgaatgttaatttacacaccataaggtacgtggttagtggttctcaacatttttaaacatgagaaacctgttctaacatacacagagttcacagatctttaagaacttttagctgttctgttatctgttggttgagaagacacataatggtgagatcaaaatgtattaagtggatttgaattacaattatcatggaacttactatatttgaaaactgtgtgtatgtagcatattacacacaatggtgctcagggattcaggatcttttctcgtccccaccaaactgaggaccctcctctgccctcccccgttctcagttcagggccaaagcccccaggttgggatctactgggagaatcaaaagattgtgaattttgggtcaggcagagaggggatcaaatttcaactctaccacatcctgtatgatcttgggtaagttactaaaccttgctgtgccccagcttcctcgtctttaaaatggagatcagttcctatgaagacttaacctcctaggggttttggaggaattgaagttttgttgtaccatgaatagtgcctgcgcaggaaaggtggcacttaaaattttttccccacttcttgcctactctccccacctccaggacagattcaagaccagtaatgcacaagatgaaaatcaataagttaattctttctgcctctgagcattcatttagccggtactgtatgttctagttagtagagctatttgacaaatgactactacttttagtggcgtaaaacaaatctttattacactcaccaattctctggacagggtacaacagggacagctcgtctctgatccgtgttgtggaacttcagctgggcagactgaaaggatgggggctaattacctggtggctcattccctcagcatctgacggataatgctggctgtcacctaagaccttaactgaggcttttggccagaacgctggtgccccattggccctggctttctcacagcatggtggctgggttccaaaaggaaacatcctgagagagctaaacggaaacctcatccatcccctgtcatggtctagccttggaaatcatacagcatcgcttctgccaccttccatccattgagattgtcacaacatcccgctcatattcaaagggaggagaaatagattatgcctcttgatgcaaggtggttctggagagtatatgggaacagaaatcttaccgcaccctttgtggaaaatctctgccacggtatgtgagcagtttgtaaatttatagaaagggactccttgaatgtccttgcactgctcttccctgagttaccgtggttgcacgctggactaaaagctaagaccttaacacaaagacctgaaatatagtatctgaactctgtcccagggcacgtgtcaccttctagctttgaactggagcctgggttttcatctaaaagctggcttttagatgtctggtcaatggcatgtcagtaactgaactctgcgctatatgctaggtggtaatatcaaggtgtaagacgcaccagcgaagccaagggctgactttctttccaattcaaagatattttttgtggtaactctttaaaataaagtcttaaaatcagccctaacctgattttatttctggacaagagccatattacctgtaccccactttgtctccattactaaaagttcaccaattacattgtcttcctaagatttaaaaaaaaatttaaataattatagaaaaagttgtagtgtttggaaagctaccttagaaggagaagaattggcctctagttaggaatgagaattcttccttatgatattatgacagttactttccccagtaaatatttatttcttctcagagcttatttgcaagtgagatatacttaaagctaaacaaacgattagctcacaaagtgttaaaccaaaaagaagtttcgcagaaaaagaatggacacataattttaaaaatgtatatgtatcatatagtttgattatgtgtaaaccaaaaatttaagggaggatgatgggttgtttatcatttatatggagtcaagttagtctataaaatgttcaatcgcttccagactctgaaagtcattctatgaccctgtctcagatttttttttttttttttttttttttttgagatggagtctcgctctgtcgcccaggctggagtgcagtggcgcaatctcggctcactggaagctccacctcccgggttcatgccattctcctgcctcagcctcccgagtagctgggactataggcgcccgccaccacgcccagctaattttttgtatttttagtagagatggggtttcaccgtgttagccagggtggtctcgatctcctgactttgtgatctgcccacctcggcctcccaaagtgctgggattacaggcgtgagccaccgcgcccggcagatttttttttctacttgactaataaaagtaatagcgctttcatgaggtctcactgggctgtttggagtatgtgagggataacagaggtgaaaagtttttggaaatctgcatgtgctattcacatgtaaagttctggcttttattttttactttttttacttattagagctagttctcactatgttgcccaggctggccacaaactcctgggctcaagtaatcctccgcgctcagcctccggagtagctggaattacaggagtgcactgtaatttttgttgttgttgctattattagtcagaggtgggactccatgacagcccacagagaggggaggaacaaagacctgccttcccacatgggttctcttcccctatttcttatatttccccttcttccttctcctctcttaagtctctttcttcccattgcctttttttccttccctgtcttctgtaaggtcttcggcctcccgttgttgtccatagatattgcttctggtatctggactctgaatgccttgtgatcaaaactatgttgtttatatagatatgtgtgtgtatgtatgtagatgtagatgtgtatatatatatatatatatatatatatatatatagatgtgtatgtatgtatattgtatacatacatataaaatatgtacatatatttatgtacataaatatgtagatatgtaaaatatgtacatatgttaaaaataatacaaggatctcacatcatgcctagtccagagctcaagagggatgtagcaactaaatgtattatgaccatctagattgcagggaaaatcattagccaggctcaaaaaagtaaacctctgctgctttctagattgagcaatacacaagatattgttcatgtggcaaatcaatgccagcaattccgtgtctgcctttatggcttggacttagggcttttattttaaatgatttcttattttctctgccaactggtctctaaatataagttcgtgtttttcttgaacggacacttttttttttgaggtggagccttgccctgtcacccaggctggaatgcagtgatggaatctatgctcactgcagcctctgcttcctgggttcaagcggttctcctgactcagcctcccaagtagctgggcttacaggtgcgtgccaccacgcccagctgttttgtagttttagtagagccagggtttcaccatgttggccaggctggtcttgaactcctgacctcaggtaatccacccacctcggcctcccagagtgctgggattattacaggcgtgagccactgtgcctggccttggctggacacttttaactgctctagaagagagctgttcttttggtgtctcgccctgaaagtgagttttatgtatgccatgtagtctatatgtagatcttttcagatagaccctttgttatgagctgagttgtggccccgcccacccccaaagtgatatgttgaaatccaaacccccagttcctcagactgtcactgtatttggacataaagttaacatgaggcctttagggtgggccctaatctagtatgactagtatccttatacaaggagaaaatttggactcatgaagagacacacacaagggatgtacatgcacagagaaaagtccatgtggtgacacagtgagcagctgtctgcaagccaaggcaagaggtcccaggagacatcagcctgctgggtgacactttgatcttggatttccagcctccagtctgtgggattttgtaatggcagctctagaagactaacatcccctccggttttagtgaaaatttgtaaagcattgttgtgtgatgtggtgacaagcagagaaatacaaacttaatctctgccaggcgtgatggctcatgcctgtaatcccagcactttgggaggctgaggcgggcagatcattggaggtcaggagttcggtaccagcctggccagcatggtgaaaccccgtctctactaaaaattcaaaaattagctgggtgtggtgttgtgctcttgtaattccagctacttggggggctgaggcaggagaatcacttgaaccagggaggtggaggttgcagtgagccaagattgcgccactttgggaatcccagcactttgggaggctgaggtgggcagatcactggaggtcaggaatttgagaccagcctgaccaacatggtgaaaccccgtttctactaaaaatacaaaaatgtataaataaattaaaaaaaatacaaaaattagccaggcatggtggtatgcacttataattgcagctactcaggaggctgaggcaggagaatcgcttgaaactgggaggcagaggttgcagtgagccaagattgcaccactgcactccagcctgggcgacagagtgagaccctgtctcaaaaaaaaaaaaaaaaaaacccacttcatcttattttatggatccactgtggagtgatggtgagggtatatattagagttctccagagaaacacaaccaataggatgtttatctatatacctatatatagatgtgtatataggatgtttatttatctatagagagaaaaaaaaaggagattgattgattctaaggaattggctcatgtgattgtgggctggcagaatcggaatctgtagggcagcctgacaggctggagacttcaaagaagagttggtatttcaagtcaaaatgcagtttggagacagaataccttttttgtgtgagatctaagtcttttggtcttcaactattcggatgaagcccacgtacattatggaaggtgctcctctttactcaaagtttaccgatttaagtgttaatcatatctaaaaagtacattcacagcaatatctagactggtgtttgaccaaataactgcaccgtagtttagccaccttgacacataacattaaccgtcgcatagtggagatgaggaagtggtagtctgggcctacgttatataagaatagtgaaatttcacctgatttaaggaaagctaaatgttaaatgttaacaatgtgtttttacatgtataacatcacttaattatttgaatcaaccttttgttttaatacatgagtgagttgaccatatatttagttttaatatactcatcacccataaatttctgttgatgatataagcattacgtgtgatataggctgtggactggtatttacatatgcttcaaaatttcaatactcatgctaggaaattgcttggtctatgcttttttgccttggtgtgactttttgccttaagtattattattatctttattatggcataaagcagtattttatacactaactccttttatttatttatttttgagacggagttttcactctgttgcccaggctggagtgcggtggcgcaatctcggctcactgcaaactctgcctcctggattcaagagattctcctgcctcagcctcctgagtagctgggattacaggcatgcactaccacatccagctaatttttgtattttagtagagtcgggctttcaccatgttggccaagctggtcttgaactcctgacctcaagtgatccacctgcctcagcctcccaaagtgctgggattacaggtgtgagccaccacacccggcctagttgttcctttctagaggacagatccatatcctttaaatctgcttgataagatacccatttctatccagataatgaaatgttttggttattaaagtatgcccggtatttgggcaaaactagaatctaataaattgtaacccacaaatcatatgtgggctatcagtgaacactttcccctaactccccatggcgtgacaggaagccatggagaataagagtaaagtgataaaactggcaagtggaccgagaaatccaagccatgagaattctgagaacagagagcaagaaacagctctctgtcagcattcaaggacagaactgaagttcaaataggaaaaaaggatgctgcttcaaggatcaggagttgattctcagagactctgatgcattgccttggtgtcttaacctgtagcttagttttccttgggactttgcaccacaatcctactcagctaccgtgggaattcttgcttgaaagtaaatctaggactatagttgtggtaatatttgagctttacttttcttctgttactcttgtccatttgattgaggctaagaaaactggccctctgttaaattgaagttgcttttctaaggcaataggctctgggagaatggagaggtggggtctcctaggttaccaagcttgtgcactcccatgaaaaagcctgggtctctgtaaaatatgttggtaacagttaaagcagaagccattggagagagagagagggaaaaaaaaaaccaacttcattatgatttaaattaatctctactttttattcttagatagaactaattaaagttctaattattttgagtgctttaaaactaggtgacagggtttccctttctctaaaagggattggaatttttctttaggaacaaaattgatgggtagtctgcaaaaggattcaaattgtttagaaatatatgaccattatgaagcattattttctgtcagtgtctatgatttaggggtcgtagaagacctgaatgtaattagtgatgtggtgactttgtgaagctagaaaaaaaagaattgaattttcattctatctttgaaggaagaaagacattgtgagcttagaagcaatagaagaagtcacaaagtacacttaaattagaaagcttaagtttattgtgtagtggatagtcaagagggaagactctcccacccccttccctcttggtaggcaaataccagacagaaaatatttgtagccaaaatggctaccagtctttattgtaagcgcatcaactcaaagataaaacaagcagaggacatcagaagacaactcacagctactaactgaacatgaagaatacgtcaccgataaccaagtgctgcaattaaaataagatgctggccaggcatggtggctcatgcctgtaatcccagcactttgggaggctgaggtgggtggatcacttgaggtcaggagtttgagaccagcctgaccaacatggtgaaaccctgtttctactaaatacaaaatttagccagcagtggtggcgtatgcgtgtaatcagctacttgggaggctgaggcaggagaatcgcttgaatctggaaggcagaggctgcagtgagctgagattgtgccattgcactctagcctgggcaacaggagcgaaactgcttctcaaaaaaaaaaaaaaaagccacaaatacattacaattttaaaatgtgaatacttttgttatttgataatattaaggaattattcttaaaatatttagacgttatactagtattttgtaaaagatttcagagaggccagacacggtggctcatgcgtataatcccagtgctttgggaggttgaggtgggaggattgcttgaggccagccaggagtttgagaccagcccaggcaacatagcaagacccttgtgtattagcttcttcccacactgctataaagaactattggaactcagtaatttataaagaaaagaggtttaattgactcatagttccaaaagctgtactggaggcatgcctggggaggcctcatgaaacttatggtggaagggtgaaggggaagcaagcacgtcttcacatggtggcaggagaaagagtgagtgaagggagaggtgctacacactttcaaacaaccagacctcatgagaacgcactcactatcacaagaacagcaagggggaaatccgcccccatgatccaatgacctcccaccaggtccctcccctaacactgggaattacaatccaaggtgagatttggatggggacacagagccaaaccatatcaccctgtgatacttgggtgaattgtaataatccccatgtgccattggagggacctggtgggaggtaattgaatcataagggcagatttttcccgtgctgttctcaggatagtgaataagtcccatgagatctgatggttttataaaggggagttcttctgcacatgctttctttttgcctgccaccatgtaagatgtgcctttgctcttttttgtgttccgctatgattgtgaggtctccgcagtcatgcgtaactgtgaattcattaaacctctttcctttataaattacctaatctcaggtatgtctttattagcagcataagaacagactaatacagtaagttggtactgcagagaatgaggtacagctgtaaagatacccaaaaatgtggaagtgacttgggagctgggtaacaggcagaggttgagacagtttggaggactcagaagaagacaggaagatgtgggaaagtttggaacttcctagagaagccttgttgaatggctttgaccaaaatgctgatagtgatatggacaatgaagtctaggctgaagtggtgtcagatggatttgaggagcttgttgggaattggagtaaaggtcactcttgttatgttttagcaaagagactggcaggattttgcccctgccctagagatctgtggaactttgaagttgagagagatgatttagggtatctggtggaagaaatttctaagcggcaaagcattcaagagaaagtagagcataaaagtttggaaaatttgcagcttgatgatgcaatagaaaagtaaaacccattttctgggaagaaattcaagtctgttgtagaaatttgcataagtaacaagaagccgaatgttaatcaccaagtcaatggggaggatgtctccaggatgtgccagagacctttgtggcgctccctcccatcacaggtccagaggcctaggagaataaaatggtttcctgggccaggcctggggcccccttgctgtgtgcagcctagggacttggtgtcctgcataccacctgctccagccgtggctcaaaggggccaaggtacagcttgggctgtggcttcagagggtgcaagcctcaagccttggcagcttctgcatggtgttgagcctacaggtgcccagaaatcaagaattgaggtttgggaacctccgcctagatatcagaggatgtatggaaatgcctggatatccaggcagaagtttgcatgggggtggggctctcatggagaacctctgctagggcactgtggaagataaatgtggagtgcgaacccccacacagagtccccactggggcactgcctactggagctgtgagaagaaggccactgtcctacagagcccagaatggtggatccactgacagcttgcaccgtgcacctgggaaagccacagacactcaatgccagcctgtgaaagcagtgtggcctgggtgtgagacttgtagtcacaagggatcatcttaaagatttggctccccctctggattttggacttgcatggggcctgtagcccctttgttttggccaatttctcccatttggaagggctatatttactcaatgtctgtacccccactgtatctaggaagtaaccaacttacttttaattttactggctcatggatggaagggacttgtcttgtctcagatgagactttggactgtggacttttgagttaatgctaaatgagttaagactttggggggccgttgggaaggcatgattggttttgaaatgtgagaacatgagatttgggaggggccaggggcagattgctatggtttggctttgtgccctaaccaaatctcaccttgaattgtaataatcctcactccatgggagggacccagtgggaggtaactgaatcacggggcggtttttcctgtgctgttctcgtgatagtgaataagtcacacaagatctcatggttttataaaggggagctcccctgcacatgctctgtctttgcctgctaccatgtgagatgtgcctttgctcttcctttgtcttctgccatgattgtgatgtctccccagccatctggaactgtgagtccattaaacttctttcctttataaattacccagtcgtgggtatatctttattagcagcatgaaaacagactaatacaccctgtttctacaaaaaaaaaaaaatgtttaaaaattagccaggtgtggtggcacctgtactcccagctacaaggctgaggctggggaggagctcttgagttgaggagtttaaggctgcagtgagccatgatggcgtcactgcactccagcctgggcaacagactctgtctctaaacagatagacaaaagatttcagagatacacactgaaatattgagagttgaaattataaaatgtctgaattttgcttacataatctaggtttctacagggaatgagtgagggcatcgataaaataaaggtgaggcagataagtgagttatttgataaagctagtgaggcaaggtgtggtggctcatgcctagcacttagtaggtatatgtgggtggatcctttgagcccaggagttcagaaccagcctggacaacacaatgtctctacaaaaaatacaaaaattagccaggggtagtggcacacacctgtagtcccagctacttgggaggctggggcaggaggattgcttgagcccgggaagttgaggctgcagtgagctgtgattgcaccactgccctccagcctgagtgacagagcaagtgcctgtctatacacacacacacaagctgaagggtgaatacatggggcttcattatattctttccttttgtttgaacttttaatttttgtaatttttataataaaacactaaaaatattaaaaatccttgaaagaccccagtgacttcaagaaaagagagaagccaccagacattttgtgcttccagatggaagtacgcgctaccttctatgaagtatttattgttgccaaaatattcaacttgaatctggtcagcctctaaatcctattgccaattaatgcgaaatactgaagataggaaaacatgttaaatgtcatggtgagataggatcagtcagaatcaagagcatgagccactctagaatccacctggcttcttcaacaagtagattaaaagaaaagggggttggggcaggaagaagaaactcataaattaagagactcatgagacagagccaccatttgcaatgtatgaacctcatttgtaacctgatttcatcaaaccaagaaaaattcatgagacagttgggaaaatttggataccaacagaatatttgatgtattaaggcactagtataattttttctaaagatgtgttattgtgttcatttttttaaaaaaagttctcattgtttagagacacatactgaaatatttattgatgctgtgctatgtggtctgggattaattcagatgatctggcaggcaagggtctaaaatggggttacagctgaaaggcacgagactgacatgagttgataatcattgaagcaggatgatgaattatccactctatttttggatatatttaagtatttccataataaaaatactagttttcacctattgttatcgtggtaagcattttctacagtgattgatatccagtgctctcatactttgctggtgtctttatatgcacaaatgtagtactagccatgtcctgtgtatcactttcctaaaaataacctacatgttaacaaatgaatgttgagttaaataagtataaaactttatggaattttatgtatcttataaaataacaatttattggccaggcatggatggtggctcatgcctgtaatcccagcactctgggaggctgaagcaggcaggtctcttgaagcgggagttcaagactagactggtcaacatggcgaaaccccgtctctactaaaaatacaacaattagccaggcttagtggcatgcacctgtagtctctgctactcgggaggcagagacacaagaatcacttgaacccgggaggcagaggttgcaatgagccaagatcctgccactgcactccagcttgggagacaaactgagaccctgtctcgaaaaaaaataaaaaataaaaacagggccaggcatggtggcccacgcctgttatcctagcactttgggaggccgaggcaggaggatcacttgaggtcagcagttcaagaccagcctggccaacatggtgaaacctaatctctactaaaaatacaaaaattagctgggcgtggtggtgggcgcctgtaatcccagctactctggaggctgaggcaggagaatcgcttgaacctggtaggtggaggttgcagtgagctgaggccgtgccattgcactcccagcctgggcaacaagagtgaaactccatttcaaaagaaaggaagaaaaaacaaaagcaaaaacaagaaaaacagaacaatttattgccccataaggctacctttgatgtatcagagtaaaagaaagcaggacaaaaatcagttatgctagaaaagagataacttagggaagttcacttaagggaaatacaacaaaatgctctttgtttttagtagaatattaaagtatgggtgtggatttttatcccccttcttacagtgtttggttatgtggttatgttttgtttctaaggccttaaaataaatagataaaaatgtatactatagtaaattgagaaaatatactcatatacatatatttaaattacatacttatcttcacctaaaataaagatactttgtctaacaaagtaatattagggatttattttatgttttaagtgaatgataaattatcttgcaatgatatacctcagatgaactcttctattaaacatctgtgtatttgtgcatctacttatttactttagaacgggcaagagaaaatggccttgggacttttgacctgtggaagttttgcattttccagcctggatatgtggaggctgtgggcaaagccatcttacttccacattgtttttctgtttcccagttcctgggcactcagctgcctaagtgcttctcttttgcaggaacaaaaagaaaaaaaggtaataagcatctcagaactcatctggggaaaaaaaaataaagaaatgaatagttaatttgctgctactgtgataaactttctttgtaaacattgtcatctcaacttctgttttgatagaggacagttgaaaacactgtgcttgcactggctggctgaagtttacacttattcaaagcaaggcagttgagaattaacccaaaaacgaatgacctgaccttccaggagtcctgatgcggccagggggccatgtgctcagggaggctttgcagggcagtcatcccaggagctcggtggagtggagggagaggtcaggaaagggaatgcctcggcctcctgctgtctgttttcagtctcctaaagactcctcggagatgaccacaggccctggaaatgggagtggcccctggagttggggtggtcagaaaaagcagaagtgcaagtccaacatgggatcagccagcattgggcatgcctagggacaatcagttgtctagggactgcccaagaggcctgggctccctgctgccagggaaggtggtgtttctgttctgccatgggtttcagctgcagccaatggacccttgcccaggaggggttttaatcactacaaagagccagacaaatgtggcccatggactcgacagtatatatagaaagagcaatggcaatgggtgtgcagagtcactgtcactaattttaccaagatagttctaatcttaacttatacaggtactagctcttaccaataatcttgcaaaatatttaccatgcttgatttttttttttttttttttgacagagtcttgctctgtcactcaggctagagtacagtggcgtgatcttggctcactgcaccctctgcctcccgggttcaagcaatcctcctgcctcagcctcctgagtagctgagactacaggtgtatgccaccatgcctggctaatttttgtgtttttagtagagatggggttttgccacgttggccaggctggtcttgaactcctaacctcaggtgatccaccctcctggcctcccaaagtgctgggattacaggtgcctggtacctgcttgatatttaaaagtcatatatatgtatacatatatatattatatttatgatatatattttaaagtcatttatgtatatatataatatgtatatatattttttctctaataggattacttcgaggatttttccccagtacacctagaaacaatgataataaggctataattaacacaaggcaaactattcctgactttctcatagccactatcctcactctgtcctgagagcctggagagtaacttctctgtgttgagaagcctcagtgtgacttgtacttgtgtttctgagacacaaactgatctgctcagtttatttgtttgaagtgtatgttgctttgagaaaaaagattgttttattatattctatttccatgatttttaggaatggatcagaggaggaatatcagagcaagattccatgagaaatctgaggcacaaggttaaagaaattctccagaattatatatacacctggaatttaacttcccagagcacagggctttgtagttcttgttcacaggcctgtccaatgcatagaaggtgctcaatgaatactgctaaataagcgaatgaatgaacaagccaggatctgagcccaggtctgtgttagtactcgaatgctcctattgaacatatgcatttaaccatatttgagatgtaattgatttattgaactgctcaagttaatgaggtgtacatttgaaagggtctttatttctctctagttgctgatttcaaccatgccaggtagaacctccttttcctgtcccatcacaatgttcaacctccataagctttcagagtaatccagttcaaaaactgaatctcaaacttgatttaaatctctctttcacctagagcatctggacccttctctaaagcacctgaagggagagaagagatagagggcattctgtcctttttctccttctgcctctttctcatctgggatcaacctgtctcccgcaaaggttggggacagagaggaagcactggggtcacagggaaggtgaatgaacacctctctgctcagctggatacagatgctgtcctcttattgctgctcagatgttagctcagtgtcccacatctcagctccgtgactcgggctctgccttcagttggaacttttcccactcttcctgctgccctcctactactgcaggggtcctctcccccaagggcagccatcttggttggggtacaggcaagatagcacaagtcaggcttcataacgtagtgtcccaggaaactcactcatccctgccgctcccagctgggggtacataggctgcttctctggagctaccaccgtgccacgcttttctctccagttcttttcttctctgtggctcagaggaacacagagaaatcagcaacctactgccttagcagatgagcagccagtgaaagtgatgttggtcttcccctctttaggcccgcccccctggtctctgtgtgattccgttgatgaccccaccagttggtgggcagggggtggggtcagtgaactgggggggctggggtgcctgaaggaacgagcactgctcttcccttgagggattctgattgcccgctccccagtgttctgatatagtctaggaagctggtattagcagggctacctctgttatcttttagtaacttctaaaggaggtatatgacccccctctttctgaaggtggtaactttgtggttcgctatcctcagcagtaggcttttgtctctaatgctggtgcaatagaagacataccaaggcttttatctcagcccctaaagactttttagtagaaggagtagaaggaaaaggatttctattgaatgatgtcattagtgatctcaaagattaaaaaaattataaatgtatgaattggggcattaactggcaggccaggaagattccagcagtatttgtgcatatctcatttattctttcttttttttttttgacagagtcttgctctgttgcgtaggctggagtgcagtggcgcaatctcggctcactgcaagctccgcctcccaggttcaagcaattctcctgcctcagctcccgagtagctgggattacaggcacataccaccacgccaagctaatttttgtatttttagaagagacagcgtttcaccatgttggccaggctggtctcgaactcctgaccttatgatccgcctgcctcagcctcccaaaatgctgggattacaggtgtgagccaccacacccaaccatctcatttatccttgaagtcacactatactacacagacatgaaggttgaaagatgctagaggtggagctgcttataatgaaaacctggtggcaacctagatgtttaatatcgtttagctttaaagaatgttgatgcagctctttattgataggaagaaagttcagcatatgttacttggtgagaaaactgggctgttgagcaaaatatttgctatatgcatagaaaaaatatggactgatagaaaaaatgggcagggtaattcttgagtgataggactgatagtggtttcatttttatttttaaattttctgtatctttgaaacttgtttacggtgaatcttgtttatatatgcaaaagttttgtaaagaaattatactatcaaacttaatgaaaagctagaatatatacttacaccaggtctttagcattttaggtgtcctatgtccttaattactgaagatttttttacatttttcatcatctctgagtgttaaagtctctgtacgtaaaagcttttagtaagtttcacaatctggcttatatttcaacaactgaatgcactaaatattacttggcatttacaaatgcatgtggtaatttggaaaagtgcctttcttacaacataaatcttccaagtaactttgaaagttgttgtagtcatcatcttgaaaactagaaaatgtgaacactctaacttgtataaagaaattccaaatgttattcatcttatggtctattttgtaatttgttggaatcattgaagtgcttcagggaaattaattcggcagggtttatttaagtgcctagagcttgataaattagagtggagttttagcatgcagagaaatggtgccgtcataggactgcatctttttgtctgtacaattccagtatcagcctataagctctgcgagttaggaaacttggctgtggttttcctgtggtactcataggacctcacagagtgcagaatacgtgatacaagtgatcatgacaaaatagtgaacttttactcagcagttaatatgtgcaaggcacatactatggtttttatgcattatctcatttaaacttcacagcaggtctcgataggtggttttcaaccttttggtagggggcagggctggactgtgctttgcaatgtataagaaaaattcagctgggcgcggtgactcacgcctgtaatcccagcactttcggaggccaaggcgggcggatcacctgaggtcaggaattcgacaccaggctggccaacatggcgaagccccgtctctactaaaactacaaaaattagctgggcatggtggcgtgtgcctgtaatcccagctactcaggagctgaggcaggagaatagcttgaacccgggtggcggaggttgcagtgagccgagatcgctccaccaggcactccagcctgggcaatgagtgagactccatctcaaaataaaaatcaaaatggcaagtgttttttgttttttttttaattccaaactgccctaaatttccatagttatggaaatgctttgtaaagccgttcattaagtagactgatattcaggttaaattagagcattttcttaaaagtctgtgtcaattgtgggttagcttttttgtttgtttttgacagagatgaggtctcactgtgttgcccaggctggtctcaaattcctgagctcaagggatcctcctgccttagcctcccaaagtgctaggattacaggcatgagccatcatgcccagccagaatgtgggtttgaacaaattgagataacagtgagaaaaaacaccagagttctttagggttacatcgacaactttctttgtaagaatgatcttttcaatgtttgccatgttttactttgctgtctataatgtgcagaattcctgctagtgattgagtaattcaggaatccccagtccctgggccacagactggtatttgtctgtggcctgttaggagccaggctgcacagcaggaggtgagtggtaggcaagcaggcattatcacctgagctctgcctcctgtcggatgagtggcaacattaaactctcatagaagagcaagtcctactgtgaactgatcatgtgagggatctaggttgagtactccttatcagaatctaattgctgatgatctgaggtggaacagttttctcccaaaaccatctcccccggcccctggtctatggaaaaattgtcttccatgaaactggtctctggtgccaaaatggttggtacagccaggatactaaatagaacaattcagaggccaggtaagcacacagatactcctaatgtagtgcaggatgtgctgaggctgaaggtgctggcatttatgctgggcttgaaggatttttgacaagttaaggaaagtagtattagcgtaaaattttgaaggaaggtcttgagaacagattggtttttaaaaatactgtgggtaattatggagttattggaattactacctgttactcattccaaatagatcaccacctttaggagaaagttctttagatgtcttggcacggtggcttacacctgtaatcccagcactctgggaggccaagatgaggatcgcttgagcttaggagtttgagaccagcctgggcaacacagacctcatctctacaaaaaaaaaaaatttaaaaattagctgggcatggtggcttgcacctgtagtctcaactactcaggaaactgaggtgggaagacagcttgagcctaggaggttgaagctgcagtgagctatgagcccaccactgcactccagcctgggtgacagagtgagaccctctctcaaaaacaaaaaacaaaaccaaaaaaagcttcaaaattatctggattcctcaatctgctctttgctgcttccaacacattttaaatttggcatatttctgatttcagattgttttctagagcagtgtcatggacatattttttcctgaatctaattgaaagcacacattagaaaacctgtctggtttcttagagtcattctgttttgcaggaacaaatgttctctgattcctcaaagaacttctcttcttttggactgctaaagcttttcttaggaactgtgccatttctgtctgctcatatttatagagggagggctatggaattgaggaatgagatggggtctattagaagttgtaagatttgtattcaaatattttagtccaggccgaccacagtggctcatgtctgaaccccagcacttggggaggctgaggcaggtggattgcttgagctcaggagtttgagaccagcctgggcaacacggtgagatcccatctctaaaatttaaaaaaacaaaaacaaaaccccaaatatttctgtccaaaataaaaaagcggaaggaaaagctgtagttattgttctacagtttgctatttctacactttgctaattcagaattctgtcacccaaggaatatgtgcattggaggtgactgccagatgctcttttccttgccaggagcagtgtggaattcatgggagcagtgcccttttcttgctgggcaccttggcactggctgcgcacacctgtactcttggcctcccttgtttgcttggtgtgctgttggtgtggtgccttttgtggtgacaccaagtgggaatcaggtagacttgacataccctcaccatcaccctttattcctctgaattaggaactgtgaatgggattttgttgggatctcttccagacattttcctggcagacaagaaggcagcttgttgacatcactggtccaattggccttccttcaaatttgtcccctctgacttaacactctaagagatatcctgaaatttctagcttgaggataccatcttaccacagtttcctatgcagatacaagttttcccttaattgtatattctgcagtttattttgatgggacatcgatacattgctcaagatatggatgaattttcccctaagttcaaacctccttagtagcttaaaaatcagttattctctggataagtatggtggcagctgaagcttctgggcttgtatacagcctgcggtatatctcatctgtgctgtagacagtctgtaaatctgggtttggccatgaaagtatattgtgaatatgaacatcagctaattctagagaaaaagaagcgctattcaaaataacggagtggaatttcccatgggtctttgaataataaccataccagctaacacttactgaatgtttaccctgtgccagacatggttttcaatattttataaatatttgattcatttaattctcacaacaaccctctgatagaggctactcttattatctcgtgtcttgcagttgaggcacacaggggcaactaacttgcccgagataataagtggtagagcgaggctgtgcacccaggtggtctggcttctgggttcttgcttttaagcactatattatactgcatttcaaaaggcgggactgagattagagatctgtggtcttctaatgctagtataaagagtttggatttgctagaatagacagaagggagccagtttattctcagtagtagagaggtgtcaagatgaaactgtcaagataataacattcaaatagttgcaatggagacataaaaaggatattttgggggcagttggggcaaaaggaaaagttgtgaaagctggctacttcctcagtgttttagtagcaatattatctgttaagcccagtgttctgcttgagtcttttcctcaggcaagcattcattcactcagtaaacatttattcatcactagccttgtgtcagcccttgtgccagatgcctgggatacagacgtaaaagccatggtccctggccaggtgtggtggctcatgcctgtaatcccagcactttgggaggccgaggcgggcggatcacctgaggtcaggagttcaagaccagcctgaccaacatggtgaaagcccatctctactaaaaatacaaaattagccaggtgtggtggcacacacctgtaatcccagctacttgggaggcaggaggcaggagaatccaagagacagaggttgcagtgagctgaggtcgcaccactgcactccagcctgggtgacagagcaagactctgtctcaaaaaattaaaataaaagctacagtccctgttcttgagctctcaacttatgtgacactactaggtatacaccaagtgactttcagtaaaaaatgtaagtgataagaagttgtgtataggatgccctggaaataaagtttcagaatttcaaaagcattcatattattatttcattgttttaacaataaatagactcattgcttttcagtgtgtggggtcaaactgcagattgctgacaaatgtcttagattaaggcctgaatccatagcacaagaccacacgctagagttccagtattacttgagtcgaattttcctgcttttggtgatttgtgtgtgtgttcactggctacttggcatctagttaaatcacaaaactctaagccaagacggttttggagaatcccttgtgatctttaaaagggtaatgaatgaggcttcccatatgggaacctcaatgacttttccaaagttctccatatctgccagcatccttggtttggctcctctgttgcttttgttaagaaatgttcagttgcagagttcagccttcatgggcttgccttggaggcctgtgtcttctgggggctggggagaccgtgatgaagagggccatctgtgcacatgctcgtctgaagcccagaccagactgatactgaatgtcatggccccttgtctcatgcttttaaaaaatgctgacctctgcctttagacaccaggcagaagtgatttcttggaactagatttttccccctgtgggtggatattagcgtttattttgggcttgctattattggagtgtaggaaggctataacaaatatgccctttcttgagaactataagagttctgttttaaataaatcagtggtgtctcttgcctgaaatatactaaactatccagactacttaaaattaacctctgataacattagacatcgtgctcatatgtgtgtagtattttgattatttaagtcactctgtttactaaggcttccaaacccacttacattgcttatagaaacttggaatgacaataatgagtttggagcattgtggaacatcccctccaagccagaaaaaattctattttaatggaacaattcattcaaaaatatctggatagatctaccaggaagggcatggtggaagaatgtgaaagtttctgccattaagtacaatctgtttgggaattcaaatatgttaaaatgtgctggcatcccctattttacaatggagaaaacagaggcatgcgaggttaagtaacttctccagggtcacacacatggtagagccaagatttgaactcaggaacccagaatccaggctcttagccctacactgttcccctctctgtaagcagatatgaagtgggagcaccatatacttggaatgctagtgtaaagctttgttgaaatagatggcagggagcaactttatgcctagttggcagagagatggccagataaaaatgggaggaaaaagtactcgtagttacaatgtagaagaggacagaataacttggattccagaatcaagagcttggctgaggcagagcatttgtgtggcttatatggcatggcccagagggagcgctgggcaaagagggatttaaggtttgaaactggattaagaaaagccttgaatgggggcatggaagagtgtgggatctcttgttgaccatggacagccacggatggttttgaataaggaagtgagccacagcagtggacaagagtacatcactatgagggaagttggcatgggaagagggaagaggggaagtgaagcagggaagacaagttaaaagacaattgaaatgtcctaaacaatgatcagtgtcagaacctcttccatggttttatgaagaatccacacgtgtcattgtgccccaggagcttggcaaagaggaagtgtctagcacgatgcctggcaaaagtaggaaccaaaaaggtgtttgttgaaccaaattggactgaataagaggattggccatagggatggaaaagaagtcaatgccagggaaacgagagacgtggcgctgacagtctttgatgagtaattggctggggaggtggagggagaaaagatgaagcttctccagcttgggtggcctcgtcgctaaccaaggcaaggggcttatgactcggggctcagcaagcctggttcaggtccttttctctctatggggcatcttgattgcccattggcatgtattaagtctatatgtgctgagtggtgtgagtgctgagatttaacctctcgtcttggtcaacattttaataaatacaggcgtggttaatatcaagccagtgtgtcatcttcattgttggcaagcgaagagtaattttggccgacagtagaatcgtagggaatacctaaaagcattcatacttttttcagacacctaggtgattctaatgtgcagccttgagccatattctttgagaaacattgcggtaaacaattgctttttttttaatcataaaaatgtgttttctttaagaaatgtgaaaaacatagagaggtagatttaaaaacatttgacgtgtgcagcagccttgagctaagtgccatacactactgcagtttgctgttttttgttttttttgttttgttttgttttgttttttaagatggagtctcactctgtcgcccaggttggagtgcagtggtgcgatctcggctcactgcaacctctgccgtcccagttcaagtgattctcttgcctcagcctcctgagtagctgggattacaggcgcctgccaccacacctggctgattttttgtatttttagtggagaaggtgtttcaccatcttgtccaggcggtcttgaactcctgacctcgtgatccacccgccttggcctcccaaagtgctgggattacaggcatgagccactgtgcccagcctgctgtttttagtgtctatacccaaagcaccacccggtgattttgaacaaacaggaaacaaatcaacgtagcgtgtggttcctgcagaaggctgctgtcagactgcagtcagtaggggtggagtcctctggggatgtttgtgctggttgagcaaaccctctccatgtgtcaccgcatcagtttcttagggctgccatagcagattaccaccagctgtggcttaaacaatggatgcctctcgcagttcaagaggccagaagtccaaaattaagacatcagcagggttggttccttttggacattctgaaggaaaaactgttccatgtctgtctcctggttctggtggttgccagcaatccttggttccttggcttgtaggcacaccactctaatctctgcctccatctttacatcgccttcttcctcatgtctctgcatcctctgttccatttctaaggataccagctgtcagatttagggtctatcccgagtctagaataatttaatctctagaaccttagtcagttacatctgtaaagaccctatttccaattaagattgcattctgaggttccaggtagacatgaatgtttggaggacactattgaacccccacagtcacttaggacttacatgtacgtagggctagccaacaccaagtatgggaagctctcttggactcctaccctaaccttggggtccccaatttttttcttagtgttcaaacaagaaactagtcataggcaattgagataccctgggcctggggtagaccccagcttcatagaagatcccttctttcacatgttgaactaactagttccaaaagggtgtgtatggggcgggggtgcagagaaaatacagattaattagcactcacgtagaatttataacttgaaggactgtttccatggcatgtgaatttctttagctatctctttgccctttgttaattctttaacatctgtaaagggcatgatcaggacaggagattactttggtcctcgactctgactatttagacacttaaagtgcacttaagcagactttgtggatgaaatcattttgtctggatacttcatgtgaaatgtgtaatgtatcgcttgggtgaagggcaaagctcaggagttgtggctgcttatgatgctcagacacatgccaggaatacttttggagtgtccttggataatagccagacctgtctccaagtgtcttgtctgtgggcaaggaagccttgctcagaccctaaaatattcattgttacatgcgtacctccctttaagcaatgaatgaatgtttgagtagatcaaatcctatatttttttttccgcaaaagcttgctattcacagaggccttatgaacatgtttataaagcaaataatcttgttttaaatgcttttgtgtaactacaaattttatatttaatactgagttttctttaggtgtggttcctgtgtttaaaaggcacttattcagacctcagagttcccagtcttgataccagcagactgaggtctctccctcgccccagtgaccactgtgctgtgatctgctgttctcttccagttggcttggttttttggaagtcttctcaatgtgatgggcatatgcgggaggcaggaaagtgcagtgataagagcattggagtgcagggtttgaattccaggtcttccactctctgactttgtaactttaggcaagatgcttatattttctttgcctcagttttctcatcagtaacatgaggataacaatatctgcctcaggatggtctatcagtttcctgtgaccgctgtaacaaatgaccacaaactgggtggcttaaaacaacagaaatgtattctctcaacagaaatgattctcgaaaatcaaggcattggcaaggccatgctccctcccaaggttctagggaagaatccttccttgcctcttctagctcctggtggttgctggcaatctttggtgttccttggttaatggcagcataattccagtctctgcctccattatcacatagccttcattctgtgtctctatgcctttgagtctctctctccttacaaggacaccaatcattggattttggatccaacttaaacgaatatgacctcatcttaacttgatgatgtttgcaaagaccctattatccaataaggttacattctgtggtactgggaaaatgtgcattttctggggacactgttcaacccagtaaaggtggttatggtgatttaaatgaaataaattatttatggcacctggaaggtactagcacatactcaaaattcagcaaatcacaagaagccactttgtcataaggcttgactcattttctgtacaatctcattgctcctttttcatttgacatttgctgctcttgcttatactgggccaccctcatctcatgcttttcaccatattttggggacatctaagtggctccctaatatttcaccaggatttttcctttctgccatcattctgggaactctaacattcacatcaatgacccatccaacaccttgcctctgatctataggaccagtccctggaccttgtccttacctgtccccaatcccatagtcattgcaggtactctctcactgccacttctcaccctttgaccctggaatctctgcttcactctctgtcttttcagtctcccatgatagatcaagccaactgcccctttctcccatcctacccgatgcctccagtgaaaaatcatgtgaccttaccaaatggtttctctatggagttacaaatgctgctcccagctggacctttggagctgttcaaagacccttatatttattttaagcaggtttccttactcacttccccccgggagctattggagcattaccatgtgtagggcttcttggcccaccactgaccgggcttactctgtctcccatttccccaagaaaaggtaaaagccataaaacaccaacagtgacttcttctctgccactgcatctctgctcatgctcctcttcctctttactatttcagaggtagaacacgaccccaattcacaaagatcagccttctgccttggttgaatcctcaattctgccacctcccagcccctttcatcacacctcctccccttatacaccaccccctcccccccccgccttttttttttttgtttttttgagatggaatctcgctctgtcgcccaggctggagtgcagctgcgcgatcctggctcactgcaagctccgcctcccgggttcacgccattctcctgcctcagcctgccaagtagctgggactacaggtgcctgccaccatgcccggctaattttttgtatttttagtagagacggggtttcactgtgttagccaggatggtctcgatctcctgacctcatgatctgcctgcctcagcctcccaaagtgctgggattacaggtgtgagccgctgcgcctggccttttttttttttttaacggagacagactctcgctctgtagcctaggctggagtgcagtggtgtgatctcggctcactgcaacctctgtctcctgggttcaagcaattctcctgcctccgcctcccgagtagctgggattacaggtgcatgccaccacacccagctaatttttgtatttttagtagagacggggtttcaccatgttggccaggctggtcttgaactcctgacctcaagggatctgcccgcctcagcctcccaatccttatacctttcatgctatctctgtctccactgactcctttgcttgccccagtgtatgaacacatttaaacccccctaaaaagtttaaacatcctaaaaagttcctgatatgtcttggctgtgtccccacccaaatctcaacttgaattgtatctctcagaattctcacatgttgttggagggacccaggggaaggtaattgaatcatgggggctggtctttcctgtgctattctcatgatagtgagtaagtctcacgagatctaatgggtttatcagggatttctgcttttgcttcttcctcatttttctcttcccactgccatgtaagaagtgccttttgcctcctgccatgattctgaggcctccccagccatgtggaactgtaaatccaattgaacctctttttcttcccagtctcagttatgtctttatcagcagcgtgaaaaccaactaatacagttccctccttcattttcctttgaattgctttggctttctcctctggagagaaccaactatattgtaaatggagtgactgcatatgttttttaacttctttgttattttccttatctgtaaagggctaataatagtacctacctcatagggttattgtaaaggttaaattgtaatatagtacagctcctcgcactgtacattttaattttagtagtaatggtatcctctttgggctttcataggactgagtccacagcactagtctagcacggataaacaatgacataagtagctattgggtatgtttctcttctcagaagtctgaaggctcctcaaggaacaatattcctgtcaatctttctatgccaagcacttcacatagtacataagataaacacacacatactctctcactctctaaataatgaatataagtaaatgagtagttgaaaccaatagaattggatgggataatttttctccatgaaggaaaaaattggcttcacctattttaggcttatctctgcccccatgagactgtgctttgacttcttgtgacatggtgggtctttaaaattatttaataatttaaaattcttaaagaggttaattaatagtagctcccaaggtagaaatgagaaaaacaaagcctttccatgcacagctctgaactgagcccctaccatccagtgggcagtgggcaaggggcatggggcttagtggtgaacgagacagatgctagccattgcccatgccctggaagtctagtccagtggaaggtggacagacctttacagatactttggaaatactatttaattacaaccatgccaaggcctatggaagagagcatgggggaccccagcaaagagaactaacctggtcctggtggccatgaagggctggggaaaaggaaagcaatgaggaggaggagcttgctgaagtgggtagggcagagggaccagcctgtttctggatggaggtgtttatgtattatgtacacgccacagcactcggcagttatgtagaaaagacctcaggaagtgctgacactcttcatttagggagagtgatggatttcggggtgaatagcagggacagtgtaacctgcatgtgtgaataatcttaagcaaaaatgtaagtaaagggaaaagacattttagataaactcatcaggtattggtctgaagtaacgaacattatctggaacactcttttatgaaactgctggttaggtgcttgccgtgttgtattggtaattttctggttgtaaggtttcacttgtatcaacttgttgtttatgctctctactaaatacatcctgtatgtttcaatccttgtgtcttttcttctctcctttaatttaaatattacttcttgcaaggactggttcacaatccagtcaggaaactccctgcttgcccagctgagagttgtctttccttgctagtgtgtcaattcaccattttgctcactttgccacttctaatatcctattttgcattgttggcgtatttctggtattaccgtatttgatctctgcaactatatagaaaatttgggagcctcatgcctataatccagccctttggaaggctgaggtgggaggatcccttgagctcaggagttcaagatcagcctgggcaacctagggagactccgtctctacaaattaaaaaaataaaaattaaaaaaaaaaaaagaaaatttgggaaaggctatactgcatgtaaaacacacttatttgttgaataagtgaatgaatgatagggattagatctcacttatctgtgtaacagctatagaatcttctttattaccctgcacctagtagatacatatccgtaagtactggtggatatagtcaactggggaaaatattatttgagactgaagcttgcctgttccttgtaccctttcttaaaatgatgaggtgtgcgcaagattttttcctggacaatgtgaatctgaaaccttcccagtgaaaacagtttactttgtctttcgtcttagacttgctgattatattggcaaaacagtctcctcaccgaaaactggagcaagaaatgcagcttttctcaagataatctcagatagattcctccagatggctgcccgagcagaggcacagaacaagagcattctaattggtgatggttagggttttggcatcttttctcaagaaagtcaaagaaactctcttcctggcttattctgtgccactggattattttgattgagttgatatgtttgaaaactcagaacctcttgactagccagatgtctgtgaccactgagttccactggtttttcaggtcccaatgattaaaccaaaataaaagaaggtgatgccatgtctggccaagggcagacactgccggttgccaaatccccagcgttcatcacccggttgacatgatgtttgctattctagatggaggcaggcaaggcttcaaaaaggccaagcttcaagagaaaacctttaagtaagtcagtgtcatttggaaatgatttgatgaataggaaacttaccggccagccaatatcatttgtgatatattagcaggaatgtttggagcccatattgagggtaagggctctttcccacatgccgcccttcatagctgacacattacacatgtctctgcagcataacatatggcttcctgaacttgcaagtatggcttaatgttctctgttgaaatcgtgtctgtttaaacagtctcttggaaaagtgagccatattcaataaaatcattaatttcatgtctgtgaatgtttctctagagccctttaaaatatgattttgaaggagcatagtagaaaatttgcattaagctgttatcagcctctaaaagggtattggactatcagtcctaaattgtaaatattaaaatattcatagaacattagtcaagaaggaacagtgcagctcatcaaattccagaagaatcaccattttaggtacctagtatgtgcctggctgtttatgtatgctgcatctgattctcaggataatttacaagtaggggggatttcctgccatttatagataaggacagggaggcccagggacacggatgaccacctagaagtgatggaactggaatttcaactcaatagcaccgaactctgaagtctgtctcttcttttctacaccaggaattttaaacttgggcttaggagtgggctgggtgggggtagatatttaggccagaaatcatatgcaagtttttgtgtggatgtgcattattctgaggaatgtctgtaactgtaccagattctccagggggtccatgaggcctccagaagattaagaaccagattttggcgccactctgcctttttttttaagcgacgaggaaacagcaagtgagactgaaccgttcgaaggcgtttgacctggtgttgaccaaaaactgaagcacaggacttctttctaaattctgtgtgtatgtgttttgtatgcctcaagggggatggtgagggaaggagaaggaaataaaagaaataaatcacatatggagaaaagtacacaaaaccatgtacgttctaacaagtagttataaagtgagcatctgaggagctgctaatcagaccctaaaacagagcaagtcccagaatggccccgggtgtcccttcctgataggatgccacaccttcacccctaatcatgacccttacttttatactgaccttatccttactttgctttatcatttttttttttttttttttttgaggtggagttttgctcttgtcgcccaggctggagtgcaatggtgcgatctcagctcaccacaacctttgcctcccaggttcaagtgattctcctgcctcagcatcccgagtagcggggattacaggctacgccaccatgcctggctcattttggatttttagtagagacagggtttctccatgttggtcaggctggtctcgaactcccgaactcaggtgatccgcctgccttagcctcccaaagtgctggcattacaggtgtgagccaccgcgcccggccataatttttttttttttttttaatttgagatggagtctccctcttgtcgcccaggctggagtgcttactgcaacctctgcctcctgggttcaagcgattctcctgcctcagcctcccgagaagctgggattataggtgcccgccatgcctggctaatttttttgtacttttagtagagacgggggtttcaccatgttggtcaggctggtctcgaactcctgacctcaagtgatctgcccacctcggcctcccaaagtgttgggattacaggtgtgagccacctcacccaggctataattttatcatctgtatatacatccctaaacactatggttccatgtttcctgtttctatctttatgtgcatgcagtcatactattgtgggttttcttgtgtgtgtcttgcttctttcaacagtactgtttttaatacccatctgtgctgttgtacctagttgtagtttgttcattttcattgctgtgtgttattctgttgcttgacgacgtgataatttatccgtcgtttgttattggaaatttgggttatttgtaattcttgcctgttatgagcgatgctttcgttgacattctaatgcatgtcttatacacaggttggggaaagaccaatatttactcagcttttatgggaaacaaaatacctagttctacaagaaaatagtgaagaattcttctcttcacaggcctgcttccttaatgccttgtggaagaagaaaattctttcaagtgaattctcctgttagtcttaacataggttccagttgtcctcaagttagcaataaaaatcaaaggatgcactcgttgaacctaagtgattccagggctccaccccagactcctggggtcagagtctgctagatggggcttgggagtctgcagatttaacaagcacccaggtgattcttgtgactgggagacatcgcgttcaccctgattgaatttataaggctgggctccttagttgggaagagatttgaagaaagtatttgcatgattaaaatcttggaaaattggccttttaaaaaagttaagggagttggatttatttagcctataaaaaaacctgaaacacgatttaatagttgtttgcaaaagaatgaaacttttgtaaatgaaaaaacaaatatttgctaagtcgagagtgatttaggccaatcaacctcctgctaaaatcagcagcaaatactgagcaccatgggggtaagaaatgaagactgttctcagggccttcagggagctaaacacaggagaaaaaccgtaagctctcgaacaaaaaccaggatgcgatatttcatcaagtctagactgtgggcttcggttgagatgagcgagtggatggcccccagggacgcaatggagtagagaaacagagagaggccaccaggaaagggtggagagggcccgcggggcttgagctaggctttcgaaatacgcctttgcttaggcagatggggtgacagagcattctgaagcagtggctgccagtgttttttcttgtgatcctccagtaagaaatatctatatttcttacatatatgtgtgtgtgtgtgtgtgtgtgtgtgtgtgtgtgtgtgtgtgtgtgtatatatatatatatatgtatcttttctttttttttgagacaaggtcttgggttgtcgcccaggttggagtgcggtggtgcaatctcggttcactgcaacctccacctcccgggttcaaacgattctcctgcctcagaatcccaagtagctgggatcacaggcacgagccaccgtgcccagtccagaaatgtattttatatcagtcaggatacacatacatgtaataaataaaagcttcataagacatttaactttattaaaggtggtacatctgatgttttctattttatttttttaacatgtgaggttaaccgataaactatacagctttcatagagttgaaaactataagaggaccagaagcccagggtggaggcagaatcagtcctgtcctatggagggcatgctagttagaggagaggattttcatggaaagtggtgagaggtaattttgttagtttgatggtggtctccaaaagccttctttgattctagagtatgaatgaattactttgggatgttatgataaaatttcaaactttacctatttatttgaccagctctacttttggacagtagattgaccaaagtgactttttgagattttttttgatgcttgggggtgggggtaggggagaggatttgcttctggattccaaagaatgactcaaagtgcttattgaacatctgttttgtctcatgttgtgattggctatgggaattttggtatagaaaatggcactggagccaggcacggtggctcacacgcctgtaatcccagcactttgggaggccaaggtgggaggatcacttgaggtcaggagttcaagaccagcctggccaatgtggtgaaaccccatctctactgaaaatacaaaaattgggccaggtattgtgagtcacacctataatcccagcactttgggaggccacggtgggcagatcacgaggtcaagcgctcaagaccatcctggctaacatggtgaaaccccacctctactaaaaatacaaaaattagctgggcgtggtggcatgtgcctgtagtcccagctactcgggaggctgaggcaggaaaatcgcttgaacccaggaagcggaggttgcagtgagctgagattgcaccactgcactccagcctggtgacagagcgagactctatctcaaaaaaaaaaaaaaaaaaattagccaggcatggtggcagatgcctgtaatcccagctacccaggaggctggggcaggagagtcgcttgaacccaggaggcagaggttgcagtgagccaagatcgtgccactgcactccaggctgggcaacaaggtgagactccatctcaaaagaaagaaaaaaaaaagagtatggcactggatagaatagttttataggagaggatgagaggatgtaggaaatatctccgtgggcaagtttaggaaggaaaactgatggcctctttatcactgtgcttctggaaggagcatgatatggccagttgtgcatatcagagctaattgcaagtatgattagtggcctggcccaggactagacaactctgctatttgatcagaatccagattcctggatcagacgtctaattgggaccctacttggcctctagttttagcatgcttgtgagaattttaagagcaaaactcttcttaaaattttttatttttagagatggcgtctcactgtgttgcccagagtggtctcgaactcaagcaatccttctgctttggcctccccagtagctgggattacagttatgagctaccacgcccaggctcttaccttccctcctcttttcccaacctagctctgcttactgtgaaccccatctgcagcacttcttgaatggtgttgtggattatttattgaagatttgcttgtgtagccatgttctcttcatctgctccaagagaaaagtaaattctggcctgcactgaaaagaggctctagatagaagagaggcatttcagaccactaggaatgttgcattgaccttgtcttccaaagagcaggatagggaagatctctcctgccatgtcttatagaaactgaactcccttaaagatccatgtggaacgaattttagggaacccctgcaatcagatttttctctacctaagagtagagtgccttagcaacgttgaaaaggaaaatcctttcatgcggccgttcctttgcttgaatactttcagtcctgtcctctgagatttgatcatatccttttgatcttcccagtccagttttaatttgttcagtttaggttagaaaaggatttggaaaaacaatacttttctcttttaggattctataggtagggatcattggtcctaaatgttcttcccttttttctttgcttgtaaagtgcactctgggggaataagctgcactgtgtttcttggggcttgatcatttgctgtagttgtttgtacagttgttaagttacgctttctattctactaacaaatgatggtgtgaggaacgccatatttcttatgtttcccttcaacaggaagcttgattggtaactaaagacaaaaatctcatttctttgtgagtaaattgctgtagtaggagcgtggctgatgttggtccagacacattcttactttgttaaacctatgaggagagtcatcaaggagagctgcactggtctacatggtggcctctggctaacgtcacgtgaagtctcgaggttaaaaattcacttcttcagtagcactagccacatttccagtgctcagtagccacaagtggctcatgcagtattgacattttgggccagattattcttggtgggggtaggaggactgtctcatgcatttgtgcattgtaggactttcagcagcacacctggtctctacctactcaatgccagtagcactctatagacataacaaccaaaatgtttccagagattgccaaatgaccccacaggggcaaaacaaatcctggttaagaatcactggctttgtggctatagtatttgaaagcccagataaagaacatttccatgacggcagacagtcctgttctagagtaatccctagcagagtttggggaattttatataataagaattttgagctttggtggaatcacagtggacatccagtccaaagcctggggaaactgaggcacagaaagattatgggtgacttcaggtcacacaacatgtaagtgtcagtctggagttctggacttcaagttcacgcagcccagagaacaagctgctgatttttgttcaaacctgcttcattcctactgtgcacctgcactcagtgttggtgggggaggacagagtcctaaaaactgggaatggttcagtcctgagacgttcagagatgcaaattctgaacacatctcttttatccctccctggcttaaggccctacatatgggctagggttgggagggtgactgagacatctgatggacaaagacttgttgggtttcctcatttccatcagtacagagattgggaacatactcccggggccgtggaagactgtcatcctgtaaaatttcttctttttagtttttaaatctacaatatctcctctgtctgcttccttttaagggtcgatcgtaaagctgttaatacgaaatacctggaggttcatcccttcagaggctgcaaggaagcagagtctatagaaagctttgggaagggaaaaggagtctctcccagggtgtggtgtccacagccgaaggggccagaaagtgggcttagctcaggggccgggcgcaggagacgactggaaggcagcccgggcttgcaaagtgcccagagcctctgatatgctcaacatctttccttcctcccctctttccctcattaatcccacgtgcttcaacacctcccaatgactcttcagtcactggttctataattctctccctcctctgctcccaaaccttcagtggctcactgctgcctttcatgtctttcttagtcttatattcagagcccatctgctcttatatagaaatcgtctctttccctcctaagtgtagaaatcagttttgcacatacgagtgccttactgttactgtggtttgcagaattattcagttggggtttggcattgacagtgattgaggctttgctcaaagctctttgacgtttaagagcttgctcaggaagaagttttgtttctggtgagactttgttgagtcggtagcctggacaactacttaaaatcagtatccagctcaaaattcagggcctggtaaacagaccagaaagagaggcaataaaagcagatgaaaaattatgtgtctgtaaacctcgggtaaccttgagctgctggtttggttctgtaacacggtggacagagtgagctgtggatgaggtcaaaggccaacgtgctgaggagcagctgtctagttcagcgagaaattagctaatgtgtaaactggccttgaggtctttttacgttgcttcatattcctagtgttagttaaaagaagtaaattttatctcagagtttggtgactagccgtgatttcattgcactatttatgttttcttttgggaaagcggccttcttgggtgtctccatggtgaaggggaaggtattttaaaacacactcattcgggagcaggctttaatttgagtgacaggagggtgggggctgcgaggactgcagccctgctggtcagtgcggctgtggccagtgttgttcatgacctctgtttcttctctttctctacagaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactggtttgcagatatgctggttctgggtttttggggtgttctctggaatccttagtatccataggggaatttcacacgtgctccctctccactcccatgttgaaatatgtaagaagatattttaatctagtgcctttctctccaaattccaagtcacatatggagctctaccttgaatgggtatacatgttcccaagtataagcaaaggttttacctcctaagattgcaaccaattgtagatgagacatgaattctctcttcgataagaaatagcataaaagagaaaaaagtattttcctataaccctcaaaccttactgtgtatttatcttaaactacttgtttatttatttgatcttccttaacatagatcattaagtacatgagtagtatgattttgctttatggtttgctgtatgtagtactcttccttgccataattaaagctgtatatttgattaagtatttgtgtgtgtttgtgcatgagcatgtatttgtttatatccattcttacgttggcagtgttgtggagagagcactgactttggagccagatagacatctcacaggaactctatcacttacgagttgtgtaatctctgaacctcagtttccttactataaaatggagatggtattagttaactgttagagtagttatgagtataaaatgaaataataatgtaggttgggtgccctcagaagcaggctctgagacaaggatttaagtgcaagtagttttatatcttttcttttttctaacatgtcaaatgatggttattgtgtaattactgtgaaacacaaagtggtaatatatattacttagggatgtatacacacatacaatgcaagtaatttctatagccggtgatcccaggaagcgtaagaaaggaagaaacctctatttttaaggtgtgttattgacaggttccaactttgtcactttttcttgatgaggattctgggaatctgtttagacctagagcagggtttggctatgttaccgaggctagacttgaactcctgggcccaagcaatccttctgcctcagtctcccaaataactgggactacaggcatgtgccaccgtgcctggctgttgtctgattttataaataaagttttattgaaacacagccatacccattcatttaggcattgttcgtgactgctcccacactacaaaggcagagttgagtagttacagcagagactacatggctcacaaagcccagagtatttatctggccttttacaaaaagggtttccttatcccaggtttatagtatgcctcagagttattccacccaaggggtaagaaacctggggtatctgtcccttatctcctctccctcaaaggttgagtgccgactgggtacagtggctcccgcctgtaatcccagcactttgggaggccgaggcgggtggaatcacttgaggtcaggagttcaagaccagcctggccaaaatagtgaagccctgtctctactaaaaatagaaaaattagccaggtatggtggcaggcacctataatctcagctacttgggaggctgaggcaggagaattgcttgaacctaggaggcgtaggttgcagtgagctgagactgcgccactgcactccagcttgggtgacagagcaagactctgtatcaaagggaaaaaaaaaaggttgagtgctactctaggggacaccagggtcatggccagaaaaagtctaaggggtccccaactcccaggtcacagaccggactggtactgctcacagcaggagatgagcagtggttgtgcaagcaaagcttcctctgtatttacagccactccccattgctcgcattactatctgagctccgcctcctgtcagatcagtggcaacattagattctcatagtagcacaaaccctactgtgaactgcacatgcgagggatctaggttgtgagctccttatgagaatctaatgcctgatgatctgtcagtgtctcccatcacccccagttgggactgtctagttccagaaaaacaagctcagggctcccacagattctacactacagtgagttgtataattatttcattctatattacaatgtaataataatagaaataaaatacacaataaatgtaatgtgcttgaatcatcccaaaaccatcccccgtacctggtctgtggaaaaattgtctttcacaaaactagtccctggtaccaaaaaggttggggactggtggtctaaggggatttgggaatggcaccttcagctgtaggtgctctatataaagagtggcacagcacccagcccacagtgagcgcttgataaagccagtcacctaccctgctcgtcctagattagtggtttgcaatcttggcagcttctgcgttcgaatcacctggagtgcttctttgttgttgttgttgtttgagatggagtctctgtcaccaggccggagtgcagtagcgtgatctcggctcactgcaacctccgccaggctggagtacagtggcgtgatcttggctcactgcaacctctgcctcctgggttcaagctattctcgtgcctcagcctcccgagtagctgggactacaggcatgcaccaccacacccagctaatttttgtatttttagtagagacggggtttcaccatgttggccaggatggtctcgatctcctgacctcgtgatctgcctgcctcagcctccaaaagtgctgggattacaggtatggagtgctttttaaaaatattgatgccatgttgatcagaatcaaccccagatgctctgaatcacttggtctggggagaggcccaggaatctatattttttgttctgaggtgtttggtggtaaatgttggggcttttggtctcccttttgaatcactactcggccttctttgtccctgttctccctagtccaggtttgcacatgtttgtgcaagacaacctcttcatgtcatcccagagaaaggggagagaaaggtttatgataattttgtccaagatagtacttactaaagagaagacagaaaatttagatgagcagcttagctacaattgtgatcaccttaacaaatttgaaccttttgatcataagatatttattacatgtgttctctttatttattgtggtaaaatgcgtataacataaaatttaccattttaaccattttaaagtatacaatgtagaggcattaagtatattcacaatgttgcacaaccattgtcactttctagttctagaactttctaatcaacccaaagaaaaccccgaacccattagggagaaactccccaacctcccctccccttcctctggcaaccatgaatctgggttctgtctctggatttgtctgctctggatattttttataaatgcaatcatataatatgtggcctcttgtctctgttcctttcacttagcataatgttttcaaggctcacccgagttgtagcttctgtcagtacttcattctattctctcttcatggtagacatatacatagcagttaggtaagagtcaccacctcccttttgcagataataaaactaaggcccacataacacagctcttcctgaatttacctttttgtgtgcatgtgtgtgagacagggtctcactctgtcacccaggctggaatgcagtggtgcagtcaccgctcactgtagcctcaacctcacagggtcaagtgatcctcctgcctcagcctctcaattagctgggactacaggtatgcaccactgcacccagctaattttggttttgttttgttttgttttgtttttgtaatgatggggtcttgctgtcttgtcctagtgatcctcccatgtcagcttcccaaagtgttgggattacaggcatgagccaccattcccagccttctattttctagagagctttcgtggtaattttgcgctggaatctacagttgcctgtctgtctagaggcttgattttggccttcaaggtctttcctctggctctgccccacttacctacatcctgtctccccgctgtttcttctggaagtggagctgtctgctcccgccctccccacaggtcagaacgtccacctgtgcacccaggttctatgtccaatccaaaatgccaccctccctggttctcttccgcctttttgacttttcttctctttgaaatactagaaatcttgatttagaacccattatattcgattattttattctatttatttagagatgggtcttgccatattgcccagacttgatttgaacgcttggcctcaagtgatcctcctgcctcagcctcctgagtagctgggactataaggcatgcactaccacacccacctttattctattatatcaaatgaacaggaacgacaacagaaatgtctccattctaagaaaacctttgttttctgaaagacttgaatcccgtagagtacagtaaagctccctaaggacagggatggtacaatcttattgtgttggtctttcccattgttctaggcccaaaggaggccttcatttgggatttgtgtaaataacttttcagtgtgttcttgtggagaaaacattctttttttgctgataatatcttatgggtaaattgcttaggggtgaattaacttggattcagaggggaaagaattcttctggtgaacatcacaacctgacttggcccccaagcttccacggcaatttaaatagagaagtactcaacctttaccacctagagagccaggcagtctagaaagtcccaacaatgtggcaacaaaggcagccatctccacagacgttctccagaagcctccataacccaaggtcaataaccagatgggtggttgggtaatgccttagacttttgagtttctttctggagtattttctttcagggaaagatgagaatgcatgccaggaaattttcttcctctaagactgatcaaagaggggttaaaaaaaaagtaaaagcaattgaatgactggaattcatttaggaaaagaataaaggaagggtggtgtcttgggtaggaagggaacaaaatagagcagagccaagagttatagctgcagcctgtgtttatggagtcaggcctggcgtgcctctgcccagctgttctctttccatggtggatgtgaggaagtgggaggaggtcaatgtcctcaaacctcttaccgtagaagagtctaattgtttcaagatgggttccctacatttggatgtgcatttaattaaagttatgtgtgtttgtcttacgaacaaccagactaaataaaatcactgccggcactgtagtatttgaacaaataccacctgggcatgtgtgtgtagatataaggagtgtgtgcatgtgtgtgtgtgtgtgtgtgtgtgtgtgtgtgtgtgtgtgtgtgtgtatgtgtctgtatcattttatgttgcccacttttcagaaacctgatctttttggctatgaaagcaagaatttgtgagagtatttttagatgactctgtggagcttgactataaagtgggagaggcaggccttgaactttagaaatcactataataagggcttctctggctggtggtttgttgcacattctcccttcctgttttctcagtatagggatgtattagatattttacaccagcagttcagtcttggaaatcgagttataccacctgatcagctctctccagttcttctcacgtacagctgccaaattaatttacctaaaaccactacatgttatttgtgcaattgcagcctcctaccttccctgtgaaatcaccctatgtcttttctaagacctgttgatatttgtcagagtgataaactgaagaatgtaattgctatatccactctgctttgagtcatttttgaagttgagataacctcttcttatactttgcaaatatgcttaaatgttgtgtttcattaatctagttgggaggtactccctgggtccaaaatgttccagactttttcataagtaaatacaaaaggagaaaatatgctcctggcctcaagatgcataacacctagtcggaaagacaaggccaatgaaaatactggagaataatcagatgctaacctgtaaaatactgcatgtaaggggttcaggacagaagagctcatgagacactggagatgctaagaaatgcttcctgcctgaagtgtgatatgaggtcggccttgtagaatggaaccagtagtggattatactgtaaccagggtggatacaggcaaatggggttcaggtaacagcatgaacagaggccaccctaaattgattgttttggtttggttttttgagacggagtcttgctcaggctagagtacagtggagtggtttcggctcactgcaacctcctgcttcctgggttcaaactgttctcctgcctcagcctcccacatagctgggattacaggtacccaccaccacacctggctaattttttatttttagtagaggtggtgtttcaccatgttgcccaggctggtctcgagctcctgacctcaagtgatctgcccgccttggcctcccaaagtgctgggattacaggcgtgagccactgcacccggcaatcaccctaaattaaaacaggaacaatgacaccatggccatgctttctttcccttctttaagagctcatcagagcaacttgagttcagggccccactcactagatcattggttctcagcttggctcccattagaatcacctgggcagctttgacaaatgctgaattccacctgcagagattctggtttcagtggtatggcggtactcctggggatggggtttcagaaagcactttaggtgatctgaatggtttgtccaaacagaaccactgagcaggacaggatacagtgagaccctgcatttcctagcccagagcgttccaacaggtgctacatcgtgatacattataggtaggctgaggaaggcccaggaagcacaggtgaattttctctctctctctctctctctctctctctctctcacacacaaatacatccctgtatacatgcaatatatgtatataagacttgtacacaaaatagaattgcaatgaaaggtacatttttgcttaaagtaaattatattaaagtaacaattctcgagttttttttttaaaggaagcagtgttgtatgttaaagctgaacttaatttattgcaaaattgtgctttagaaggaagacttataaccaagattgtggtgcaaaattgatgagaatagatttggaaattagaactacattggttaaaatattggtgatatggtttggctttgtgtccccacccaaatctcatcttgaattgtactcccataattcccatgtgttgtgggagggacctggtgggagataagttgaatcctgggggcagtttcccccatactgttcttgcggtagtgaataagtctcacgagatctgatgattttagtaggggtttttgcttttgcttcttcctcatttttctcttgccgttgctatgtaagaagtgcctttcactttctgccatgattctgaggcctccccagccatgtggaactgtaagtccaattaaacctctttttcttcccagtctcagatatgtctttatcagcagcatgaaaatggactaacatagtaaattggtaccagtagagtggggcattgctgaaaagatacatgaaaatgtggaagtgactttggaactgggtaacaggcagaggctggaacactttggaggactcagaagaagacaggaaaatgtgggaaggtttggaacttcctagagacttgttgaatggctttgcccagaatgctgatagcgatatggacaatagggtccaggctgaggtggtctcagatggagatgagaaacttgttgggaactggagtaaaggtgactcttgttatgttttagcaaagagactggtggcattttgcccctgccctagtgatttgtggaaatttgaacttgagaaagatgatttagggtatctggcagaataaatttctaagtagcaaagcatttaagaggtaacttgggtactgttaaaggcattcagttttataagggaagcaaagcataaaagtttggaaaatttgcagcctgactattagatagaaaagaaaaattcattttctgtggagaaactcaagccagctgcagaaatttgtataagtagcaaggagccttcccaagaccatggggaaaatgtctccaggccatgccagagaccttcacggcagcctctcccaccacaggccaggaggcccaggaggaaaaagtggtttcatgggctgggcccatggtccctgtgctgtgtgcaccctaaggacttggtgccctgtgtcccagctgctccagctgtggctgaaaggggccaacatagaacttgggctgtggcttcagagggtagaagccccaagccttggcagcttccacatgatgttgagcttacaagtatacaaaagtcaagaactgggtttgggaaactacacctggatttcagaagatgtatggaaacacctggatgcccaggcagaagtttgctgcaggggtggggtgcacatggagaacctctgctagggcaatccagaaggaaatgtagggctgggatcccctcacagagtccctactggggtaccagctagtggagctgtgagaagagggccacaatcctccagcccccagaatggtagattcaccaacagcttgcaccattcacctggaaaagctgcagacactcaacaccagcccgtgagagcagctgggagggagcctgtacactgcaaagccacaggggcggagctgcacaagaccatgggagcccacctcttgcatcagtgtgacctggatgtgagacctggaatcaaaggagatcatttcggagctttaaaatttgattgccccgctggatttcagacttgtgtgggccctgtaaccactttgttttggccaatttctcccatttggaatgggtgtaattgcccaatacctgtacccccattgtatctaggaagtaatgagcttgcttttgattttacaggctcctaggtggaagggacttgccttgtctcagatgcgactttggactgtggacttttgggttaatgctgaaatgagttaagactttgggggaactgttgggaaggcatgactgattttgaaatttgaggattgaaatctctccacatgagatttggagggaccaggggcagaatgatatgatttggctctgtgtccctacccaaatctcatctaaaattgtactcccataattcctacatattgtgggggtacccagtgggagataatttgaatcatgggtgtggcttctcccatactgttcttgcagtagtgagtaagtctcacgagatctgatggttttagtaggggtttccacttttgcatcttcgtcatttttctcttgccaccaccaagtaagaagtgcctttcacctcctgccatgattctgaggcctccccagccatgtggaactgtaagtccaattaaacctctttttcttcccagttttgggtatgtctttatcagcagcataaaaacagactaatacaattgctaagatcacagcatttttcattttagagctattttcaaagttggattaagtatattgagaacaaaggattttagacacttaaatgggtaattgttgcccagggtcaaagctctttggctttgcttttcctctctctgttccctccactggctggacctgccccaaatgcagaggtcaggagagcctgggaaacgtagttggctgtgatagacagcagagtaagggagggtggagatggatctcagaacccacagcagcgagcgacctgcactcagccgctatcacactggggctgctggagcgggagattctcatgctgagcagcaaccagcctgctcagaggctggggtacatgagatcattagcgtgtgccagttctttagaagcacttctgctttccctgctcagttcctgccttccaagatgctgtcgctgccaccgccaccgcccccaccacccccaccacccccaccaccccccaccccattccaccaagtctggcgtatcattcaaggcccaatttaccatctctttcctgaagccatttctaaaatttcctgagtgagtgctgtcttgccactgcctctctgaaatcacctaggatttggtgggttttggtttcctacgtacttgtctgatttctgttatcaaattatcaaggcgagagcccaatctttcctactaagaaaggaattgtttcttattaattatgttaatactgaatgtcccaacaccgggctaggttctcatggagagcctctgctagggcagtgcagaagggaaatgtagggctgggaccccctcatagagtccctactggggcaccacctaatggagctgtgagaagagggccaccatcctccagaccccagaatggtagattcaccgacagtttgcaccgttcacctggaaaagctgtagacactcaacactagcccgtgagagcagctgggtgggaggctgtacactgcaaagccacaggggcggagctgcacaagaccatgggagcctacctcttgcatcagtgtgacttggatgtgagggactctgtgagggggtcccaaccctacatttcccttctgcactgccctagcagaggttctccatgagcacctagcccagtgttggggcattcagtattaacataattaataagaaacaattcctttcttattaggaaagattgggctctcgccctgataattcgataacagaaatcagataaatacctaggtaacaaaaaccgtgtcattcattcagccaacagtttattcattcaacttagagatctcgtcaatttccatcaggtgtttcccatctgatgctctcaatcaccctgaagtaaatttacgaagagggaagtggggatcagagaagttctgaaattagtacaaatcgcctgttctacatactggagtctgggggtgtgtcagtgaatacaacatagaaatcatttgccctaatggagatttcataatgcccaagtaccatttccagactatccttatgaagccaaacaatcctgaagaaaaagagcaaatgctctggttaaatgtcgtgggccccgggtgcggtgattcacacctgtaatcccagcactttgggaggccgagacgggcagatcgcttgaggtcagaagttcaagaccagcctggccaacatggtgaaatgccgtctgtactaaaaatacaaaaattagctggatgtgtagatgcacgcttgtaatcccagctactcgagaggctgaggcacatgaatcgcttgaacctgggaggtggaggttgcagcgagccgagatggtgccactgcactccagcttggatgacagagtgagacccagtctcaaaaaaaaaaaaaggatgaggggtggttcctcagtccttgagtatgtgatcttccatctcagtgtcctctccctcctgttcctcagaagtagtactgctgattctattaattagcacatcacaggcacttaaaggatagtaatcctgtttttttttatagcattcattttttacatgccagtcatttattataccttttgagcagggaaaggcaacaaatgtttccatctcaaactttctgctacatcagttcctaatagaagcagtgatcagctattgcagctgcttttgaaatcactgaaagccgggcagcccatcacttttctgctgaaaagatttgtctctgggccaatagagttaattctacagagtagaatttagtttttcaaggcttttataactaaagttataagatagtgctgccttccttaccctcagtataatctgaaatgggaatccagaccttttaatcctattgttaggattggcctgctgaaatattctgtgtgcgctaagcctcatttgaactcagtgacctagaatttagatattgcagcaaatgagtgccatagaacacttggtaggctggaatggaatcctagacttttagaggagaaaaggcttagtaattctgtagatcagatgagtacactgaagtaagtgaatttgagtggctttaaattgtcccatagcttggggttggcagagttgagaccaaaatcaaggactaatgacttttagtttgtatatattttttaagacagactcactcggtagcccaggctggagtgcagtggtgtgatctcagcctcactgtaacctctgcctcctggattcaagcaattctcatgcctcagcctcacgagtagctgggatttcaggcatgtgccacaatacttagctaatttttgtattttttagtagagatgtgggtttcaccatgttggccaggctggtcttaaactcctcacctcaagtgatccacctgccttggcctccccaagtgctaggattacagggatgagccactgcgctcagctccagtttatacttctttctactgtgccagtggtcctaaaaatcgaatgtgtataagagtcatctcccgggtaggggagcttgcagggcttctcccctggcgtcaggacaggatcccgacattgcgcatgtccagcccattccccggtgatgcggatgctgctggcccggaaaccatactttgagaaccactgcacgacactgttgggaagcaaaatcgagctcatgtcataaaggacacagctttctctcctaagaatgtaaattacaacctgagaaaaatatctgtttatgccagtatataggtgtgccttgacgtgagaaaactcaaaaagttcaggctaaaaaagcaaattcaaaactaaagatttacatgacctaaaaattaattctgtgtgctaggaaaataaagtctctgccttcatggtacacacagtctaatagggcagacagacaataaacagatacctctttactataatgtcaaatacattcaagaaaataaagaagacattggactgtgcgaataaacctggagaaggaagccctctcagcagattcctgaatggagtgagggattcagctgcgtacttttctgcaggaatggctctcctggtggaaggaactgcaaggcaaaggccctgaggtggaaggacgcttgatgtgctcaggaaacagcagagagcccagtgaatagggagagtcctagaaggtaggtcaaaagggagccaggacactgcgtgtagagccttgtatgctacaggaaggaatttacctaattttaaaaatatgatctaatattaaaaatattttaatcctgttttttaaaatattatttaatatcattagtttttttctctccagaaagacatcatataaaaagagtacaataaaaatataagcagtttgaggtggtcaggatacaaggctcctgttgcagaactgagatgctgaggctctcaagggattgtgggaaagttgttatgtaccatgaagtatttgagtctcttcctgatcacagtcactcctttcttggaaatgaagattttttaaaaggaaagaagggagtcgtgggtgtattagggagaaaatacccttggggcagggcagtgatctttgacacatttcctaacctctctgagcatcagtgcttccatctgtgaaatgaagatgttggaccagttattcttctgcaacgtcctaacactctggtattctggggtgtggctaatgctggtagggtcgtgtatggtcatttctttgtgtgagcgttggtggcttgcttcatttggggaagtgaatattggttgcagaggcaatggaaggaactgatcatggtaacagacgccctggtggtgaagaaggcaagaaagactggtttgagagaaattttcagtgaatgaatatgcctgagaaattgaagtcttgtaaaagtagccagtgagtttgtatttcctcccaatatctatttcagccggtaatcagaaaccagaataattgtgtttgttattattctgaaagatagaaggagctttctgggttataacttaagagtttttgaatagcaacagttcaagcctcctttggcttaagagccttgagaattatcccagccttgtcccatggtatttattttgggaaggtttgcacaacttgttgagtggtttggtaggaaatgaaacctctcttgcaggctctgtttgcttctgtgcttgggttatatccccatctatttgagagccctggcaaccctaatctgtcccactgagaacactgtttgcttttttgccaaatacttccagattttagtttaaactttgatttttaaagactagcacaaccagtaggttatattacatagggtgtcactgttttttgttttttgtttttttgggacagggtcttgctctgttgcccacgttggagtgcagtggcacgatcatagctcactgcagcctcaacctctcaacctcctaggcttaagtgatcctccctcctcaccctctcaagtaggtgggactataggtacgtggcacctcacctggctaatttatttttgtactttttgtagagatggggtttcaccatgttgcccaggcttgtcttgaactcctgagctcaggtgatccacttgcctcagcctcccaaagtgctgggattacaggcatgagccactgcccccagttgtgtgcatagtgatttaacaaatggtgccgtttctcagtaaaatgataaagaaccagctctaattgcagaatgcctgggttagaatccagaaattacttgtaatttctgggactttgggcaagttattaagttagtgcaaaagtgattgtggtttttgccatacttttaatggcagaaaccacagttacctttgcactaacctaacagcaaacttctctgcctcagttttcctcgtctgttaaatgggagtaataaagtttactccaacccctcacaggcttgttgtgaggatgaaatgagttaaaacttaagatgttcctagagtgtaatgtttccatagagtacctgctattattattgatgttgttgttattcaactgcctcagattggtttagaaatgagggaactgaagttaagcactgtagcaacaaggcagctgaccagccttgtcacctgggcctcctgaatcaccctccagcctcctggcatgctccctattgtgcctccgttggtccctccatcattcattcaggctgccacccggctgctatttgaggctgctagggacatcagtgagttgactttctcttcaggaaaaagaaaatgagagcgagagaaagagagtgcactacaaaactcttattagcactgaaaccttggaatctttccaagtgacaagagtagggacattccaaatatcaataagcagcaaagggatcaaagtcattttgtgtaaatcttcaggctgcttatttgtgccattttgctacattgctgctgaagggccccagctgagttttataagcaaatctaaacatttcctattgtaatgaaatgtaaaacagcagattcctttatttgtggaacatatccataaaattgtttttatggctaagtttgttttcaaacaaactttgaaacaatgggtgccttggcaaaaaacgatggtgtgaccctcttcaataaatagtgtgggaaaattggatatccatatgtagaagaatgaaattggaccctcctctctccctatatacaaatatcaactcacaatggattcaagacttaaatgtaagacctgaaactgtaaaactaccagaataaaacataggggaaacacttcaaaacattggtctaggcaaagatttcattgctaagacctcaaaagcgtagacagctataacaaaaatagacaaatcggattatattaaactaaaaagttttggcacagcaaaggaaagaacaaagtgaagagacaacctgtcgaatgagagaaaaatatttgcaaactattcatcaaggaactaatatccggaatacacaaggaactcaaataacttgaccatcaaaaaataaataatcccattaaaaagtgggctaaggacatgaatagatatttctcaaaaaaagacatacaaatggccacagctatatgaaaaaaaatactcaacatcactaagcatcagggaaatgcaaatcaaaaccacaatgagatgttatcctaccccagttagaatgactattattacaaaggaaaaataacagattctggaaggatgcagagaaaagaaaactcatacactgttggtgggaatgtaaattggttaaactactgtgaaaaataaaatggagcttcctcaaaaaattagaactactgtacatccagcacttccacaactgggtgtttatccaaaggaacagaaattgtgaagtcctagctaaagcaatcagacaagagaaagaaacagcatccaaattggaaaggaaaaagccaagttattcttgtttgcagatgatatgattttatattggaaaaaaaccaaagactccaccacaaaactattagaactgataaacaagcctgggcgcagtggcccacatctgtaatcccagcagtttgggaggctgaggtgggcagatcatttgaggtcaggagtttgagaccagcctggccaacatggtgaaatcctgtgtctacttaaaaaaaaaaaaaatagccagacattgtggcacctcccatagcaggcactgtgcctgtcatcccagctacttgggaggctgaggaaggagaatctcttgaacccgagaggcagaggttgcagtgagccgagattgcaccattgccctctagccttggtgacagagtgagactctgcacaaaaataaacaaacaaacaaaaaaactgataagcaagttcagcaaagttgcaggatacaaaatcaacataaaaaatcagtagcatttctatatgccaacagcaaaccatctgaaaaaaagtgaatcaagtaattctatttacactagccacaaataaaataaaatacctagaaataaagttaaccaaagaaataaaagatctctacaatgaaaactataaaacattgattaaagaaattgaagaggacacacacaaaaatggaaacattctttaacaatattgattcttccaaccatgaacatggaagaatgtccatactatccaagcagtctacagattcaatgcaatccctatcaaaataccaatgacatttttcacagaaatagaaaaaaaaaaaacctaaagttcatatgaacccacaaaagacccagaacagcaaagctatcctgagcaaaaagagcaaaactggaaaaatcccattacctgacttcaaattatactacagagctatagtaactaaaacagcatggtactggcatgaaaacagatacacagaccaatagagcggaacagagaacccagaaacaaatccatacatctacagtaaactcatttttgacaaaggtgccaagaacatacattgggaaaaggacacactcttcagtaaatggtggtgggaaaactggatctccatatatagaagaatgaaactagacccctatctcttgccatatacaaaaaccaaaatggattaaagatttaaatctaagacctcaaactatgaaactactataagaaaacatcgaggaaactctgtagggcgttgggttgggcaaagatttcttgagtaatacctgacaagcacaaacaaccaaaacaaaaatggacaaatggggatcatatcaagataaaaagcttctgcacagcaaaagaaatgatcagcaaagagataacccacagaatgggagaaaatatttgcaagctacccatctgacaagggattaacaaccagtatataaggagctcaaacaattctatagggaaaaaaatccaataatctgatttaaaaatgggcaaaaggtacagttgcagtggctcatgcctgtaatcccagcactttgggaggtcaaggtgagaggattgctttagcctacgagttcaagaccagcctgggcaacatgggagccctcatctctatttaaaatgaatgaatgaatgggcaaaaagatctgaaccgacacttcccaaaagacatacaaatggcaaacaggtgtacgaaaacatgctgaacatcattgatcattagagaaatccagatcaaaactacaatgagctaactactatgagctattgttgcaccccagttaaaatggctgacatccaaaagacaggcaataacaaatgttggcaaggatatggggaaaagggaaccctcatacactgttggggagaatgtaaattagtgtaaccattatggagaacggtttggaggttcctcaaaaaactaaaaatagaattaccatatgatacagcaatcccactgctaggtatatacccaaaagaatggaaattgctatattgaaaagatatctgcactctcatgtttattgtagcattattctcagtagccattatttggaagcaacctaagtgtccatcatcagatgaatggataaagaaaatgtaggacatatacacaatggagtactgttcagccataaaaaaagaatgagatcctgtcatttgcaacaacgtggttggaactggaggtcattatgttaactgaactaagccaggcacagaaaaacaaactgcctattctcacttatttgtgggagctagaaattaaactcatggagataagagcagaatgatggttaccacaggatgggaagggtagtgggttgggggaaagtggggaggttaatgggtataaaaatatagttagatattaatagaataaataagatctcgtatttgatagcaccacagaatgagtatagtcaacaataattattatacattttaaaatagctgaaagagtataattgagttgttggtaacacaaagaaaggataaatgcttgaagtggaggatacccccatttaccctgatgtgattattcacattgtatacctatattaaaatatcttggctgggcacagtgactcacacctgtaatcccagcactttggaaggctgaggcagatggttcactggagcccaggagttcaaggccagcctgggcaacatggcaaaaacctgtctctacaaagaaatagaaaaattagatgggcatggtagtgtgtatctgtagttgcaactattcgggagactgagatgggagaatcgcttgagccagggagattgaggctgtggtgagccaagattgcaccactgcactccagcctgggtgacagagtgagaccctttattaaaaaaacccaccaaaactcatgtgccccataaatatatatacctactatcttcccataaaaattaaaaacaaggaaaagagctgggtgcagtggctcatgcctgtaatcccagcactttgggaagccgaggtgggaggatcacttgaggtcagaagttcgagaccagcctggccaacatggtgaaaccccatctctactaaaaaaatacaaaaattagccaggcatagtggcatgcacccgtaataccagcaggaggctgaggcaggagaatcgcttgaacccaggaggcagaagttgccatgagccaagattgcaccattgcactccagcctgggcaacagaatgatacactatctcaagagacaacaacaacaacaagaaggaattcagtatatcaaaaggatatctgcacttgcattatttacaattcacaatagcaaagatatgcagtcaacccaagtgtcaatcaatggaccaataaatagataaagaaaatgtggtaccatatacacaatggaatactatttggccataaaaagaatgaaaccctgtcatttgcagcaacatagatggaactgtgggttattatgttaagtgaaataagacaggaacagaaagacagatgccacatgttctcactaacatgtgggaaccaaaaaaacaaacaaaaacaacaaaaacctgatctcagctgagcgtggtggctcacacctgtaatcccaacactttgggagactgaggcaggtggatcttctgaggtcaggagtttgagaccagcctgaccaacatggtgaaactctgtctctactaaaaatacaaaattagctgggcttggtggttcatacctgtaatcccagctactcaggaggctgaggcaggagaatcgcttgaacccgggaggcagagatggcagtgagccgagatcgtgctattgcactccagcctgggcaacagagcgagactccgtctcaaaaaaacaaaacaaaacaaaaaaacctgatctcatgaagacagagaatagaatgatagatattagagcatgggacaggtgtgtggtgtgtgtggggggggtgtggataaagagagtagaaacatagttagagctacaaatgaataaaccccactattagatagactagggtgactatagttagcaacaatgtcttgtctattgtaaagtatgtagaagagaggactttaaatgttacccatacatggaaatgataaatattcaaggtgatggatatcccaaatgctctgacctgaattataatctatgcatgtaacaaatattcacatgtactccataataagtaaaatattttgtgtccaaaaaaattttaaacatatttttaaaaggaaaaaatgacagtgtgaagtttttaacttattctatgtttagtgtagtgctactcaaacttggatgtgtacatggaaccagctcgggatcttgtaaatgcagcttttgattcagtagatttggagtggtgcctgagagtctgcatttctaacatgctcctgttccccaggccactctttaagttagccaagacttaggctgtcaaagtgttatttcagctacatcagaatctggatagtaccctggccgggcatggtggctcacgcctgtaatcccaacactttgggaggctgagatgggaggattgctagagtccaggagttggagaatctggttagtacctgctatcccaggtagtgaccagcatccctgtcactgggcttgagttaggaagtagataaaatgtttttatactcttcgcatctccacagctccactgcattcttgacctatctaaatgaagatgtaggcgggtttggtggctcacacctgtaaccccagtttgggagaatcgcttgaggccaggaatttgagaccaggctgggcaacacagtgagaccccgtttctgtgatttttttttttttaaagaaaggaaaaaaaaaaactatcttaatggtataaatatattggcatatagacttttgaatgacatttcgtgtctttgaaaggaaagcccacacttcttaatccgtaactcattttatgaggccagcatcatcctgataccaaagcctggcagagacacaacaaaaaaagagaattttagaccaatatccctgatgaacatcgatgcaaaaatcctcagtaaaatactggcaaaccgaatacagcaacacatcaaaaagcttatccaccaagatcaagtgggcttcatccctgggatgcaaggctggttcaacatacacaaatcaataaatgtaatccatcatataaacagaaccaaggacaaaaaccacatgattatctcaatagatgcagaaaaggcctttgaaaaaatcaacagcccttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtattcagttaagaaaagaggaagtcaaattgtccctgtttgcagatgacatgattgtatatctagaaaaccccatcgtctcagcccaaaatctccttaagctgataagcaacttcagcaaagtctcaggatacaaaatcaatgtgcaaaaatcacaagcattcttatataccaataacagacagagagccaaaccatgagtgaactcccattcacaattgcttcaaagagaataaaatacctaggaatccaacttacaagggatgtgaaggacctcttcaaggagaattacaaaccactactcaacgaaataaaagaggacacaaacaaatggaagaacgttccatgctggtggataggaagaatcaatatcgtgaaaatggccatactgcccaaggtaatttatagagtcattgccatccccatcaagctaccaatgactttcttcacagaattggaaaaaaactactttaaagttcataaggaaccaaaaaagagcctgcattgccaagtcaatcctaagccaaaaaaacaaagctggaggcatcacactacctgacttcaaactatactacaagactaccataaccaaaacagcacagtactggtaccaaaacaagaggtataataccaatggaacagaacagagccctcagaaataatactacacatctacaaccatctgatctttgacaaacctgacaaaaacaagaaatggggaaaggattccctatttaataaatggtgctgggaaaactggctagccatatgtagaaagctgaaactggatcccatccttacaccctatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggattaattaaactaaagagcttctgcacagcaaaagaaactaccatcagagtgaacaggtaacctacagaatgggaaaaaatttttgcaatgtactcatctgacaaagggctaatatccagaatctacaaagaactcaaacaaatttacaagaaaaaaacaaacagccccatcaaaaagtgggcaaaggacatgaacagacacttctcaaaagaagacatttatgcggccaacagacacatgaaaaaatgctcatcatcactggccatcagagaaatgcaaatcaaaaccataatgagataccatctcacaccagttagaatggcaatcattaaaaagtcaggaaacaggtgctggagaggatgtggagaaacaggaacacttttacactgttggtgggactgtaaactagttcaaccattgtggaagacagtgtggtgattcctcaaggatctagaactagaaataccatttgacccagccatcgcattactgggtatatacccaaaggaatataaattatgctgctataaagtcacatgcacacgtatgtttattgcggcactattcacaatagcaaagacttggaaccaacccaaatgtccataaatgatagactggattaagaaaatgtggcacatatacaccatggaatactatgcagtcataaaaaaggatgagttcatgtcctttgtagggacatggatgaagctggaaaccatcattctcagcaaactatcacaaggacaaaaaaaaccaagcaccgcatgttctcacttataggtgggaatcgaacaatgagaacacttggacacaggaaggggaacatcacacaccggggtctgtcgtggggtggggggaggggggagggatagcattaggcgatatacctaatgtaaatgacgagttaatgggtgcagcacaccaacgtggcacatgtatacatatgtaacaaaccttgtgcacatgtaccctagaacttaaagtataatttaaaaaaataataaaaaaagtaaaagcttatgtagagacaaagctgaaggatgtttctaatttgttttgcattcactctgttatattcctttaagtgcagatttcagctgataattaaccaaaagaactacctcagagggctcactgagaaagatctaaacgttttacatctggacatttaggttgtaattcaaattctcatctcttaaattttgcagaagataataaggcttggctaggatgtggagaaattggagctctcatgaattgctgatagagatgttaaatggtgcagcagctttagaaaacaggttagcagttcatcagaaagttcaacgtagttgccatatgactgagcaattccactcctcggtatgtacccattagtactgaaaaatgtgtctacacttgctgagaccagcttgatcatggagaccctaacccagcagcactagaggaattaaagacacacacacagaaatacagagtgtggagtgggaaatcaggggtctcacagccttcagagctgagagcctcaaacagagatttacccacatatttattgacagcaagccagtcatgagatttactaaaagtattccttatgggaaatatagggatgggcggaaataaagggatgggtctgggtagttatgtgcagcaggaatatgtccttaagccacagatcactcatgctattgtttgtggttcaggaatgcctttaagcggttttccaccctgggtgggccaggtgttccttgcccttatttcggtaaacccacaaccttcagcgtgggtgtcatggccatcacgaacatgtcacagtgctgcagagattttgtttatggctagttttggggccagtttatggccagatttgggggcctgttcccaacatgtcccccttgtctttttttcttttttttcaaagtgataaaagcaaaggcagcattatcacggtgagctacttctcccaggagtcaggttccgcatctgcagactatacagagacaacacagattaaaagcacagtcatcattgaaatcacagagcttttaagtgtttttatgcattttaatgggttactagctcctaatgtgtctgcagctccttcaagcactccagttcctggcattaagttcaggtgtgcctgggatgctttaaatatttgttcttttagttttgcaatatccaaagacaaatttgtagagtgtccttctagatgcttttttattctttcccaaaatttgatcttattaacagctattaatagtgtctacaaatccttatgtttagctcctacagtgggccatatcatttgaggttgaggtgccactatacctccatgtttccagataataggaacttttgccatattccttatcatttctaccatctgaccattttgttcagaccagctgaacatagtgtggccatgacacacagactgagaggtgcaattcaagctaaacatctccataggggaataatcaatgatgattccacaggaatcgttgcacagcatgtctgcctgttctgcaatgcaatcttcccaaacaggtacgttcattatttctggccaggtccaattctgtttacaaataggtttttgagggtagtatgcctcaattataggagcagatttataatggtaaatactgagatcagaaagcatgtgtaactgtgtcagatcgattatatccaggcattattgccagccaagattgataaatatgcccaataagtataattgttctctgtgtcagcccttgctaaaggaatactcaaggcagtggtgatcactgctatcgcagctaccattaaattactcattgtgactggttgtcccgctttcctctggttttcttctgccatttgtgacagcttcttgttctgtcctcaagtaggtggctgtgttcaatgggtgttgctcatgacagttggggtcctcctcagcgtcagtcttgacatggctgcaaccggggggtcctcgggatcctcctggtatctcttcctcggcatctggctcatgataaggtttcaggtatcttgatggtatccaaattggctgctggttctggcctggagaaacacaagcataacctctaccccaagttattattttacctatttcccaagtttttgttattggatttctcccaccaaaccagttgttctgcttctgtctttgcagctggtttctgtagatgctgttcagctgctgacagcatctggcctttaggcaggctcaaaaaattttaagtcaataatacgagattcaattgcatatgtggtgttctgtactccctgttttccccccttagctcttgcaactgctgtttcagggagagattcattctttccactatggcttgtccttgagaattatatgggatgccagtaatgtgtttaatattccatatagagaaaaatgtagctagagcttggctagtatagcctggggcattatctgttttaatagaagctggaatgcccatcaccgcaaaacactgcaaaaggtgacgtttaacacaggcagaagactctcctgattggcatgtagcccagacaaagtgagaaaaggtgtccacacatacatgtacataagctagtctcccaaatgagggaacatgtgtgacatccatttgccaaagagaattaggttccaatcctcgaggattaactcctcctggaaaagatgcggaatgcaccatttggcaagttgggcgtcgctggataatagctttagcttctttcatcattttcaattaattgtgtgtaatgaaccacatatgaagaatcagaaatcacattaatgggcatattaaaagcagtcaatacctcaattacagctacaagctctgctttttgagctgaagtatagggtgtctggaaaactttatcttttgagccagaataaaaagctttaccattactagacccatctgtaaagacattttcagcaccttcaattggtttaaatttagttatactagggaggatccaattagttaatttcaaaaattgaaacaattttgtttaggaaaatgattattgagaatacccacaaagtcagctaaatgggtttgctgagtaagactatttataaaagcttgctgtatttgtgcctttgtgagagggacagtaatttttccaggatcatatccatgtaatttaacaatctgagttctcccatttcctatcatagtagtgatttgatccaaataaggagttagagtccatgaattagtatgtggaagaaaaaaccattctactaagtcctgctcatggacaataacaccagtaggtgaatgctgagttggaaaaattagcaaatctagagccttctctggatctattctatttatttgagctttatagacttgcttttcgattagctgcagctctggctcagcttcttttattaattgccaagggctagtgagactaggatctcctctaagaatagaaaatagattactcatggcataggtaggaatgcttagagcaggtcgtatccaattaatgtcccctagtaatttttgaaagtcatttaatgttttcaattgatccctacctatggctactttctgtggcacaattgtagtgtcatttactaaagtctccataggttgtataactgaattaatggctcataaatcagttaacattctccatttaccttattgtttcttaataacaaagactggagaatttcagggggaaaatgttggagctatgtgtccttttcctaattgttcattaacgaagtcctctaaagcctccagtttctctttacttagcggccactgttctatcaaaattggcttatcttttaaccattttaaaggtataggttctggaggcttaacaatggccaccatcaaaaatgatatcctaaaccttggtgggaactttgtctttctgcttgaagtggttccttcaaaccttgcaaattttttcctagtcccataccagggacataccccgtttcatgcatcatatgttgactttgagggctgtataattgttctggaatcagaacttgtactccccattgttgtaataaatctcttcccataaatttataggtacaggagttataattggttgaatagtcccaggttgtccattgggcccttcacagtgcaaaatatgactactttgatatacttcaggggttaccaactccagctatgttaaattgaatgggttgaattggtcacgtggacggccagtgctgtagagaagtgattgaaatgtccactcctgtatctaccaaacctttaaatttctttccctgaatagttatttcacaggtaggatgtttatcagtaattttattcacccaataagctgctttgccttctttatttgtgcttccaaatcctcctgttcgtttaatttcacttttccccattcccacatacagcacaatcaggagctgtactatatgctctcctggctctgctttccagggaacagaagtagataaaacaatttgagttgccccattgtaatcagaatcagtgactcctgtttgtatttgtaccccttttaaatgtaaactagaccttcctagaagtaatcctatcatccccgctggcaagggtccacagactcctgttgggaccttttgcagggttcccgaggcagaaggctcacagcttttgtgcagcatacatctgtggcactaccatctgtggcaggggacagacattgtaaggggtgagggaacggcctaagccagaaatgccccggtttggaacggggcccgggatgggcccctcatgccatttcccaaatttaaaaggaaaaggctcaaatgtagctataatattgccctgttgatctgggggggtgtatcctaacagggaactgccaagcctctaaatcaccctcttgtctagcttgctgaattcctgcctgaatagaactgagagcagtcgctcaaggtgctgctcgaacagtcactggggcaactactttttgcccagtgtcctctggaaaagaaagatctggagggtcaggccgttctttttcttcaaaataagaagggggtgcagaagagtagggatgaacttcttcctcctttgccactttagctttagctggcaaacaaaccggctctgttacttcttctgttacttcattatactctcctccttcctcatcatttgtgaaaaggttccaaggtggaacgaaccagagcccacacttgtccagttgttaccctgatgcttccgagctccccttcctactcaccactgggattgcttaaaagagtacttgggtgtcctccgcttggttccacattttccaactgttgctctggcgacccttcgacctgggtttgagcctccacgttgggcaccacttgccgagaccagctcggtcgtggagaccctaacccagcagtgctagaggacttaaagacacacacacagaaatacagaccgtggagtgggaaatcaggggtctcacagccttcagagctgagagccttgaacagagatttacccacatatttattgacagcaagctagtcataagatttactaaaagtattccttatgggaaataaagggatggcctgaaacaaagggatgggctcttgttagttatctgcatcaggaacatgtccttaagtgcagatcgctcatgctattgtttgtggttcaggaacgtctttaagcggttttccgccctgggtaggccaggtgttccttaccctcattccggtaaaaccacagccttcagcatgggtgtcatggccatcacgaacatgtcacagtgctgcagagattttatcagttttggggccagtttatggccagatttgggggcctgttcccaacagccatatgactcagcaattctgctcctcagtatgtacccattagtattaaaaaatgtgtctacacaaccactcgtacatgaatggtggggcatgatagtaatccccagtaaaaacaactgaaatgtccaacagacaatgaatagataaacaaaatgcagcatatccatacaatttattattaaggaaggaatgaagtactaatgcatactgcaacatggatgaaccttgaaaacatgctaaatgagagaagccagacacaaaggagcatgtattatacaatcccatctttaaaaggaaatgtccagaataggcaaatccatagaaactggaagtagatttgtggtttcctgggagttggggaagtagggaaatagggagtgactgctaatcgatacagggatttttttgaggaggaggtgacgaaaatattctagaattaggtaatgatgttgttgccagctttgtgaatatactaaaagcaacttaattgtgcatttttaaaatggtgatttttatggtttgtggattataactcaataaaaagattaaattctcatttattttgttttttggtctttgtttaatttgtttttatagaattatgtttttagtatatacattgcctttaatggtttattacagggtttcttaacctggatactactgattttttttttttttttttttttttttttttttttttttttgagacagggtctcaccgtcacccaggctagagtgcagtggtggtgtgatcacagctcactgtagcgtctaccttccaggctcatgctatccttccgccttagcatcccgagtagttgggactacaagcatgtgctaccacacctggctaattttttaaatttttttgtaaagacaggatttggccatattgttcaggctggtcttgaactcctgggctcaagcaatctgccttcctccgcctcccaaagtgctgggattgcaggtgtgagccaccacacctagcccactactgatattttggtttggatagataattcatagttgtggggacctgtcttgtgcattgtagagatggtcagcagcatctctggcctctgcagattagatgccaatagaatctccctcctctccttcttccctagtccatgataaaaaatgtctccagacattgccaaatgttccaaggatggggtgcaaaagtacgcccagttgaaaccattggttctctttagtcttcctgctaaaagccgagctccataaaggcaggaactttgttttattcattattgtttccttagaaccatgtctcacacatagataccctaatattatagtaaatatatgaatgagtacttctggctatagaagtagcagtacttgtaaaaaatatataactatagaaatatcaaaatgataccatacttgagttaattccaatgccttaggattaacattgttaagaataccatgtttggctgggcatggtggctcacgcctgtaatcccagcactttgggaggctgagacgggtggatcacttgaggtcaggagttcgagaccagcctagccaacatggtgaaaccccgtctctgcaaaaacacaaaaattagccaggcatggtggcacatacctgtaatcccggctacttgggaggctgaggcacgagaatcgcttgaactcaggaagtggaagttgcagtgagccgagattgagtcactatactctagcctgggcgacagagtgagactgcatctcaaaaaagaaaaaaactatgtttaaagaggacaagtaagttttatcaacttactgccctggccccctaccccatcctaatctgtaggctctttttatttagagttgccagctatccaggacacaggccatgagagggcaccagtcatgctcttaatgagtcatgtgctggccttgggcaccatctgcttcctaagcctgagatgaccccacagatgccttcctgcctgccatctagatagagcggccccagcccttgaggatgctgacatttatcagtcactgcatacataagaagggaaatctacccaccatcatctacatatcaggttctgtcactgactggtcatgtttttctacccaacagaacctaactttccacttgagtatcttattcaaagttggctatgcttctggttcacattccgaggctaaatgttaatggcttgctgctgccaaaccctgctttggggatgatcacttccgtgagaggtgccaaaacgttagctgctcaagtgtgggcgttagacaaggctggtcttggatggtttattgtggtttgctacttgtctacaactttgttcccaagtttccattcaatggaaacacacatagcttttgcccctcctttcccctctcttcgttttttaagcagtggtggttctgatttaacttctgctacttctcctttctgaacattgaaacaatcccttttatcaagcaacatgtcacagactctgtgccatgctttgtgttggtgaggatacaataattggtggcatgttttgagtgtttatttcacgcttcaccctttatgaagtgcttttacacataattcttgtattcgtcaacaacccattttactgatgtggaaactgagatagagcctaataagtaaggaagcatagattcaaacccagatagtctgagcccttaaggttaccagcactacctccttaatatcctgcttcttgttatactttaccatctgactagatgtttttgtccctcttctaagctttgataaagctataaggttggaagctttaatttttcaaaatcacagacattaggaataagaaccagagaccctgaagttaaaacattaagacttgatatccaaattagatacagaaaagaagttcatagtgtggttttcccaccctgctcttctgtacattggtgattaataactgcttctaggcatagggtgggggaatgagacaaaaggaggcagggctcctatttctaggagcttcctttctctctgaggggaataaactgagtgagcctgctctttcagttggttgtttgagtgtaagatacccagattgaatacataagtgctttcataatacacaggagatgggttgttagggaactgccaacaaagtcatttcgttgtctgatttgtgcctatttcttctgcatttgcacagctttcataaaaacaggacaaagctaaaagagtgcactgaccattttggttttcttttatgtgataactcattgagcaaactctttcaggttatagatgctatgttccaagttaagtagtaaaatgattttctgactaaaattatggcaatgattcactactttattatataaaaagtaagatattttaaagagttagagcaagcaatagagatcaaaatgactttctagatagttattctttcttattttgcattttttttctaaacctagcctgcacattttttaatagtagaatatggtacaaggtattatatatataagatgtatagtgtgtatatgggtgtgtgtgtgtgtatatatacatatatatatatatatagtatatagtatagaatatttagtaaattttattttacttctaattcattactgaagaaccctcattattacacaggatatgcctacagaacttattgagaatttccccattgtagaccacaattctagcatatacttcaatgagtaatatgtcagtgactctgataaaattaagtaattccattagagtctgcgtcaagtagaatgaatgaaacctcagcatgatgggagggttcaggagctgatacatttttgtattttctgagagtcttaattacattttacaaattacatggatggttgggttggtaagaagtatgtgaattttgatggctttttaattttgtttttgtagcagttgtttgtatccatgtgtgttggtgcccatatgtattgtttggggtttggttattctctcaaaaccaagttaccgtaaaaagtttgaattttaatatttctttattgagtagtgggaccgtctagactgtgtgctggctcttactaaagtcatttgtttttcttacccgtggagaggtgtattcttgaaccctttaaacgggtctctactttggcctaagaccatattagaaaacttttttgaagtcacttattatatgccatataattaaaaagttatatggtatattctcccattacattttagccacaatgcccgtatattaaataagcaaacaaactatatgtggcaattaaaacttaaaaaaaaaagcctgaattggctcttagaaatatttaatcaagtagtatccactagaacttaacatttcatcctgtggatcatcacacacaaaatacccaaccctgctgtcattcagggtcctagcaggaacaggtagcatcaaataggataattgatgagagcttaagaaaggaactatttacaaatatgtggccagattaggggaaaccagtaaggttgggaatgccgcccaggattctaacaagagtgagaatctatttctactcttgacctaaaggggcaaggagggaaagctgcagctgtggctgtgggagagccggcctgcaaagctgtggccttcacagaggaagacagccactgccgaggtatggctagggaaggaggggaggagatgatgccctgaaccccatcgtcattctcactgggcaagcccaaccaggagccaaagcacagggcagcccattggatgcagttcattaggggactgcctctgggtagagggcagacctggaggggcagagagaatgcacagcgctagtgactatctcctcaagagcagactcacagactgtgtttcctggctttacttccatttcccagaagcgcatacccagtgagaggaatgatgatacacagtggagctccttatctggagagtctggagaaatgaatcatacacttctagctaaaatgatcagtttttccctttcctgcttttcttttcttttttcttttttttttttttttgagacggagtctctctctgtcgcccaggctggagtgcagtggtgcaatcttggctcactgcaagctccgcctccctggttcacaccattctcctctctcagcctcccgagtagatgggactacaggtgcccgacaccacacctggctaatttttttgtatttttagtacagacggggtttcactgtgttagccaggatggtctcgatctcctgacctcgtgatccgcccacctcggcctcccaaagtgctgggattacaggcgtaagccactgtgcctggcccctttcctgcttttcaagatcattcctatgcctgtgtgttttagaaagcagagcagaagcttttgtgtgacatcagaacacaacaaacacctggatgttagaattttcttgcagaaacaccttgaaataatgtttaactgaatcacatgaactagcaatggttttactagcaaaaaatatggtattagatgcatgcagtgtaaaatcaaagccaagactatctatccttatagaatgagctgtttctagttatttatatttgtttgtactttgtctgttttatctgtaaaagcagtaagtgatgcagctttaggtaaaatacatgaagagaaaataatgaatttggaaaattctgtcattctgttttctcagcaggacacaagcattctgcagcataatagttggaaagtccccagaatagagaaaaaaagtcacttattgatctaaactctcaatgggagagggaggacaaaataaaatctctcgctatcacacgatttattaaagcgtatgcaatgaagctttaactaactggatccctgaaaatgtatttcagccatcaaatatataaatttaggttgatatcagggattttcttttacaaagctatgtctaagaaaattcttttgtgggactggaaattgagcgcagcttcctaacacctcacttctgccttgtattgatcgtgggccttccaagtgatgatcctgaaactctgcatttcccaaatcatttgtagaatatcataacacgttcatcagactgcatttaccaatgtacaggagtggcctacaataatgcttcactgtcagatggtctgcagttccagccacccataaaagactatgtaatccagaggtaatccaagaagcctcagagtagaaaaaaataaaaatatcacatggggaagggggttagtaactaaaaggggcatatggagaacttctggggtgctagcaggagggttttggggtctctgaccacattctgtttcctgattagtatgaaggcaaaatatttcagttgcaaaaatttagcaagctgtacaattatatgtgtagctttctttacatgttatatttcaatcaaaagttaaatgtagataaatataattgattgattgattgatttgggtgtgtgtatatgcacatgggcagtagacacttcctggtatggttatttttagaatgggatatggctactctcttatttagatacttttgatttagttttcctcttgtcataggagatggcatagtgaacagcttagaaacaaacacaaagacattaagaagctaaatattaatcaattttagggcttagtaatccaggggcatttcaattagtatccctaaacatgcaattcaataattgaggagactccatattcccaagagcaattaattatgttacatgcactattactaaggctgggaaacttttagaaaccttccaccaagattaataaaagacttactgcttaaaggtggacttattgtaaaatgaagctattccaacaatgttgagaagtggaggaattattgcactgccagtatagtttggttaagctatattgaatgaggaattccatttaaacaagtcactatggccaggcatggtggctcatgcctgtaatcgcagcactttgggagactgaggtgtgtggatcacatgaggtcaggagtttgagaccagcctgggtaacatggtgaaaccccgtctctactaaaaatacaaaaatcaactgggtgtggtggcacatgcctgtaatcccagctattcagtaggctgaggcaggagaatcacttgaacctgagaggcggaggttgcagtgagccaagatcatgccactgcactccagcctaggcaacagaataagactccatctcaaaaaatattcaaaaacaaaaaaaagtcactacactcccaaatcattgtatgcaaagttttattgtaatgtgaaatcacttataaaataaattttgactgtaaatagatattacacatagattgctgcacaaatacagaaatagttgcgtgagtagagccaggtaagctaaaataattaaacgttagagccaagggaaccattagaaattatttgacttgatccccagcctttacaatggaggaaatttaggcacagagaggttaaaatgacttcccaaaacacacagataattatgttatggctgatttgcaactagtactgaagtattcctatttgttgatatgtccccctcactcagccaggttattaagaggtctggaatcagaccaacttgggtttaaatatcagctatcggactttccagttgaatgttaccctggatttcaatgatagatccttcccagcgagaaaatattatctgggcattaattcagaggtacagacaccaagggacttcatgagaggtatcctgagggcacatccctaaaacaggactgactcaggagaagaactagaaggctcattaacctctctataggatggcaactgagagaagggaaacctgcccaaattttgcagccatcttggcctctgggcctgaccacccagtggaattgtgctttgcttctttctgcatgcaaaagtgcccttcatcccgggatctggagggatgattgaattggcatttggatgttatcccttcttctagtgaccagtctaaacatgctgatcatggtttgtgctcccaagtttcactgagttctggagtcttaatggtgggctttctctaatgctgtttgcaccagagtatagacacttgccatctaatggagaaagtaatagaactcaccttaaagagctgtcataggaatgaaaaacaatgcataaaagtgtgtagtcagatgcttgacccacattaggcacttaccaaatattgcatgcaactattgttactcagatacaacacaacagtgggcattgagttgtccaagaaccttggccactgtttgacttagacaagattttctttttagagcatatcactttaaaatggtgaaacagctgtggtgaaaacactagacaataggaaaacattgataaagacatattacttagaaattcaacctagttgggactttctgatttgtttcatcaagagacaaatatatggctgaatcttacttttttcaagcctggtctttggggttggaagatcaaactcctgctccatcccttaactaaagctgtcaacgaggaaattatcagaccatcctgagcttctgtttcctcctctttaaagtgagattgataataatgcctagtcagtgggtgcttgtagagctcaaggaagagaaagtgtacatgaaatggcggggggcgggggggaaactctgttggagatgaacattaaagagtagaaatctcaaggagattgtgtttacttctctttccagtttccatcttgctgctgcaaaaggacacgtggaatgcctcagggtcatgattacacatggtgtggatgtgacagcccaagatactaccggtatgtggtttttagtctcttaagtcagcaggccagcaccagattaggtatcaaaaagtaatacatattcattatggaaaatttaaggccaggtgtggtaactcatcctgtaattacagcactctgcgagggtgaggtgtgtggatcacttgaggccaggagttcaaggccagactggccaatatggttaaaacccatctctactaaaaatacaaaaaaatttagccaggcatggtggcatgcacctgtaatcccagctactcaggaggctgagacatgagaatcactggaatcctggaggcggaggttgcagtgagccgagattgtgccactgcactccagcctgggcaacagagcgagactctgtctcaaaaaaaaaaaaaaaattagagtctacagataaaatttagagtccaaaagaagaaaagagaatcacctccaatagcaagactctgacatggttttgttgtatagccatacttctgagttttcatctttcatgtggttagtcaactagagactgtatgcttcttatcctcattttttatattattttctaagattatatgtacagaccaagcaatagtccctaatttttgtttttatgaatcattgtgtgaggtgatgagtgagttactcaggagctcatttcatcaactgagataggctctgtagatggaagccttgaacttcatctggaccagctgcccacgattctcaccccttgctgtacttcagggcatccagttcacctgggaacttgaaggaagggaaaagagaagaataaacagtacacacacacacaaacacacacacacatacacacacacacaaatatatatacctacactttaccctctgagattcagattccattgtctggaagttgccagtcaactggtatttttttaaagctcgctgggtgattctaatgtgaagccagtgttgacaaaagatgaacaaggcaaatggagagaaaaggtagcgtagtcttaccttgtataaaacactgtcctataagaaggagcccctggggtctccagcctgggattctgcccctgctggccaccccaaaagaccaaagcaaccactgatggcttttcatttttcgattgtactcgagaatttttggcttctaataggtttctattagtgtttactgggatacaaaattagcctaactccattgcctttatctaggcttttcgtgaatccgtaatggatccctttcttttctcccatccccaaaattggcctcttcagactagtcatcttgagggatcagccaggtattgcaggaatgctattattactcaaaatatggttgggaacaggtttagaattgttttcattgtgtgaggacttaaaaaaaagaatctcagtggttgggaatctttatcctttgagaatagggtttttttttagggcaaacctaagagccctaaaaaaatttgatgtcaagtcaggtgaatgatgtttcaaactggtaaaaccatttttggtcaaaaatagggagtgattgaaataacagaatgatttttctgagcagttccacagaaagttccaaaaatattttgagaaatggcaacaccaatatagggggataaatggtttccttaagtgactgccttgagggaaatactaatttatgtttttccaattaaagtcatctttaaactcaagacccaattattgtgtttgtttttaaagttcattgtcattgctcttaaagttatgccataaaaccacatggtgcagtatgatttgctaaaatacccctaatgagatgtatgtcctcttaagtaggagaagtttccctctaagaaacccataatctgaaagcattagctcagagtgaataaactggtgccgtcacacggttttgtttcattgtacttgatattaagaaatagattagacaggactgtagttattttcagcataaccaaaatcttccctcacgtctttttattgtagggaaaaataagttggttttttgtgtgtgtttttttgtttgtttgtttttgagacggagtcttgctctgttgcccaggctggagtgcactggcacgatctctgctcactgcaacctccgcatcccaggttcaagtgactctcctgcctcagcctcctgagtaactcagattacaggcacccaccaccaccacgcccggctaatttttgtatttttagtagaggcggggtttcaccatcttggccaggctggtcttgaactcctgacctcaggtgatccacccgccttggcatcccaaagtgctggaattacaggcgtgagccaccaagcccggccagaataagtttttttttttttttaatacatgcttattgtagaaaagttgagaaatatagtaaactataaagaagaagataactcaagttcctactcctatcagaaagaaaaaaaatatttctattttgttgtatttccttccagattgtcccaatacatttttacatgcctgagatcacattatataataaattctatatcctgcattttaatttattaaatatcccgccagtttcatttcccccattaaaggctcttaagaagcatagttcttggtggcctcataacaccctgtgggtagagctcatatttaccaccagagccctaacccagttcctgagaggctggtgcagtgctgagcaggaagacctggatgccccaaggcagtgcccacttcctgcagactgagatggtaccactctctaagaagcaacactggagggagtgctgtggacacagcctggatatttcccaggattcgccagtgggaaccaattgaaattggtggaatccacagcactttggggccacaggacattgtccaaacattccatgggttgaagatgtctcagagctcccgtcacttccttctcacctgatatttttagccatgattccagcacttccctccttgggcttcatcgttttattttggcctgaaggaggtaccagcttcttcccatgatttcttgaaagcatgcaaagagaacacgggaacaaaagaagaacactgcatggaaaaaagtgcatctagaaaaacacttctcatttttttctgtcccaataaacaggttaaattgtaatggctttgattgcccatgcctgtgtcttacctgttggctataatacccacctattcactctccctctcaagaaagcatatctgaatacaagggaaggatgaggttacgttagtaacagtgcttagtggtcatcactagtcctaaacgtttgttgtggtggttaggggatgaattaaatggcttagcttttacaggtattgtctttccatgtggaacctaccttaagttttgccactttattactgagatgcagtcaccttcaatctgaagatccagtgagaactggtacaaagatctgttaccataaatcctgccctgtagaatttttgaaaaaaacaaaacacacacacagacacacacacacacacacacacacacacacacacacacacacacacaaaaccacctttcaaaatctattacactggctctttttattctttttatccatgattaatgtcttcaggatggtcaaattggtataatttcctactttttaaacttttgactgaatttaagttatagaagcaagaatctgttagcattttttttttttttttttttttgacacggagtctcactgtctcccaggctgaagtgcagtggcacgatctcggctcactgcaagctccgcctcccgggttcacgccattctgctgcctcagcctcctgagtagctaggactacaggcgcccgccaccacgcctggctaattttttgtatttttagtagggacggggtttcaccgtgttagccaggctggtcttgatctcctgacctcgtgatccgcctgcctcggcctcccaaagagctgggattacaggcgtgagccaccacgcccggccagcattttttaaagctatttttgcagatgaaatacttggaagtctgagaatttttatggatgctttacaagcaattttaagagcaaaaccctgtcagaagataaggccttggatgtgattatagtgcaatatcaactgtcatgtcattttagattgatactacttaattcttccctgttttttctagctatcttaagaattgaatacatggtcatagtctgaggtagttttagggaaaggtgccctgtggccagagcagttgggccattctacttagatagcctttaagtaaaagggttcttagactacttgtaatagtccaagactcttaatttataaatatcactagtcttttatttgcaggtggaattctgctggaaggcacttaggattgcccttgttatttgcccacagggaaattgcttcctgatactctagacagatccacagctatatgggagtcagagatgcattgtctcatcatagttggattctgtcactaaaatagtatttcgtccagaaaattttgcatttggagagagaatttggtgttaatagtagcaatgagagacatcttacttcagtgttatagtgttcagggaatgatgcgtcattcggattttgagactatttttagtgaaaaatacttttctgctgctcgttagaaaaacatcacagggctggggaataaaagaatttttgcttctatagaaacccggcacttccaggtatgactagaacacttactcaaagtaaaaagaaaacctgttattttatagtaagttgtttacatctcccaaccatcttgtctttggagaaccaggtctttttccagtgggtgttgcttatgcagaacagcttttgttcacagcagggacaagttaatgcattgcgtacacgacataaacggtctccatcttacaatcaggatgtgttccaaaccttcatttgtaaggcatttgtttaaaactcagaatgtgcttgtccacagaaacagtggtataagtgatggttggagggccaagctactccaccaaagcctatttaatgcatcatgtaactaaactcatacacagttatgcttcatacactctggaaggagggatctcatataatataacaggaggaggaggaagagaaaatctttgtcttcttacttccaagaatctctcttccttcatttttaaattttgttcatcctcctccttttgggaggggacagagggattcctgtctctcagtatcctatgctgatgaaacaactctcccccacacctaccctaaaaatctctccgtacagctgaattcaaaatagaaggaatcggatcatttgactttacacatttttatgccattcaccatagccctatggcccactagtttttaaatacagtgtttcctagctatatgattctctaattagtgaatttctggtcagtgttacagactgaagactgatttagaaagaaaaatggggccgggcgcagtggctcatgcctgtaatccacactttgggaggccaaggtgggtggatcacctgagatcaggagttcgagaccagcctggccaacatggtgaaaccccatctctactaaaatacaaaaattagccaggcctggtggcacgcacctgtaatcccagctacttgggaggctgaggcaggagaatcgcttgaacccgggaggcagaggttgcagtgagccgagatggtgccactgcactccggcctgaatgacagataagactttctaaaaaaaaaaaggtatttggggcctgggccaccatcatataaagaagttgttggccaggaatggtggctcacgcctgtaatccctgcactttgtgaggccgaggcaggaggattgcttgaggacaggagtttgagactagcctgggcaacatagcaagacccccagctctaccaaaatttagccaagtgtggtggcatacacctgtggtcccagctactagggagtctgaggtgggaggatcacttgacatcaggagatcttggctacagtgagccatgcttgtgctactccattccagcctgggctcagaaaaaaaaaagaaaagaaattgttcctcgaagtcagtggttctgatgaactgggcttgatattgccccccaggggacatttggcaatgtctagagacatgtttgattgtcacatttggacctctagtggatagaggccagcgatgctgcctaacgtcctgtactgcataggacaaccatccacagcaattatccagcttataaggtcaatgatgctaaggttgagaaagtgcatctacggccataccaccctgaacacgcccgatctcgtctgatctcggaagctaagcagggtcgggcctggttagtacttggatgggagaaagtgctttaaacatgtcctaaagtatgggagttatctacaggtgttatattatgtcaaatagcttgggaaatccaggattaagagtttactaggtgtggtggggtgtctggtagtggtcaggtcctctgctctgaccctctccccaggtccccccatccagacatttgaaattagcataccctctaattcagatggacagaaatgtattgagagcctactgtgcagcagcagagttgtcaatactagagatacagcagggaatcaacaggggtgtctgtcctcaccaagcttatattctcatgggggaaaaataattaactatataagtgtgtgtctgtatagagaaagaggtaaaagggagtgatagaagctgctaagtgctatgaaggataaagaaataaagcagggagtgggggtaaaagaattagggagaaattggaatttgaaacgagaaagtcaggaaaggcctcattgagaattttacaactctctcccttctgtataagaactttgaaaatcagaaaactccaggtaatttccattcagggctggagtacattgagaggagagggaaatgagatgtcaagagtaggggctgaagtgtgtggatctttgatgtattctgctggcttgtgggttgccttcactggattcctcagcctgtggtgggcatagcctggcatggctcttatagacacaggatgtttggcaaacatattgacagctgaaagcagagctgctgagctgcattatcatgaatccaccgcaagtgtctagcctggagctgcttttcaccccaagacaacagcagttggaacctgtgaatgtcatccagtaggtgggatagggcatgggggatgctcgattcttcccactcgcaagaataacagttccagcccaggcacagtagctcatgcctgtaatcccagcactttgggaggccaaggcaggaggactgcttgagctcaggagttcgagatcagcttgcgcaacgtggcgaaatctcatctctacaaaaaatacaaaaattacccaggtgtggtgtcatgctatttgggaggctatactcccagcaacttgggaggctgaggtgggaggatcactttagcctgggaggttgaggctgcagagagccatgatcgcgtcactgcattccagcctgggtgacagagtgagaccctgtctcaaaaaacaaaaaaacaaacaaacaaaaaaacacagttccgtcttttttggataacaacctatttccttatagctgtcttctcatatataagaaagagattttttttaaagtgtggcctttttaaaaaaaattattatttgaaaaaatccatttaggacacagcgccttacatctcgcagccaagaacagccaccatgaatgcatcaggaagctgcttcaggtaagctggtgacaacttagaattataaatgtgtcggttttacaatttgaaagtaatcatatttgtgaaagaacaaacacaccctccatacacactcctttaaatactgtccccaaacctgtgtttcctaagaagcttcatgattgaaatgatagccaaggagaagactgtctccatagcaactccactggcagagaagaggatctaatcaaaattggagtgtcttttttgggatctagcctttttctcccctttatttggttccttcttttctttgctgaaggacttacaccctctaaatagtgtaagtttttaaaacatcggtttctaagctgttggagatccttaccacacaggatctccagtatcctagtattgtgaaatcatcagtagaatgcagctcttctttgagaagcaaactttcaaccattatttcctcatatgtaacttgatgagcttcagttcttgggttttgtttaagtccttggttttattcttctttataattttcagccaactccctggttcaataatcttgccaggaagtttgtaatgatcccttaaagtgacaacttccataaatctttaaagatgaatatttaatgaactcccaatagccatccatacggtaacatccagttgttgccagtcaaaatgcaaactggctgttttcaggaacagcatagagcaataaaatacgtgtttgcttgtactgtctgttctgttgaactgttgtcttggccttcacaagcactatttgggacccagcatcttgctttaatttggctttgaaattctaatgcagaaatgtgatcacattcttcaacttgtcctgtgctgttgatcacacagcttcttgtcttgcgttacatgatgcaagctattgccagttccaagaatgcttaaccttaacaggtctttgaagctaaattcaagaaaaatagattaatgtctgtgatgttgtattatgaggcttccctttgaagacaactaaaatagaacttttcttacctgcctcttctgggaccagacactctggataagtgaaaatcattgctcaagctctctgcctccatatccttggccctacctcaatttttaagtaattgatttatgttttaaatctccattcccattctggcttggctatccagactttgcatctgactctgattttaaggaagaattaacctgacaagctggatgttctcgtgggcaagaaccagatattctagtctctaatgtaatcttatatctggttatgcaaatggattggtttttcttcggaatctttgaagcctttaaacagttccttgtgctgctttaaaattaggccaaagcatggtaagtcgtaacttaatctccattcttcttaccacgaaagggcagacatttcactagcgtggtagtgtgttattacctcctctcactgccaaaccattcagattgttcttcttcctggatggtggttaaaacctcagctgtgtcctcctgttgggctgttttcccaggtcctgttcctctttgcactctagccagttcttcacctcttgtctcagtagcccaggctctctgtgctgtgatccccattacctcctgctgccccccactcctatactctctgcatttatggatctccctgggctctccaggcttttgctcttattgcccgtctgctggagccattccccctctccagtggctaccaaggtaaagttcttccttctcacggcaatgagcacaaatagagccttttgagattcttcaaataagctctctcaggctgggtgcagtggctcacgcctgtaatcctagcactttgggaggctgaggcgggtggatcacctgaggccaggagttcgtgaccagcctggccaacatggtgaaaccccatctcttctaaaaaatacaaaaattagccgggcgtggtggtgcatgcctgtaatcccagctactcgagaggctgaggcaggagaatcacttgaacctgggaggtggaggttgcagagagccaagatttcgccactacacttcagcctgggtgacagggcgagactccatctcaaaaacaaacaaacaaaaacaacaaaaaacaaatgagctctctcccttcccgaaccctcagctattcctcccgccctttctcatactgtgtttcttgggcactgtgcaccgtgtcaagcagtgacaaacagcagcccctatcccagtggagctcccagtctggtaaacaatccacaaataaacattacagattgcacagcagtaaaaaggaagctaacgggttactgtaagagaggaatcagaggtggaggttcatggaaggcctcgtgaaggaggtgatatttaagctgagacctcccaaggatgcaaagagccacaaggaaagcattctaagcaaatggtacaatgtgtgcaaaggacctgaggtcacaaaggtgctggccagggagggaagaatgccaatgtgtgggcctggggcagagcaagtaaggaggaaagcagcacaggatgtagggccttttgtatgtcatgatgggcttgactgcagttcatcctaagtacagcatggaagtgtgaggggcttttaagtagacagtgagagtcacagttttaaaagagaattctgtttctttagagaattgataaaaaggggaaaaatgcagaactggggagacgtgccaggaggctaccttagctgttcaggtgagaagacgctgtcctagaaaagggtgtcgggaacaagaaagggaagagggtagagtggaggcgagttttggagaaaaaagttgacagggcatggtggtccactacatgtggggtgaggaagaggggtcggggaagggggtggaggatgaggaggaatcaaagctgaatcgctggtttctggctcaatgtctagactgatgatgatgctgttgatggagaaggcagtcagggaggagcaggtggggcacgggggaggggaagccagagattttggctgggcctttgagatgctaataagacatcagagcagagatgtgaagtaggcagtgggttatcaagcctagcgcttgaagatgacaacttttgtgtatgagtaagaatacaggccctagcccagcctgtctgagtttgaatcttggctctgccatttactgcgacttgagcaaattatcaacttttttgtgcctccgtttcttcatctgaaagtggaagtaatgatagtatccacctcgtgttgttaggggacataaagcagttctttgaacagtgcctggcacgtgagagctaatacttacatagcacttattgttgtcactgttaggacctccgcatttgggagtcactagcgttcattcttctagatgatatttcaggttgtgggtgtggaggagcttaccagggaaaagagcttagaggaagaacactgaggagccctgaggttttctgtttggctagaggaggagccgcaagaggaaaagcagaataagatgagccaagcagggctctaggagctgagaggttggagagaggaggacagaaatgtttatcgtcattggaaacatgaaggtttttggtgaccttgaccaaggccatctccttggactcgagaggggacacccaactgcagtggttttgggagtgaatggaggtgagggtgcgtggactgcatgtgggtaatccttaagagaaagctggtttcgtgaagggggacagaaagggcaggagatgggggaaaagaaaggattaagatgagagagcctagagtatgtctattagctggtggggtgctggagtgatgagggaaggagaggaacagataggtgaagcagcaaagaggggagagtttgcccatcccaaagacatgagtctccttccccataggagactgtaggcccctggaacacagcagctggggcttatttatgttaatagtcttcctaataagtcacatcataccttgcaggaaaagtctgaactgaatagaattggggcagggtattttattatatggatgtatttatttttgtcttatagtctaaatgcccagccgaaagtgtcgacagctctgggaaaacagctttacattatgcaggtaactttcattctcctatttgtcttcttctgccattagaaacaccaacttttctttttccttattcaggccattaaccttccatactattcctggtgctcttttctgtcatcatttctaaacattcccattttactctgtttgtaaaacatacacagttttaccgaggcatatgcctagaattcatcaattcctttgccacctaaccactgaaaattatcacgattaatatattttaactaatttaaggtttctttttaaactaagagatattctaagcatttgtagatttcaggtaatgtgtgatacagactttttgatttgaggattattatgaacatcagtcaattttatttactaatattttgtttagtatgattacacaacttgaagtgacaaacgttgacactgaactatgagtgattagatttacacatgtgttttattgctagttgtggaaaagctaagtcctgtgaaaacctgagccaaatatttgcctaaaggcaactggcagtcattggctttaggcctgcataactctgaaattaagcagtaattttaaacacctcactcctaaccttcctaataccatttctcttcaatgcaactagagtgaatatatgtagagtgggtagaacatgaacatttccttcctgaagtatctgatacccctggttgtgaataactgtgtgattggctgtggtatttatattttccttcccccagcggctcagggctgccttcaagctgtgcagattctctgcgaacacaagagccccataaacctcaaagatttggtaagtaccaggtggtcactagaggcagaggtagacattggtttctagagctcaatgggatacctctagagtcactgagactttagactagcagtctccaacctttttggcatcaggggctgattttgaggaagataatttttccatggatgggggtggggatggtttcaggatgaaactactgcagctcaggtcatcaggcattggagtgcacaacctagatccctcacgtgctcagttcacaatagggtttgtgctcctatgagaatccagtactgctgctgatcttataggcagtactgctcactcgcctgccacttactccccgctgtgcagccagatcctaacaggccacagactggtactgatctgcagcccctgggttgggtactcctgttttagacaactaagtattgggcaaattctattgcttttcaacctagattctcttctgcaaaatggatttatgtattactcttaacccttttcccatttgctccaagaatactcaccagtggcgtttggggatacagcatttacctcaagataactttgccacgaaatatctcatttttattattattattttcccatcactctagtgtattgactttggaaacaaaagacatcattctgtttatagcattctgtttttagtagtggtatttccatttacaaaatgtagtaattctcgaccactgaaaatgtcaaatcctagaaaacgtagcattcctatgtgtgatgttaatatcgttctcaaagagatcttggctgaagattcatttgatgaatccgatttttctgagacagatgattctggtgttagttctgtttagaaataactccaagaacagtttttatattttattttcacattgaaaatcagtcagattttcttcagcctcaaagagtgtgtttatataaaattaaatgagctctggcagagagctgcacttttttttttttttctaaactgggaagaaggttaattagcttctaaaacattagtaaaacattttgcagcatatatttcctatataggtatatttatttctacggctatacatgttttctaccatcaatgtaattacaaataaagcttaatttcttgatttttaaaaataagtctaaatagaaattttactactttctttctgcacttggataacttctacgtagaatctcccaactttgaagaccattactaggctattttaacttcaccaggctactttgagaataaatttatatacctatcacatggttctgtcatggggttatatttcatgttgcagcatgagaactgacatgcatacacttatatttgatggagatgctgtgaagtgactagatagaatctgtaaataaattcatattccttgaagttcagtacttcctaagcagaaagtagtataacttcacagagatagtgcccagaaatctatctgaaattctttatgacaatactcaatctttaagtagcacttgtatttttaaatagttggatatattgtaacatcttttccctttgcctattgaatgcttctaccttaaaactcactgtcgatggatttatagggtatattccagaaaaaaaacaaaataacaacttctctttatggtttgtgtcagacctaagattacaaaaaatacttatgtatattcttctagtatttttcatcatttgttttatattgtaatgtttaaatgcttaatccacctgacatagtttgtatatgagttggagacctagatttcctttttcccaaaggggttgcaattgtcatgacataattattctttctatccatttctttatctagtcatgtgttagtaacagacataggctcttaatttatgttatattttgatacatagcaagattactaaagggtacactttcggtaaaagtggaatggcaggatatataatgattagtgcactgggaataagctgcctacagggcagtgggatcttctggtgtcgtgcggagacacgcccttcctttctccagcaccgtccctcagtatacccggtacacttgccttgagcctttacacactttgtgttctgtcctctctcacagtcacccaaacagtgatagccaagggcataagcagccgcaagaagctggagctcctatgtaaaagctagcattcagtaaaattccataacaagagttgtgccaacatacaatcgtgactctataggggtacagaatatcaggttggaccagatactagatcagcagtcagcagtccaagtcaggagaaaaatgtgcaaaaaacaggggctgacttttgcaattctggcattttgtgcctgaggtaaaatctaaatctgaatttgtctcctaggatgggaatataccgctgcttcttgctgtacaaaatggtcacagtgagatctgtcactttctcctggatcatggagcagatgtcaattccaggaacaaaagtggaaggtactccagaattaggcagaaatcatgtgacttcagtgatacccacattctgagagtatttcaaaatatcacagctatattttggatcatttgttataagggatttttaacttcttacctttttaaagttctactgtttctgataatcaagaatctatgttgactttaaagcaattttccccagacatctgtggacatcattgctggctaagtctgtgaggagactattaaatgctaatgtgaataaacaatttcctgtgactttctatgcaaaataaaacaaacctattggttgttttggagaaatggtcttagaaatatatatgttatttaaaatgcttgaggtaaaacaaggataagattcatgccagtcatattaaatcccatcatattatgccaaatagtatagaagattgtgttgtttgacaaaatgtggtttaatgttttgatttaatctgaagtttaaaaaaaaaaaaaaccacctaatttcatcttgattgcattccacttcgaattccctgaagattaagtgtaataaaggtttaactgcacttaatcttcttttctctttttttaagacaactgatttcccaagaaagactttttacattctcttagtactaattttgtgtctcttttttcctttagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctggtatgtaaaagaaaatagccaatgttgttttaagtttatccactccattttccccaaaggataaaggaatgtgtgcaatatgatatattttattattcttttaaacatattcttgaaaaaaaaaggagtgttaaaaaatattgtatatggtgtatgtgtgtgtatccccccacccaaagtgaatatgaatcattatgcttcttatagttctttttttcactttttcctctatagatttaaagaccccaacaaaaccaaagcaggtatttatctttgggggaggcttctatgtttcatttatgcttgtgggaatttaaaaatgttcagatttaaccactctggtccactagtaaagtaataaagactatattgaaaatacttagggactgaaatatctttgaataaataagtcattgttataaggtgttaaaggttgccaggccgggccggtggctcacgcctgtaatcccagcactttgggaggccgaggctggtggatcacctgaggtcgggagttcaagaccaccctgaccaacatggagaaaccccgcctctactaatattacaatattagccgggcatggtggtgcgtgcctgtaatcccagctgctcgggaggctgaggcaggagaatcacttgaacccaggaggcagaggttgcggtgagctgagattgcacgattgcactccatcctgggcaacaagagtgaaactccgtctcaaaaaaaaaaggtggtaaagctttccttaataatttgctttatttcaaaagcatgtaactttaaacttgctacttatatgttcatctttttctgaaatgtactaactcatacttcctattggtgtgaaaatgtttgatgtggcttaaactctgtgactgaataacactgttttaaatacttgtaatatcacatgagctacagagcttcagccagaaaatgttagctatttaatgaaaataagagaatttagccttttcttttaattagggtttttctagaacgtcatgtggtgttacacaaagtagaaattgagtttgccctgttattgtgtagttttttctaaaaatatattgtcactatctgtttttttgatgaacagtatatgtttggttgtttatttatttacacatctacgttcttgaagaaatcataaacagcaaatactcaatactaaatttatgtgctaactgtattacttaccagtaaccttcaaaaatgaagttatccctttccctcatatttatagtctttaaaaaaaggaatggaagtaatgcagacgtgtgggaaataccattgcttttcattaatacagaaagctggctgtgattgtattctggattctaagttgtagtagacctcaacctctactttcccagttctccacaccaacctaatctggttttgtctcatgtgtttttattttcttgctattaaagcatgggctgctaggagaatacttgtgcatgcatattatttatttttatgttggtagcagatttcagattttgataaagtaagaaatgtatgaacttttgaggtttttctcatgtgtttgataaagctacttgcccagactttactaaccaaactaacccacctccattctttggactgtgataactttcagcatgaccaagtctctaaaataagctcagaaagaagtggaactccaaaaaaacgcaaagctccaccacctcctatcagtcctacccaggtaaaaacaaaagcaaaccaacaatcaataaacgcaccacaagaaagccataaatttgtcattttgtttaggccaaaaaggaatgttttagaactgacctttaagtgcatatttaaaattttccttagcagttttaaattacaaattgtggtaagaaggattgatgattagtatggaaataatgttgattcttatctatttttaaaaaaacagtagaatcgaatagcctctttttgaaaagtctcaaggaaatttctcaaaatcttatcacagaaactttcccttaagataagttcaatttatttttagttccttatgttaaaagatctagtaaggactgggagaatgagtagccattgaggcaattagttgaaaatgaatttcagttcgtttcttaaaacattgctgcaatacatttgcctttttaattgcttttaaggttggctaatattaaaagtagttttcatttctgagctttatagtgacggttgcatagaggaggaagctcagtaatctatgtaatggcaggtaaaaacacatcgaaatttgttatttaaaaattcataggccataaagagaataatccatatttaaatagtagagaggaatagctcatctcataagtattttttaaatgtatgttagcatacttattaatattcttaacctgcaatagaagttttatagatttttaaaaaagtgattctaatataggagcacagttatattctgtaaactttcagaaagtatttgaagtagctgaattgcactgaaaatattctacccgtgaattaattgatgccaaggatacttactgttagatttcattgcattggttaaacaggttgattcttcggcactggagaagaggagtttgaagatacattctttattaatgattttcattttgtttcttttttagttgagtgatgtctcttccccaagatcaataacttcgactccactatcgggaaaggaatcggtattttttgctgaaccacccttcaaggtatttcctttctgtattcagttttgttactgtattttaagatacatgatagacttgctttaagttatataacactgggaaaaacagaatatacttctgaatcattggttcacaaccttttcaccatgaagtaccccttgattattttttctggcatggaccccataaagcaagaatgtgtacagctagtttgtatccataataatttaaaatttttaaaaaatcattgagtgaataaattaaatttacaaaccaataattgattttcttcatttaaaaaaaaaagagacaagagggctgggtgcagtggctcacacctggaatcccagcactttgggaggccaaggtgggcagatcacctgaggtcaggagttcaagaccagcttggccaacaaggcgaaaccctatctctactaaaaatacaaaaactaggccggggttggtggctcacgcctgtaatcccagcactttgggaggctgaggcaggtggatcacgaggtcaagagatcgagaccatcctggccaacatggtgaaactccgtctctactaaaagtacaaaaattagctgggcatgatggtgcgcacctttaatcccagctacttaggcggctgaggcaggagaatcacttacacccaagaggcagagattgcagtgagccgagatcgcgccactgcactctagcttggcaacagggcgagactccgtctcaaaaaaaaaaaaagaaaagaaaaaaatacaaaaattagttgggcctggtggcaggcacctgtagtcccagctactcaggaggctgaggcaggagaattacttgaacccaggaggcagaggttgcagtgagccaagatcgggccactgcactccagcatgggcgacagagcgagtgtcttgtggtggggagcagggacaaagtttacttatatggaatctaaaaaagttgaacccatagaagcagagagtagaatgataattgggggagtggtgggaggtattggggagatgttggctagacggtacaacatttcatccagataaaaggaataagttcaagagatccatggtacaacatggtgactatagttaataacaatgcattggattctgaaaatcactcagggagcagattttaagtgttttcatcacaaaaaatgataagtgtgtgagattaattagctccatggccttttcacattatgtacgtatttgcagacatcatgatgtacatggtaaatacatacaacttttatttgtcaactaaaaaataaattaattttttcaaaaataaggtgtggaagttaccagcttctacctgttattctcctcattctttcctgaatgcagaatattgaggaaatgccaaaaattatatttcaggaacttctctatttataatgaaatattctagattggatcctgggacagaaaaaggccattattcgaaaaactggcgcaatttgaataaagttgtaatttagatagtagtaatttaccaattgacaaatgtataatggctacatctgttgtaaacattagaagaaataagtgaaggtttctatcttgcaacttttttataaatcttaaattgctccaaatacaaagtgctaaagtttttttaaaaagagacaaagataagaacttactagataagcagtcttcttacccaattaagtttatattaattccaatcaaagagacagaaacttgtgttattctctgttgtcttactgagaattgtatagttaatttttttcctgactataaaagtaatatgtatttattttacaaatgttagaaaatccattaggttttatccacctggttctgtagatttgtggttgcaaaacattttaaggaagtgggaggatatttccatttaatatctgtttaatatactgagaaattgtactcaagggggaaataaaatttataattgttaacatgaaatttcgatattttatatttacttactttcccttatttagaattattaaagatgtttttttttaacttggatacacattaatctgaaacagattctatcaacctatcatttccctcactttagactttactaataaactcttcagatgaatttctatgtaagacaaggcaactatactcttatagttagtacgataatatcttctgatatgactgtgcctcaaagaagcagtgcaatccgaagaatatcacaaattatgatttttcagaggtagagtataagactgtcatttctgaaaaaacaacaacaaaaaaaaacaagataaaaagtgacatttattcctacgttagcttagggaggagacaaaagtgatatctaggccaggctcggtggctcacagctcatgcctgtaatcccagcacttcgggaggccaaagcgggtggatcatgaggtcaggagatcgagaccgtcctggctaacacagtgaaaccccgtctctactaaaaatacaaaaaattagtcaggtgtggtggcgggcacctgtagtcccagctactgggaaggctgaggcaggagaatcgcttgaacctgggaggcagaggttgcagtgaaccaacattgtgccactgcactccagtctgggcgacagacactccatctcaaaaaaaaaaaaaaaaagaaaaagtgatatctatttaaaatggctaaagtttaaaaagactgatactaccaagtgaggattgaggatgttgcagaactagaactccatttcctgctggtgggaatctaaaatggtataactattaccagtttggaaagctggaagtttcattaaagttaaatataaacctaatatatgatccagccatccactcataggtgtttaccaaaataaatgaaattgtatgtttagacacaatcttgtatgcaaatgtttgtagcagcttcattcacaacctccccaaattggaagcaaaccaaatgtccatgaacaagtgaataaagataatgagatatacccatataatgaaatattatctgccaataaagaggaatgaactgtagtgcaagtaacaacatagttgaatctgaaaagtcatcatgctgagagaagccagccaccaaaaaattcatatgggatgacattccatttataggaattctaagaaatgtgaaaaaaagagttgtggttgcctaggaatgatgcgggcaaggactggttgtaatgaagcatgaagaagcttttaggcataatgaacagattctctatcttgactatagtgttggttccataggtatacatctgtcaaaaactcttcaaattgtaaacttggctggatgcagtttattatacgttatatagtggaaaatataaaaacaagtaaatttgttataaaagtgaaaggactgctttttgtaaagataagcacttaactaaaaataagctactttattatttagcatttgggcttttacaaaggtatctctgctgaaaaattctcttatcattgactggctcattcggatgccacattgtaatttttagcaagtcactgtaatgttttgaaatgagattgtggctttgaagttccaagaatttttatggtatattaacagatattcagggacaaagcattagagaaaatctttagggaatctattgccaatctgagaccatatgatatttattaccatttcccttagaaaagttaatagtaactttaatagcagataacttataaaatgataaagctaaaaaatctgctttaaaatatttcaatcaatgtataatgcagacatatagaacttctctttgacttcattacgaaagcactatttgctgtctcagtttttagtacataactcactaaattagcaattacataaaattattgtgatcttaaatatatttgcattgtactcactaaatgaaacttctgaaaaatatttagagaatatgccctctggaacttctaatgttttagaaattaaacttagtagataattgtcacttttactcatttatagcttaaaatatcttctttcttcgagattttctagctgcttttctagtaggatcataccagatctgctctgcgtaagctcaaggaggaaagtctgcttgattcttttgtgtaatgttacatttagaaatgttctttaagtcatttttgtgtttcaataggctgagatcagttctatacgagaaaacaaagacagactaagtgacagtactacaggtaagacaaggaagcatctgtttttttttttccttcaaccaaactatttcatgtccatttaaagagagcaaaggccaagctggggtactgtgtaaaaatgtcacaagccagcatgtccacacagagctgccagtaatgcacaagctgaagcgctctgtacttcagggtgccttcttcacctgcattttaaagagtctctgaatttgaattttgaaaaatacatctttattttcatttgtcccaaactacatgttagcagttcgttcaattatgagtacaggcaataagcctcagtggtattagcagaccagtgattttgtcaccaagagaattcctatcaccttactgttattgcagatatcttgaaatatttacaatattgctactaaaaattatggcagttattagacctgctgccagatcttgttattgttaccaaataagctcttaagttactgtagcctatatattttatcttacccatttaaaaatatcatgttcagatgaggtccataggcttctgctgtctgctaaacgcgttctttgcagctgagcagcacattatttcatgaagggagaacccaccatgccacctccatgactgtccccatctaacttttctactttggatttcaagtagacacacgcaaagacaagaatgttcatgaagtcatatgtaatcatattgtctttatgatcatagggtttaattcattgtgtctcttataaaagagtgcctcctaagaatttaccctttaagaatgtaatatagtaccttcagaatccatttaaaatgtagaagagacaatttcaaaggtccacttttgctccagcattcagtgtcttaatctgttgtgtatttcataggtgtttggagcctttaatttgcagaacttagaaatattttttatttatgtatttattgatttattttagagatggggtcttactgtattgcccagactggtctcaaactcctgagctcaagcgatcctcccaccttggccccccatagtgctgggattataggcatgagccaccacacccggccctagaaacattaaactttctaatttctggcagagatcaatgttaatataactaaacaaatgttacattgggtactttaaaaaccattcactgtatcttagaagtaatttttatttcttagaattgcatttaggctcccagttccctagttcattccacactcaccagacttcatgtcaaggaaactcagctgtgatttaggcatcagacttatgatgagaagcaaggatttctataaagaaaggtcattttgcatccttccaagttaagattaaagttttcatctttgcattaaatggctgtgagaaaataaaaagcatagcattaaaaatttagatcagtgcttttcaaagtgtgggtaaagtatttactagcttataataattaaggagtttgagctgggtgtggtggcccacacctgtaatcccagcactttgggaggccgaggtgggcagatcacctgaggtcaggagttcgagaccagcctggccaatgtggcaaaaccccgtctctactaaaaatacaaaaattagctattacataaaattattgagattttatgtaatagttaattattgagcatgcctgtagtcccagctacttgggaagctgacgcaggagaattgcttgaatctgggaggcagaggttgcagtgagccgagatcgtgccactgcactccagcttgggtgacagagcaagactccatctcaaaaagtaataataatattaagtttggaccagaaattcacacagttacttcactaagcacattgttttgttcagctgacatatcttttgtaggactttctagatgaaggaagcagtacattgcattgcattctggaggaagtttgctatctctgtgagcaccttgaatagcactccttaagttgcaatttcagcatgataatcagtaggatgtccgaaagttgtggtttaccaacagggattactgtgggattcagagaagagaagatagtttcatgctagggtggtctttgaatgctttaaggactgggcaaagtttgacatgatgcttaagaattctctaggcagagagattctgcagggcaatcctgtggataaagaatgaaagaatcagccgtgtgttgagaatgtagagggtgtgatgggaaccatgaatctgaggaaaataggaatctagaaaagtagcagtgtcatgaacctgaagaagtagactggagccaaatcatagaggcctgaacccagataaaggaatttggagattatttttggagggaaaacaattaaagcacttgacccagaggaatgacccaatcaaagtatgttttaggaagactggtctgacgttgctgtgcaggctacagtttcactgggaagaagagagaggcagagatttgttgggaagctgtttgcagagtttccaagtaaggtgataaagtcttaactacagtaatggtggtagggggaaagaaataaaccagattccagagacatttctaaaatgattcacataactgagacttacaaggcacagggaagaaccaaaaacaaccaagatatgacacttaagcaaatgaataggaaatatatgaccaaattcatcaattttcagattgccttgtgtacacatgtatctagtattgtgctagcaataccacagtaaggaaaccccagtttcctttctatataaaatgaaaattttagttcacccatccagctgctagggcgttttataattagggccaggaagaagaactggattaggctaggaagtgaatttgtctcaggttagagaaataagagtttaattgttttatattttaaatggctttctctttcccaaggtgctgatagcttattggatataagttctgaagctgaccaacaagatcttctctctctattgcaagcaaaagttgcttcccttaccttacacaataaggagttacaagataaattacaggtatataaatagattgctatcatggactattctgtagagtcaagctcttggtcttttcagtagtcagatgtattttgttttaaatgtgtacattagtttctttttaaatattagctttaagcatcttatagtttcagattatttgtttcatgagagtgttattcattaactctttctgtaaattattcaactggtaaattataaataattatacacatagtatgatcagtattaaatattctatatgtttaataaattatataaataaaacaaaatttatagaaaaaattctatataaaatatactatatgcatagaatgatgcataatatataattttatattttgattttatatatattaaaattttacgttttaaattatatatgtatgtgtgtatgtatatatatatatatatatatataaaatattatccatttagtaaagttgatcatttaacaggtttaagtacttgataagaaatggctgtaccaaaaaataagaagaagaaatagctgtactatatatccattacccctcttggcaagtagaatgatataagaaataaaggaaatttttgaattggaggctttgtagagaaaacaattttagtgttttcaaagtgacacaaatcgtctgtcccaatagaacccaaagcaagctttgtgtcattagtcccactcatgtcccagactgtcttttttcatggcatgagaatacacaggcaaagtgatcatgctactctcccgtaccaaagttgcggatttactcctctcattctagttgcttgcttagctaaccacgcctttggtatctttttttttttttttttttttttttttttttttttttgagacggagtcttgctctgtcgcccaggctggagtgcagtggcgcgatctcggctcactgcaagctccgcctcccgggttcacgccattctcttgcctcagcctcccgagtagctgggatcacaggcgcccgccaccacgcccggctaattttttgtatttttttttagtagagacggggtttcaccgtgttagccaggatggtctcaatctcctgacctttgatatcatttaattcttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaaggttggtgaaactgtattgctgttgggtttctagcaataagtcttagtctctttggcttttactatattaaatatttctagtgttggcactaaactggagtgaatgctcagaggctctgcacatgaactttatctgtcaccaaagccacattaagaatagtttgttgggtcggccggacgtggtggctcacgcttataatcccagcactttgggaggccgaggtgggtggatcacttgaggtcaggagttcaagaccagcctggccaacatggtgaaaccacgtctctactaaaaatacaaaaattagctgggcgtggtggcacacgcctgtaatcccagctacaagggaggctgaggcaggagaatggcttgaacccaggaggtggaggttgcagtgagccaagatcaggccactgcactccagcctgggcaacagagtgaacagacttcatctcaaaaaaaaaaaaaaaaaaaaaagaatagtttattgggtatttgtattttaaaaacacatctgctgggcatagtggctcactcctctaattccagcagtttgggaggccatgatgggaggatggcttgagaccagcctcagcaatatagtgagaccccatctgtacaaaaaatttaaaaattagccaggcatggtggtatgagcatgtagtcccagccacttgagaggctaaggcaggaaaatcactagagccctacaagtcaagactgtcatgagccatatcaacaccactgcattctagcctgggcaacagagtgagaccctgcctcaaaaaataatcaataagcaaacatcaatcttcggccacttctccttatactaaagcattttcatatatctgtcctttaaaaatcattttacagaagctttgccagtattggggatcagaagtgaacctgcaaactggaaagtatttgtgatccacctcaaacttcaggttctttttttggattcagaacagattcctccataatatgaaactaaaatactcctagacttaatcctgtttccctaaggtccatgagcttcccctcaagtcactgtaaaagctaccctcgccggtccctcctttgacaggtatataggagaggaagggggaggaatgtggggagccggcaatttgagatggcgctggacacaagagatggtgctggccgtgctgctggaggaaggagggaagcaaaggggaagttcagggggatggttccacgcctcaatcggctctgcatctctagtcccctgtctcggaggttccgaatagcattcatgagagactacttgtctttattcttttgtaatgagtgtttcaaaagagctttatcatccaggggaacagggattagggagtggtggggtacggtgaggagttagttgtgtttactttaaagaaagacgtccagagatatcaggcttcctagaccttattcctgatcacccatgtcagcagtattggacaaaatatagctgtctccaaataaaagcggaaatcctaattctgattttttttttcaatcatacccattttaagagtaaaagtaggaaaccaacatcacagcttttgttaccgccatcaccaaaacataatatgtaattcaagggcctttatctgaacctaatggatgtagcgggctttgttagtttgcctgattttgtcatccatttcattttatgagttttttaatttaaatgtattaaaaaggaattgttccaaagtcttaagtcccagaggccaaaagagatgactatgtttgaggcttacaaatatatgaaattttgctttgtagacatgttactgtctgctaataccattttcctttgcccctagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggtgagtgggcttgtttctgctgcctggtttggggtggagggcctggcagatttcctaccatctcagctgctagggcaagtgggcgtgaacaaaaagattcccagcccaaaggaatgtacttcaatgagcagttgactgatttcttcagtgagggcaaaagagggagccactggtggaattcctggtcgttatcagcaatgcaacgggtcagatattcactgggaaggaaagaaccgacaggacagtaggaggaggctatgtgctcactcataccctaactttttaccccttctcctttttctgcaacagtctttccccatctctggcagtggcaagagctttttcttgttaggggccaggatctctagtagttgcatctctatatatctgaagctgcttcttggcccctctccttatttcacccaggaaagcccttgcttatctaaatttgtttcctgggtccattgtaacaaatcaccacaaatttggtttaaaacaacatgagtgtattattttacagttgcattgaactgaattccaaaatcactttcactggactaacttcaagttgttggcagggctggttcctcctcgagaccataggagaaaatcaatttccttgccttttccagtaccagaggctgcctgcattctgtggctcatggccccttactccatcttcgaggcacatcactccagcatctgctcagtcttcccatctcctccttcagcctttgattttcttgcctccctcttataagggctcttgtgattacatctaaagcccacctagataatccacgataatctccctctccatctcaaacccttaatttcatctgcaagatgccttttgccatataaagtttaacattcacaggttctggggattaggatgtggacatctttcaagagccattatttagcttaccacaatatctgttaaggtttgagttggcatgggtacattccgttttctacctaaagtccagggttagtctgtcctggactgtctctagcttccatatacaaacagaacatggatttgatgatttcttcggaatagacctaactgtagtgaattcaggtttctgcagtccttactctggctggccacaaagttcaatgctagctttggaggaaacagctctagaaatggtggatacttaggagaagctgctctttactgtgttctgcaggtcattcttctcctgataaaatggtattacagacttgtagataaagtgctattggtttatacagtaattcttataattacgcaacatgtgtttgttgagctcttacatcagtattatacatggggctgatgatataaaatgagtaagactcagtccctgccctcaaggagtttatactctatataagttatcagcaaagagatgcccagcataccgtgggcatacaaaggaaatgtgtctacccaatcttgctgagtcatgaaaaggttcctacgggagttacacttgtgctgagtcttgaaggcctgagtaagaatatgttgttacttagcaaggactgacatatggcactagctggcttttgggaaccttggtgagaaccattccagtggagtggggaggagggtagaatctggaccgcagtagactggctgctagagaagtaagtaagtagataggtatctggtggggctaaccagtcgcagtaggggttgggggaagcctgaagcaagcttgctggaaagatgggaagtggtggttagggtgtgggatgctttcagttgagatttcagaggtggtaatgatagaggcagggctacaaccatgacaggagttgctgaactgaagaggagcatgttattaaagctgaagttgaggaactgagaggtccaggtgttagatggatcattcacacagatatcaaagccaagcgaatgatgacagaggcagtgatagaaaggaagccagatcagaagataaaatcataaataattgagtagaggttgctgaaaggtggggagggaacaacacagagaaatgccaaatgtgccttcttatgatgtgaacttaaaggacgggttttaaaatgtcccttaataacaggaaagatacctcatactctgacactgatggggggaaggaagaatgggtattatggacttttgtacatttttgaagtaatccatatatgatggtctcaattttcatgatgaattaggaggacaggttcttagaacaagagtttcagagataagacccttgaaacagccactgagaggaactggagtaatagctcaacaaggagaaatagaagcatcagcggctgtattgaggaaccactggagattggggccaccaccctctttgccttcttagtacactgatagctaaataattgagctccccaaggattatacaatgctggccatatagtgggtaatcaataattcccttaaaaataataggctttaaaaattaaattagtacatatttggtcattgtagaaaagttgaaaaataaagaaaactctaacaagttcctataaataaaaattttccataattcaataactctgagataatcactttttacatttgatatatttccttgcagtatttacatttaatgtagctgtatttgcataagtatatgtacatatatacacacacatatatacatatatacacacatatatagacacacatacacacacacacacatacacacacacatatatatatatattttgagacagagttttgctctgtcacccacgctggagtgcagtggcgtgatctcggctcactacaacctctgcctcctaggttcaagcgattctcttgcctcagcctcctgagtagctgggattacaggtactgactactacgcctggctaatttttgtatttttagtagagacggggtttcaccatgttgtccaggctggtctcaaactcctgacctcaagtgatccacccacctcagccgcccaaagagcatatatttttaaaaccaaatgtggggtgataataactcctttttatacagttttttctagagttgacataccaagacttttttccctaagatgattgacaagtattcagaaatacacaagccagtaaggccacaacaattttagaagcttccagtgctagcataaagtggaggggaccacttgggtagcatttggctgcagctttctcatagttttttgtttttgttctttaaagatctcttaagctcattaataatgtgaaatattccctttctaggaatgcaagaaacaacaccaggaggtcatatcagtttacagaatgcatcttctgtatgctgtgcaggtatggttatgccccttgaagtatctggacatcctaaagaaatacggcagcagatgttgacagaactcccatcatttaactaggagaatgaacaagaattagaggagaatccttttcactggaaagcctgaatatgccttttgcattgctttggattctgtgtcaggagccttgtgccctgtttaccaggaacagccccatcttttaaagcagggcctcactctgtcatgcaggctggagtgtaatggcataatctcgcctcactgcagcctcgacccacgggctcaagtgatcctcccaccttagcctcccaagtaggtgggattacaggtacccaccaccgtacctggcaaatttttgtatttttgtagagatggggctttgccatgttgcccaggctggtctcaaactcctgagctcaagcaatccacccgcttcggcctcccaaagtgctgagattacacgcatgagccaccatgccccaccctcccatcatttattgaggaatgagggatgatgtggtcctccactgggaagacgggggctttattttccagcaatgctgatcttcttagttaccagtgctgccttggctctatgatgcttggtgttctggctgctggactcacatttgcaactgagaccccagatagcttttgctgagggttttggtagacactgccacctcatcttccagctggataaaggcagggccctttctttgactcagttcctcatagaaatttgggaaatgatagggctgacattcctgtgaaagatgtgggaattagcccaggtcttcattgcagtcagccatctcattccccagagaagaaagtgccatggcttaatttaggttctaatgagtatcttgtgtttgaatatcctagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 36059 - DNA, 89249 bp, Homo sapiens
gccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctggtgagtgctggggccttgcggccccggcccctccccctcccgccggcagatccgggcagtcccggagggactcaggagaggccctggggcgagggcgggtgccggcagggcctagagccggggttcctgggccggacgctcgcgccgcgtccgtgcgtcacgggcccggctgtcctaacggccacaaggccggcggaggagagggtgggggtggggagccctggtgtgatcgccatcgggaacgccggtcgaggctaggcggggcggggcggcgtggcgcggcggcggggctgtaagcggcgccggggactgcggggcgccgaggcagcgggcggagaggaggcgagcgcggagcctgcgccgcggccgggcggcgggcgggaggcgggggtgggccgcgcagagcgctgtgacagaggcaggaaggagcaggggtggcgtgtaaaaattctaaccctggcaaaaagggaccgtcttgggaattcacaagttacagaccgggtcggagccggcggcccggagggaggtgggggaagcggggggtggagacggccggctgcagtttaccgatgtcataacaacatgggcctggagcggctgatcgggggtgtggtaattatagcaatgacagaacttggtctgcacgccgcgtgtgcgatgcgagggaagcagcgaggtatcggattaagctcaaaacgggaggaggaaacaaggatgactggagtcaaggaagtcgtcatgaagtaatgttttaggattgggtcgtgttccacttttaaatgaaagcgttcaaaatatttgatttttaaggtttcaactcagaacaaacgattgccgagtttttgtttgtattttaaagagatggggtctcgctatattgcccaggctgtactccaactcctgagctcaaactgtcctcttgcctcagcttcccaagtagctgggactagtcttgggcaaccacacccagctctgcagagtatttttttttctgaaacgtactgtcaagtaatattaacttgaatttcacccttttttcttaaataaacggttgcttaaaaatctctattagtagatgaagtgatttcccccctcctgttttgtttttttttttcttaagagatggagtcttgctttgtttcccgggctgatctggaactcctggcctcaaggcatcctccctactagctggaactacaggcggatgccaccagcaaggctcattctcgacattgtttttgtcttaactagcttttgcatttgtaatattttgaaagcagtacacaagttatttttccctcctttttaaagatcaaagagatgaaaatttaatttttcaaaggaaagtaagaatgagttctgttgtatttttactgaaatattcttggaagacactgttttatggatagatgagacgtaagagaaagtaaaggaattaacatttattgagttcttttttcaggtattgtgttaaatgctttacatatattaaaaacatttgaatctgaagtatctgttaatttttctattttacagatgaaagcattgacaatcaaatgttaagtaacttacctaaggtcttccagttcttgttgagaacaaccttagaacccaaagttactgccatttaaattatttctctcctttcatactttttcgttgttttctttatttaatccgttcaatcagcgaatacttacagagtgatcttctagacttggggggatatagtcgcgatcaaaactcactgtccctgttctcatggaatttatagtgtagcagggaaagctaatattacaaatattgactgcataacattttgtcagttattatagttgagtagcaactgtaaagcactctactaaatagtaaaggcagttcaaatggaagcagacaacataagccttgaggagtttacagtcctgtagggcaacaaaacatacatttatgaaaacctagaataaactaaattagaaaggtatcacctgaaatcactatacttgcattatggtattttttattttatttatttatttttttggatgcttgctctgttgcccaggctgggcagtgacgcgatctcggcttactgcagcctctgcctccctggttcaagcagttctcctgcctgagactgcctgagtagctgggactacaggggcatgaggccacactcggctaattttttgtattttagtagagacgggtggtttcaccgtcttgcccaggctggtctcgaactcctgagctcacgcaatccgccctcctcggcctcccgaagttctaggattacaggcatgagccaccgcgcccagccgcattatgttactttataaagtggttctcgtagaagtttcttcacagaactatgatttaatatacatcttatctagagctgatacttaccaaaggggccattaaaaacatcttttcttcattaatatctaatgaagaaatttctaatttatgtattggttcctataaaatacagaccttagagacaaattcttcctaagaccccagtattaagctttttttttttaaactaatgattggttttattagattatttttgttttgtaagccatcctgtttctctatactttgactgtcaggagtctcagagctgtgttcaatttttataattttctttagtctcaactatgttaagaattattttatacgtaacctggaattgctgtcagttgtttcttgcattattttctttattctctgttgctctcaatggtccttttaccttttcccttttccctttacatttgagaataggattatatcttattctttgcatcttcagtgttttagcacagtgtttgttgaattaatgataaaatagagttttaatgatttatgatgtctgtgcttttaagtctaccagattgtttttagatgtatgagtactgtgtataaaatcagttaagacctttgattggtcttgcaagtaaagatgactgacctagtgataaagataactccttgttttgttttaaggtatctttgtactttgcatggtgttatgaatttagccataatagggaagaaaacactggaaatggtaaacagttaaattagctgatttgggctgatttctgtcttttgctgcagtaagcaggagatggcctgaggccaactgagggccagatagggcctgcattagaaaattttgaggttgtacattggaagagtagggatgaagactgtgggaatgtatgtttctttctttcttttttttaaagatgttacaaacctacaaaacaacatgaaaaaatggttctgtccaagtgttgtagactaattgggacagttcttgaaagcaggcagtaatccagaatgtggataatggagataatctccttcatattaacaagaataatgctgcccttcatatacaaagataagtctgcttactcatcatgattgtttttccagcgtgaggagggatatgtgctgagtccatgagtgcctatatactctgtgagcaacaaggcaggttggggtcagaataggcagcttggggtcagaataggcagcttggggtcagctagggaacagaaagacccgctgaaagtactctgacatctattgatgggtcaggttctgcatcaggtgctttcacttacttgttcttgcaaaaccattttgaggaggtgattacgtgtgcaaggtgattgggtaactcgccttacttcacaaagtagtggagttgggattcaaatagggctgtttgtactgtgttcacattgatcgttaaagattggttttagccgttcagtctctttggcagaacaaactagatgtagtttaacaccatgaaataatactgaagatctaatataaccgtcgtgagattgttcaagttccttgttttatcaacattaaaaaaataaaattttggaattagaatacctgaaaagcagctgttccctgtcccagcctctgcacttgaaaagctaccattttctttcttctagctgtttcctcttgtgtttgctttcatatttataaatacagtgacttgcttttattgctatatcatgatatagcaattatagatattattggctttcgtctaagcaagatgttccttagtgtttcacatatatattcacctcacctgccatatgcacacactgtctctaccatcctccaaatatagttatcacaggtgtgtctactaaaccaatatttagtgtttacaatattgtaactctataaatgttcacagctgacccatgtagagtactgtgatatcatttcttctcttaataaatttttgtttttctacaagttagtattttttgttgttgtttgcttcatttcctgagacagctaacctggaacctcttaatgcaattaggactggttactttctaggcctatttcatagttgttatccagggacttctcttttcatcatccttaaacttctttgccctcttttgtactggttcccctgtttactgtttcctgtattttctttcttggtttacttatttccttggagtacattttttagtagctttctgagaaaggatacatggaaaacaaaaacttcctgacatcttacatgactgaaaaaaatctttattcttccttcgcatttgatcagtaatttgtctgggtataaaattctgagttgaaagtaacttctacttcaagtttgcaagtcatagttctattgttttctttcttccagggttactcttgaaatccaaagccaatctgattctttgtttgtatgtgatcttcctttaccccaatctctagaagcttttaggatatttttaaccctcaaaattccatgatgatgtgtctaggtatgggtatttttttgtttaagggcattccatggacctttataagctgggagttcatgtcctttagttctcgaaagtttttgttattatttggatgttaggcaaaaagaattttagaatgaattatgcttctcagttcttgtcacacatcagatcgtacaaggtcctttaaatttttatcttaaatttctgagccctacttctgttacctctttgtataacattgtggttggtacattccttgattatatatgaaacattgtaaaatatgtagtggagctgtgtatgtttaggtattgtgttatagaccttgcaaaggtctttttcttttttattcaacattgatttggggatctttctgttttgttgtaagtatgtatagttgtgtctaatgtagaattctgtaatgcagatctaccacattttacttttcattccctaggaattgatccctgagttgcctttctgctatttcaaataccctgtgttatatatactcttgtacattattatagacctgtatagaagttctctaggatatatacccaagattgtgattccttgggcatagagtgggagaattagtgtatgtgcctacttgagtgcttgagagttcttttttgctcacatgtttgcctttacttggttttatctttcttttttttttttttgtttgatagagagtcttgttcagttgcccaagtgagtgcagtggcatgatcttggctcaccgcaacctctgcctcctgggcttaagccattgttctgactcagcctcacgagtagctgggtttacaggggcccgccactacgcctggctaatttttgtatttttagtagatacggggtttcaccatgttggccaggctggtcttgaactcctgacctcaagtgatccaccctcctcggcttcccaaagtgctgggattacaggcgtgagctaccgcgtccagcctctcattcttattttatagtatatttgtgttgtttcatagatgctgtattctttctggggatattaatgatagttttaaaaattttgttaccattgttgtcttttctttattgaggctttccccagatgtctggtagtcttgtggctgtccattcatatttaagaatgaagtgccaaaaactgaattggaagctctattaagtgtggcttgttgaagggtgaagagagtagctggtggccattttttttgtggtgggtggagggcatatactcataggtttgtttctcttgggctagtcagtttccctgagagtctccagtctcttgccaggagaatgtgtgtctggctgccatgttttgagaactcattttagaaaaggagcttgggtttttactgttgtgctcatgtaattctgttatcaataaggcacctcacccccaccctcacctgcattggagcacccatttgaagggattactgaaggatggttgtctggttgtgaagagtggaggaggaaatctgggcatgtgatggctgttttgtagactttcaacaaaccttctgattttgagcccaactcctcactaccttaaggagggatagtacctggatgatctgtctgaagcatcctgtttgtgggtaggtagtgtgaatcagcttgtttcttattgccttcttcgtttgcaggttaggcttcagagttttccactttgctagtgacatataatttgtctattttatggcttcttttaggttttgacaccatctctgattcttttgcttacctattctctttatgccgtggttctggttcatttatttgaaaaaaaaatttctttataattttagtattctaccatgtctaccattttatttctttacataaactctttgttttctcctctgttcattttttcacagcatttgaatgaccactgtgtgcctattgaagattaaaattgaatttctggctttgagttaatatgatatgggaagaaaagtgcagtctatatgtgctaattcctgatttgaaatttgaaaaccctcataagtgttcttaaaacagatatattacagtggttattaaattcattaatggatatgaattgaatgaaggcaagtttttgcgattaaaaatttttttactactgagggaacgaaccctttatgtcatcttctggaaagatttgtctttttttttttttaaccccccaaaaaatcattcaacttttagataagagataatttttctccttcataaagaccataaagatcagaacttctgaagaaataacagcatactcagttgaaaaaatagtagtgaaaagtatagaaattcagtgttttaggtaggttgataagctttatcatagtaaacatatgctttcagctctactttttgaaagtttttttcttgtataatcagtatattgcttatcacagaaaatttggaagataaaataatatttccatattcaaattttatatgctgatatcttctcttttctttttttttttttttgagatggagtcttgctctgtcgcccaggctggagtgcaatggcacaatctcagctcactgcaacctctgccatctgggttcaagtgattctcctgcctcaacctcccgagtagctgggattgcaagcgcccgccaccacgcccggctaatttttgtatttttaatagaaatggggtttccccatgttggccaggctggtctcgaactcctgacctctggtgatccgcccgccttggcctcccaaagtgctgggattacaggtgtgaactactgcgcccagctatattctgatttcttaagttacgaaatatttttcgaaagtatagagaatagtgtaggttgggtttttgttcccagcattcagatttttcatgttagtgttctgttttctcaatacattgtgaacatttcctttaaccaagccctcatattggaacttttaggttttttacaatttttcactagaataatcacactgcagtgaacagtcttacacatactactagttttgtttcctttatgtacattctaaaagtggaagtattcaattcagggtttgagttctccagatccttgacagatattttcctttaagtgttttgatattgagaatgtctttggagaacttcccagcttgggaacctatagatactgggagttgggggtcagaatttggggcaaaggttatgataaacctctcaaaggaaaacatttgaaactgggctgtgaaagaaaatatgtattgccattggattattggttagagctataagatgaggccagagatgaacacctatgaatcatatgtctgccacattgacttctcacaggaaaagctttattgaagggtttttcaaactttgctttcattgaacactgaaatgctcttaataaaaataaagctactccttaattatcgtataggaaaagaatgggtaggatatttcaaattttaattttcttttctaatttctattaaaatattttaaacggacctactatcgtttgactagaagctgttaacatcaataatttatattttcaaatgaactgaacactttatacttatactccacttatttaaattcataacttttttgtagtcatactttcttgtagttttggtttttaatagtaaatgcatatcatatactttctaataaaattatgcctgatttatatggtggaattaagtatattaggatttcaagttgttccacaagagtattatggattttaaatattcagaacatttagaatgtgtttgagatttactgattaggtgggctgacccagtgcactgaatatataacatcttgaatataataaaaatataaaaagatctacactcattgttttgggtttagagtggtggagaatggtattgaatgaatccagacaaaaggatcttgcaggaccaagaagtttagacttgttctaagaagtggttaaaaacgttgtagttccttatccattgaagtgatacagtgaaaagggtgttgagattaatctgagggctgtgtaggatgaattgaggagcaaagagtctgaggttaagaatgctggtttagagctgttgtagttatctaggtgtcagttgacacagacttgagccaggctggtggcagtgggaatagatcggatcagataaaatcaaagactttggatagaataagcaaaatttgataattgagtaactagacatgaaggagaaagtgaggggatctgtctttgaaagagtgtgtttctatttcaccaccagtattgcatcttgtttttaagtttattgcttctttggctttatttctctagaaaacaagaggaaatttaggtataatggctttaattttgaaggcttctgattcctgagagggtactttgaaaagtaacttacaatttttaattagtagcttaggtgataacacctaaaaatatttgcttaggataaactaattttctcatacaattactttgttattcctcttattacagacatagagatttatttcctttctttcctatcaaagctatcttcagtccaacttcagccttcattttcaactgtattttacattgttttaaaataaaacttttgctctactatagtgattttcaactgcagatgcatatcagaatttgcttggatttttttttttttttttttttgaggcatgcagtggtacaatcctggctcactgcaacttctgcctcccgggttcaagccatacttatgcctcatcctcccaagtacctggactcacaggtgcatgccactatgctggctaatttttgtatttttagtagaggcggggtttcaccatgttggccaggctggtctcgaactcctgacctcaagtgatctgcccgccccttggcctcccaaagtgatgggattactggtgtgagccactgtgcctggcccacttggggatcttaaaaggaagaaaaacccagaggtgtctgtctgcttcagacacattaattagactctttagagggacatttgaggcttgtgtttaaaaaaaaaaagagtctctcccaacagaacaaatgtaatcccctctccatcctaagagggggcaacgaatctcatttatggatactgatgagatatttatgttttaaaaaatctctctctctctctcacccaaagtctaaatgcatccattgaagtaatagagtgaaaggagtgaaacttaaaaatctcaccagtatccataaatgagattggttgtcccctcttggggtgggaagtctaaatacacacatacatgcgtgtgcgcagacacacgcacacacacacagacagtttcttagagcagttttgggttcatagcaaaattgaatggaaagtacagggtttccgtcaaccccttgcccccacatgaatatagactctcccaccatcaacattgcacaagctccagaatggctcatttgttacaagtaatgctgtagactgaatgtttatgtccccttacgattcatgtgttgaacccaatctccagtatggtggtgtttgaagatgaggcctttgggtgatgaaaatggagccctcatgaatggaattagtgcccttacacgagatcacagagagctccttagccccttctgctatgtgaatacacagtgaaaaaaatggtcatctgtgaaccaggaggtgggtcctcaccagatactgaattagccagggtcttgatttggactttccagcctctagaactgtgagaaataaatttctattgtttataagacacccagttgatggtgttttgttacagtagcctgatcaagctaaaacaattgatgaaccaacattggcacatcatcctcactctaagtccatggtttacattatggttcattcttagtgttgtacattctttgggttttgacaaatgtgtaatagcatgcattaactactattgtatcatacagaatagttttcctgccctagaattcttctgtgttccacctgttaatcctgccttcccccaaaacacccagcagccactgggttttttgtttgtttgtttctggttttacctcttccagaatgtcatataattggaatcatacccgtgttttttttcaaacagctctcagtgtgacaaatataacaaatagaattggaaaggggtaatacacaccatcaccaagtgtgtttatccaaagaaacaggatcatttggtattagaaagtctattaatataattcaccatatttaatagttcaaaagagaaaaaataatgaccatttcagtaactcccaagtataaactatacaagggccagacagtgggaagtatgcttttacatgttcttcaccttatgaggtatcattatgtccattgtacagatgaggaaacaggctcacagaagtctactgtcttctgtatgtgattggtctgcaaagcaaatttgaacatgggacttgtggaaggctaggcttcatttattcaacttgctgcctatgacactttaataaaaaagcagttgaatatttaatttttgcgtaacatttctttccttttagattttttaaaaagtttggaatcatttcaaactacaaaaacgttttaagaagtgcacgagacttcctatatgccttcattgacatttctcaattgtttatcttttgccttatttatcatttattctttctttctttatatatatatatatgtatgcatgcttccaacactggctttaattgcttacccttacaactccacattgaatacagacctctaagttacttccttaagtctaattttaggtttttggttttgttggagtttactgttggctttttcctttttttgacctgaaactgaaacttaacgaatctttttttttgttttgagatgggattttgctcagtggtgcgatcttggctcactgcagccttgacctcccaggctcaagtgatgctcccatctcagcctcccaagtagctgggaccacaggtgcctgccaccatgcctgtctaatttttttgtattttttgtggagacagggtcgctacaaaactcggctcaagtgatcctcccaccttggcctcccaaagtgctgggaatacaggcgtgaactaccgcgtcccactcagattttgaatttgggacatcattgcaacactactattattgtgccatattgtgatatttcatagctaaaatgctgcctgcttcaggaaaccagcactcttctttatatcatttttcatcacctttaaatatgattcccttggaattattcacaagttctcatccgtattacacccaccttttagtctgataaagtttctgccagatttccactgagtagacatattaatctgctcaggctaccataacaaaatactgcagactgtgtggcttaagcagaaatttattttctcacagttctgaaggctagaattccagatcaaggtgccagcagagttgatttctgggcactcttttgcttgcagacagctgcattcttgtcttcttatgtagcctttctctgtatctctcagagaagtctctagtgtctcattctgttataacgacaccagtcttatcagggtgggaccctcatgacctcatttaactctgcctcctaaaaggcactataacaaaatacaagtcacactggtggttagggtgtcaacataagagttttgaggggacggcacaattcagtctctctcagtagatcactgggtgtataatgagacctgtgttcatatcctagctctatcttgtatttagtgtgtaaccctggccaagtcactctgtgagccttctgattccttatctgtaaaaggtgagaatgatattttttgccataaaggtttgttaagagatccaaataaaatagaagatgtggtagcatgttataaattagtgattctcaacccaggtttgcatcaaaatcatgttcgtatatgtaattatttatgcagcttttagcataataaggagctctgctgacccactacccagtaaacttagggtaaagtatttcaaaaacaaccatggaaagcctctggaaatggtcctaggatatatgcagtaaatgaatgagagaagcaaaaactgacagaaacagagaattcagtaataagagttggaggctttagtaccccactttcagtagaggacagaacaacttggtggaaggtcaagaaggaatcagtacaataaacccactagacctaactgacatgtatagaccacactaccagccagcagcagtcaaaaatatgtattttcaaatagaaatatgtatatcctggaaatatgtgttttccaggatagcaagtgttatgtgtgcattttgctgggctacaaaacaagctagataaattttaaaaggatcctgttctttgatcacaatggaaagaaattagatcagtaacaggaggaaatttgagaaactcaccaatatgtgtaagttaaagaacatactcctaaataactgatgggtccatgaagaaatcaaaaaggaaatcagaaaacactttgggataaatgaaaatgaagacatcgtgtaggaatacttagggatacagctaaagcagtgcttaaagggaaacttagttgtgaatgcctttgttaaagaagaaaggatgctgggcgtggtggcttacacctgtaatcccagcacttcaggacgcggaggtgggtggatcacttgaggtcaggagttgaccagcctggccaacatggtgaaacctcgactctactaaaaatacaaaaattagctgggtgtgatggcagtcgcctgtaaccctagctacttggaaggctgaggcaggagaatcacttgaacctgggaggcagagattgcagtgagccgagatcatgccactgcccttcagcttgggcaatagagtgagactctgtctcaaaaaaaaaaaaaaaaggaaagaaaagaaaagaagaaagatctcaaatcagtaacctaactttccactttaagtgactgagttaagaagagcagagtaaacctaaagcaagcagaaggaagcaaataaagagtagagtgaaaattaatgacatagagaataggaaaacaatagagagcattaaagatgaataaaattgacaaacttttagctagattgagaaaaactcaacatttttcagatttcctgggcacagtggcatatgcttgtaatctcagcactttgagaggccaagacaggaggatcacttgagcccaggagttcgagaccagttgcccacatggtgagaccctatctctatccccctagccccccagcccaatatataataataatctgggcatgcacctgtagtcccagatacttgggaggctgaggtgggaggattgcttgagctgggaggttgatgctacagtgagccatgattgtgccactgtactctccagcctgggcaacagagagagagagtatctgggggaaaaaaaaaattagaaatgaaagaggagacattactagtgaccttgtaaaaattagtaaggttataaagaaatactgttaacagttgtggctgggtatggtagctcatgcctataatcccagcactttgggaggcagaggcgggtggatcttctgaggtcaggagtttgagtccagcctggccaacatggtgaaacgctgtctctactaaaaatacaaaaagtagccaggcgtggtggtgcatgcctataatcccagctactcaggaggctgaggcaggagaatggcttgaacctgagagacagaagttgcagtgagccgagattacgccactgcactccagcctgggcaacagagtgagactccatctcaaaacaacaacaacaacaacaacaaaaaaacagttgtatcccagtaaataaaatggtttagatgaagtgcacaaatttttggaaagacaaaaactaccaaaactgactcaataagaggaacagacaatctgaatagacctgtaacacgtgaagacactgaaatagtagtcacagaactgcccgcaaagaaacagcctaggcccatatggctttactgctgaattttaccaaacatttaaagaaataatataattcttgacaaaatcttcctggggaatactttccaactcattttatgaagctggtatcactctgataccaaagccagacaaagacatcacaagaaaatataaacccgtctctttttttttttttttcttgaagagacagggtttcactgtcacccaggctggagtacagtggtgtgatcatggctcactgcagcctgcaactgctggactcaagccatcctgctgcttcagcctcctgagtacctggaactacaggtgcacaccaccagcctgtctgatttttattttttaaattttttgtagagatggagtctcaccatgttgcccagtctgatcttgaactcctggcttcaagtgatactcccgccttaacctcccaaaatgctagaattacagacatgagccactctacccgtcccttgtctgttaaaaaaaaagaaaaaaaaatcacattgtgatatcaatagacacagaaaaagcatttgacagaatctgacactctttaattataaaacagtcaactaggaataagagggaacttctcagcccgataaaagtgcctttacagaaaatccaaaggtaacatcatgcttaatgtaaaagactgctttcattctaaggtctagcataagacaggggtgtctgctctatttctattcaacattgtattggaggctctagccagggaagttagacaagaaaaagaagtaaaagacatcaaaattggaaagggagaagtaaagctatattgtagacgacatgatgtgtatcaaataaagcattagcaccaattaaacaagttcagcaggattgtaaaatacaagatcagtatacaaaaatcagttatatttttctagatttgtgaacagtctgagaattaaaacaatttcatttccaatggtataaaaattaaatacttaggaatgaatttaacaaaagtataaaacatattctgaaagctacattacattatagacagaaattaagatctaaatagagctcctatcttaaataagtggaagatttagcattaaggtgccggtatttcccaaactgatctacagacagtgcagtctcttatcagaatcatagctgacttcttcatagaaattgacaaactgattctaaagttcatatggaattgcaagggatcaattatagccaaaacaatcttgaaaaaagaaccaaaaaagtaagaagactgacatttttcgagttcaaaacttattttgaagcaatggtaaccaagacagtgtggggctgacacagggatacacatatagatcagtggaatagaattgaatgtcaagaaattaaactatatatatgtatatagtcagctggttgtcagcaaggtgctgtcatggtccgtttgggttgctgtaatgaaataccagagactaggtggctaacagacaatagaaatttgtttctcacagttctggatgctgggaagtccaagatcaaggcactggcagattcagtgtctggtgagagcctgcttccttgtttacagatgccttatcttttctctgtgtcctcacatggctgaaggagcaagcaaactctttggggggtctctttttaagggctttaatcctattcatatggactctaccactaagggctaatcatctctcaaaggcttcaccttcaaacactatcacattgggagttaggatttaacatatgaattttgggtgagacacacattcagtctatagcaggtgccaagaccattctgtggagaaagaggagtcttttcaacaagtattgttgggacagctggatagacacatgcaaaaaaatgaggttggactctcataccatgctacaaagaaaaattaactcaaaatggatcacagacttaaatgtatcagttaaaactcttggaaagaaacacaaggttaaggattcttggatatgacaccaaaagcatgaacaacaacaacagcaaaaaacagattaatttggacttcatcaaaattaaaacttctgtgttttaaaggacaccaagaaagtgaaaagacagtctatagattatatttgaaaagcatatctgataagggacctttatctagaatgtaaaaagaactcttacaactcaataataaaaggacaacctaatttaaaaatgggctaaggcacttgaatagacttcattttaatgggagatacacagttaccaaatacgtatgtgaaaagttgctctatctcattagtcatcaggggattgcaaaccaaaaccacaatgagttgccactcacacccactaggatggtttcaatgaaagttttaatagcaaagtgctggcaaggatgtggagatactgcaagcctcatatgctgctgaggggaatataaaatggcacagccactttggaaaaacagttgagcagtttcttaagcaattaaacatagttaccatatgacctagcaattttagatatataacccagagaaattaaaacatatctgtgtaaaacttgaccacaaatgttgtagaagtgttattcataatagctgaaaggtggaaacattccaaatgtccattagctggcgaatggataaatagaattgggtatatatatagaatggaatattattcagccataaaaagaaatgaagtactgatatatgctacaacatggatgaaccttgaaaacatgctaagtgaaagaagccagtcacaaaatactgcatattatatgattctgttctgttcatgtgaaatgtccagaatagggatgatagcttaaacaatacaggatttctttttgaggtgattaaaatgtcccaaaattcactatgatgaaggttgtacaagctgtaaatacactaaaaactgttgaatagcacattttaataaaactgttaaagtaacctggccaggtgaagtggctcacgcctgaaatcccagccctttgggaggccaaggttgggggatcacttgaagctaggagttcaagaccagcctgggcaacatgatcagaccctgtctctacaaaaaataaaaaaattctctgggcatggtggcatgcacctgtggtcccagctactcaggaaactgaagtgggaggattgcttgaacccaggaatttgaggctacagtgagctatgattgcaccactgtactccagtccgggtggacagagcaagaccttgtctcaaaaaagacaggagtgggggaggggaagtagccatttctgatgtccctttgggatatgtctgggcatgtatatgtttaaaagactgagctcttagaataacagagctcttcacagtaaactcatttgttctctccccacttgtattgtagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcaggtaaatcctttacctttattcatttcttttaaagaatttaatgttccattttaagcctgaaactatcttcattttagcaaagttggggtgtgtgtgtgtgtgtgtgtgtgtgtgtgttttccccttctcccctgtaaaatcaacacttttttggagtggggatgaggaggtactgaaaagtggtatacaagaatggggaaatctctcaggttctcattttctcagcataactacactattcaatattttcacctatttgtgtttagtgtattttagttttctaagggtgcaactttcttctttaagatttttttgatgtatgtttgttaattaattcacaagtgaccactaaagtgttgctgttcattgtaaacttaaaattggaaatgtaaaaatatacacaaaaagaaagaataaacctcatacataaaccagtcctttggattcagtaattgtcaacagtttgctacacttgcttcgtgtttgtctttacatttctttgttatctaacattttaaagtaaaatttcattcacagaatatgtctttttattccagattaattctgtattattcataaagacatttagaacattgattttttttttttaagccttcctttgaaaatgctgttgacaaatggtctgttacattcggcaaagaaatgaaaagacataaggcttaagtgactttttttttttttttttttttgctaaggagagactttggagcctgaaggaccatttgaccctcactatagaaattccataaaggcagatgaattagaaccctcatgcttgagaaataagatattctattataaatattttgcagttatagtgaaatattctcaaaacacattttatgaaacactgcgttagataatccatttaggtgaagtccaacagtacattacaacctcagtattttatttgttagagttgtatgaatcaagcactttattattggcaaaggtattttgtaatattgtaatagactttatattgagtgcagcaaattaagttatgagttcttgacctgctttatcatctttgaatgtatccacttaattttctcttatttattttttgaactgaaaatggatccttttctttcacagagcttttaaattagttctgttttttgggtgaatttccttttctttttttttttttggtttgtttgaggcagagtctcgctctgtggccaggctggaatggagtatggtggcgtgatcttggctcgctgcaacctccacctcccaggttcaagcgattctcctgtctcagcctcctgagtagctgggactacaggcgcgtgccaccacacccagctaatttttgtatttttagtagagacagggtttcaccatcttggccaggatggtcttgatctcttgtcctcgtgatctgcctgcctcagcctcccaaagtgctgggattacaggaatttcctttccttttattctcagaaatcttaacagcatgattatatatttatattcatatatttaagtggaatacatgtatgatacatgtgaacccaggtaggtataggtctgaatataaccaccagtctagggatcgtatttggcataacaccatttgaaggtgtagcagtggcactctttgattaacacgatgttcattttattctgtttcttcttggtgactactgatttcatgtaattaaacttcattataaaatttatatactaccgaaagcaatctacagattcagtgcaatttctgtccaattaccagtgtcattcttcacagaataagaaaaaacaatcctaggattcatacagaaccaaaaaagagccccaattgccaaagccatcttaagcaaaatataaagctggaggtatcacattacctgatgtaaaattatactacaaggttatagtaattgaaaacagcacagtactggtataaaagtagacatataagtcaatggaatggaatagagagtccagaaataaagccccatactgtcaaccaactgatctttgacaaagttggcaaaagtatatactggggaaaggataccctattcaatgaatagtgctgggaaaattggagagctgtgtgcaaaagaatgaaactgtacccctaccatatacaaaaattaactcaagatggattcaataattaaatgtataacctgaaactataaaaatcctagaagaaaacctgggaaaaactcttctggacattggtctaagcaaagaatttatgagtaagtcctcaaaaggaaacaaaaccaaaaatagataaatgggacttaaactaaaaagcttttgcacagcaaaagcaataatgtatttaacagacaacctacagaatgggagaaagtatttgttaacactatctgacaaagttctaatgttcagaatctacaaggaactcaaacaacaagaaaaaaacaactccattaaaacgtgggcacaggacatgaaaagatacttctcaaaagaagacatacaagtggccatgaaaaaagggtcgacatcactaattatcaaataaataaaagttaaaactataatgaggctgggcggggtggctcatgcctgtaatcccagcactttgggaggccggggtgggcagatcacctgagatcaggagttcgagaccagcctggccaagatggtgaaatcccgtctctactaaaaatataaaatttagccagtgtggtgatagggtaaaggagggcactttcagtataagactatgttcttgggaattttcctgtgttaattcattgagaagctccttccttcctcatatcctgtaagtcaaatgttggatttaccaggctggttttcttaattttctctttttcaaaccgtgcccttgttctgctgcctcaccacagctttccgttacagctcaattaagaaaaattcctgaggctttccaaggctctttgtggtttgtgggcttgcttctcaacagtatatccctccataggctcttaggtttgatcttcctccactctaactcgtatattgtttctcaatctgtttttccattgttgtagatatggctgggagctacacatactgtttttttttttttcttgtcccttttatcattgtggggtagtatttctgagactaaaaggatgggaaggcctgattctactatttttaatctgtatgtctcattgtataaggtagattattatgttgattagtttacaactggcatgaaaattttattgaccttgggaagaaaaactataatatgttttaatcctgttgtgaatagagctggacagttctagaatagtgtagtggattaatgatgaagtattgatgataacagttaactgttgagtgtttgttatgtcaggtactattttaagcacttaatgaattaacctttctaatcatctcaaccaaactctgaggtaggttattattttctgatatgttatagttacacaataattgtgaatgtctttaagtatctgattatggacaagataaagcatatgtatataaaaacactgaaatggatagaaaataaattcatagcattactggtcctttatccgaagctcagctaagtggttacagcagttcagtgtgaatgaccattgccgtaaagaataatagcctttttctctggaaagaacctttgcaataatctagaccagcaatgttaaaattatgttctgtggagctttgaggctctgagttgagtctcctgctgcttctgttcccccatgaaacgtttgaaaatggttgagctatgctgtccaatatgagatagtcactagctacagttagctattgagcatttaatatgtggctaattcaaattgagacatgtaagtgtaaaatttacattggatgttgaagcttccatatgaaaaaataatgaaatctcaatttttatactgaaatattctagacatgggttaaataaaatattaaaattaattttatcttttatttcctttttcaaatggctgctagaaatttttaaaatttcatttgtggctttcattatatttctgtaggacagtgcagatacaaaccatgtttctattttataccaaaattttgagtttgaatgatttggccaagattacatagcagataagtagaaccaagatcttctcacatctgaattagtgttctttctacaggattgtgcagcattaggtccacctgataaaagttgtactggcacgctgtgacacaaatcttgtgtttgttttgcagagcaggattggaaagaaagcatagttaaaatgtgatggtcgggccgggcacggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaatgtgatggtcaaagcattgctttgcatgcttagctcacctcttataactaacgattaaatgatattgattatagctatttagataccgtggtacatctcttattctgtatgacctctattacctttttgggattatttcatttaatgtcattttaaagattttcacagttgtccatcatgctgagacgttttcgcttgagtagttgcataacttgcatgttttccaaccttttactgcattataaattgtctttgacaaatttaatgtgttaatctcattcttccacttttatcaaaccagtgtttgtgcttcttttggctagtagtattagttgcatgtttgtcagtttgccctttgatttcacctgtttaaccaacggccgctacagtttttatcactgcattaataacatttaacatatcttgaaagtggttgtacattttaaaaatattttctgttgctaattttttttctagcagttttgaatactgttgacatagctttgctgttctaagtcaaatattggacgagcagtcgtgtttttcatgacctgtagtacttaaagatcactaacagcatcccgctgtaccaaactgcctgtgcgtataaactgcaataccaatagatgtaatgttagtgactgggtatgattttggaatcgtgtaaatgttttaaataactgtaaaacaaaattaaaatgagagaagaaatcctcaaaaagaaggaaacaagtgacctggtttgtcatgcttgtggctaagccacacagagaagaattattttagtatacctttaaactgtggtaatttgactaatttcctctgctagtttatatcttaaggacaaaaaagaagtataaatgaatcttcacttgcttttggtaatcatataaaattggtagttatgaaactatatatacatttgtatatgaataaaggaaattcatatttatattaatattagaaacctgatacttttagtttaagaaaataagtaaataagaaaattaaagaagttaagtaagtttgaattggtaatatcactgggaatttatgatatattttctttaataaaacaaaacaccagctctgtcctgagaaggcctagaaatagcaaattacctttttgcagtgagcactggcattctgaggtatttagaattttttctcaaaggaaccaggttccttgcaaaaataactggttcttggttaaagatagggaatattttataaagcaaagaagttttctgagatcactggagttttgttgaaaagactcagagccaacttgaactagctcctagctcccattgggtaaaaatagggtattttgagtatcagaaaaggttataaagacttctgcttctggccaaaatggagtattaggaccaggatttaccttcctacctgaaggaaccaggaataaacagataaaatacatgaaaacagcagttcaagacactaggcattaggcagtggaagatagtgatctctaaagatgggaaacaaatgagataaatcctgtgattatctcagctttctagttgtaaacatagaaagaggcgctaaggcagagcccacagcctcgctgccttgaggcagagctcagagtctgtgaagaccaggcaaatagagtttcgtaggatggaatatcaaagaagagagacctgtatattgagtgaagcctgaaaatcttcaaaggctttcctcagatattcagcagaatgctgattagcacatgtgtttgaggaaactacccaaggttagagaaaatatcattttaaaggattagacggaacagtgcctggtacttacacagggctggaaacagtgcctatccctctagctggactggagaaactcataattcatgagggattaggtagagtattcaggagagccttgcctcagtagtggagattaatgagctgtatacttagtactgctccatacttaacctgacaaatgaaaacaaggtccaaaaggatcaaacagtttccatataacttagctgtataccgaaatggagctcaagaatgtttataggaatacgaaaatatccagtacacgaggtaaaattgacattgtctggcatccaaagattgtgacgtatacaaaaaagcaggaaaacacaactgtaatggggagaatgatcagttgaaactgactcgactgataaagatgttagagttatcaggtaataaaatataaatggttattataaccataccatattccatgtgttcaaaaagttagagacatggaagataaaaaaagactctgccaggcatggtggttcacacctataatcccagtgctttgggaggctgaggtgggaggatcgcttgagcccaggagcaacataacgagtctaccaaaagataaataaataaaaaacttagccaggcttagtggcgcacgctatagtcctaagtcccaaggttgaggtgggaggatggcttgagcccaggagtttgaggcttcattgagctatgactgtgccactgtgctccagcctgagtgacagagtgagaccctcttaaaaaaaaaacaaacaaaaaaaaacaaacaaagtaaaaaggtataaaaagactcaatttgaactcctggagataaaaactgtgatgtccaagatgagaaattcccaaatgggattgattgcaaattaaaaattgcagaagaaaagattagtgaactctgggcataggaatagaaaccatcaagaatgaaaaagaggtaaaataacccacccccgccctgccctgacacacacacacacacacacacacacacgcacgcaaaaaaacccacaagcgagttatgggacaacttcaagaaagctaaatacaggcaattggagtccgtaaaggaaaagagagggtggaagagaaaaaatatttaaagaagtaatggccgaaaaccttttataatgaagaactgtaaatccactgattgaaggaactaagtgaatccccatcacaagaaagatgaagaaaactacgtcatggcatatcatagccaaactgctcaaacccaaacttaaaaggaaactcttaaaaacgcccagagtaaagacatgttacctgcagaggaacagagataaggatgacatcacagttctcgttgtaaacaatacaagccagaagacagtggagaatcgtttaaggaaactgtcaactaaagaattcttcacccccagacgttgcactgagacagaagtaaaataatgtcctggattacttgagcaaatcccagctatcaaattattttatctgtaaatacttcaatatgtatctctacagaataaagattctttttttcttttctggagacagagtctcattctgttgcccatgcaggctagagtgtagtggtgtgattacaactcactatagcctcaacctcccagactcaaagtgattcacctcagcctccctggtagctgaggctgcaggcacgcaccactacatctggctgattaaaaaattttcttgtagagatggggtctcactatgttgcccaggctggtctcaaactcctggcctcaagcaatcctcctgccttggcttcccaaagtgctggcattacaggagtgagccactgtgcccagtcccggataaagatttttaaacttaaaaatcatcaaagagcgcagtcagcttttcacctcaaattttagcagtcttccatggtcccttcctagatccattacttttataggagttacggggatcatttcttctgcttttattagctggaaggtcattcagaatagtgttatcatactttaaaaagttagttttttaatattaagcatctagtcaacattcagattttctacattgtcacaaaatcttatgtttgtttcttagagtcagaaactaagtcatacattgtatttggtgctgtctcttaactgttttaaaaaatttttattaataattggtgaaaaaatttttcctcttactcatttttaagtgtacagttcagtagtgttaacaatattcacattgttatataacatatatctagaactttttcatcttgcagaattgaaattctatgccacattaaacaagtattcctcatttctcctttcccagcttctgataactggcattctactttctgtttccatgattttgatttctctagatatctcatataagtagactcgtacaatatttgtcctcttgtaactgacttatttcactcagcataatgacttcaaggttcatctgtattgtagcttgtgacaggatccctttttctttaaggctgaataatattccattgtatgtattaccacattttccttattcatctgttgatggacatttgggctgcttccacctcctggcccatgtgaataatgctgcaatgagcatgagagtgcaaatatctcttttgatattctgttttgaattcttttggacatatacacgtaagtgggatgtctagatcataatgataatttcatttttaatatttcaagagcctccctactgtttttcatagtgggtacacgttttattttatggtagttttgatttccatttgtctaatgataagtgatgttgagcatcttttcatatgcttgttggcatttgtatgtctttggagaaatgtctggtgttttgcctattttttaatttggttacttgactaatccttacattctggttttgtcagcctgatctgtcattataaagaggcccgacagctttttacctcaagttttagcagtctttgatggtccctgcctagatccattacttttatagaggttacagtgatcattccttctgcttttattcgctggaaggtcactcaaaagaagacctttcccttagctacagttcacacaggacagagaaatgcttgattctcttcctgtatttgttttcagaataatgagttggtttcttagcatcctccaaagggatgaaatagtgtgtgctttaatatcattaagaatgtacagaattgtaatcccagcactttgggaggctgaggcgggcggatcacgaggtcaggagatcaagaccatcctggctaacattggtgaaaccccgactctactaaaaatataaaaaattagccgggcgtggtggcggtgcctgtagtcccagctacttgggaggctgaggcaggagaatggcgtgaacctgggaggtggagcttgcagtgagctgagatcgcgccactgcactccagcctgggcgacagagcgagactccgtctcaaaaaaaaaaaagaatgcacagactttaacatagatactttcaaaaataggtttatgacagtctggttgacagtctgtgaaaaccatcaccatagttaagttgtgaacatattcatctcacccagaggtttcctagtgcacctttttagtacatttttctctacctctttcctctgatctattttctgttactactgattagttaccataaatggaattatgcaacgtgtattctttttctttctagtttcacacagtttaatcattttggtattcacttattgttttgtgtatgaattgttcattccattttataattgaatagtattcttttgtatggataaacaacaactggtttatccattcacttgttgatggaaatttggattatttccagtttttggtgattacaaataaaattgttaggaacactcgtggacagctttttgtgtggatataacttttcttttccctcaggtaagtgtctagaagtgatatggctgggttgtatagctggtgtatacttaggagctgtcaactgtttgccaaaataggttgtactattttaccttcccatgagcagtgtacaagagtttgagttgctgcacatcattgttaacatttggtatggtcagtcttttctatttcagctattctgaggagtatgtagaagtactccatgatggtttcagttttcattcacctaataaataaagttgtaagcatcttttcttttttaaaaaagtttatttttaattggcaaataataattatgtatatttatcatcttatatacttctttgtggtgcgaacatttaatattcactctttcagcaattttgacttatgtaatacattattattaactgtagtcactatgctatacgatagatcaccagtgagcatcttttcatcggcttatttgctgtgtatctactttagtgaagtctgttaaaaaaaaaattcctttccagttaaattttttaactgagtcgattgtcttctagatatgtcttttgctagatacgtgttttacacatattttctcccagtcagtggcttgccttttcatttacaaaagtaacattttaaagaacaagcatgtatatctgatgtgaggtacatgttaagggttcttttttttttttttggcatatggctatccagtcgttcaggtgccatttattgtaaagattatttcccccattgaatttccttggaaacacttaccgttgaccatatctgtataggtctgtttctggacctctactttgttctattggtctatttatctagcttaaataccatgctggctggtaactgtagccttaagattagtttcaaatcaggtagtgttagagctccaactttttctttttcaaaattgttttggtctgggtgcagtgactcatgcctgtaatctcagcactttgggaggccgaggcgggaagattgcttaagcacaggagtttgagaccagcctgggtaaggtggcgagacaccatctctacagaaagaacaaaacaacaacaacagcaacaacaacaaaactaattagcatgcacctatagtcccagatactcaagaggccgaggtagaaggattgcttgagcccagaaattcgaggcagcaatgaggtatgattgtgcccctgcactccagcctgggcgtcaaagcgagatctcatcccttaaaaaaagtaaaacgttgttttggttattgtaggtccttcacatttatatgaactttagaatcagctattcagtttgtacatgaaagcctgctgggaatttgattgggattatgttgaatctataaatcagtttggagaattgatactgttaacaatcttgagtcctctgacccatgagcacagtatcttcatttatttatgtcatctttctttcttcctttcctttgctttcctttattttatttattttttttattattatttttttttgagacggagtctcactctgtctcccaggctggagtgcagtggtgtgatctcagctcactgcaacttctgcttcccttgctcaaacaattctgcttcagcctctcaagcagctgggattataggcgcccaccaccatgccagctaatttttgaatttttagtagagatgaggtttcaccatattggccaggctggtcttaggtgatctgcctgcctcggcctcccaaagtgctggaattacaggcgtgagccactgtgcccggtcatgtttattttttataattgagattttattggttgtgttgaggattagtatacagacatttcagtttgtacacagttcttatgtactaaaaatctaaaaagctgtgtattgtaattcttttttaaacagttattccagtgagtttccagcttaaaatctggaggcaaatttttaagaggctgtccagtaccagtatcttaaaatgttaagttactgcatacatcccaccaattcacagtttaatagcatatatactacatattcaaattttcaatcttttgcagtacattaacaaagttattaggaaaacagcactaccatgactgaagattttacagagtatgcacaattctgatagggagagccatgatcaaggagtggttttctttaggaaacaattctgctaaaaaataacataggaatagaagtaatttaaaatattcaagacattaaatgcaggactgtgattccatattgccattttgtatactttgtattgtaggatataaaaactaatccctcatctatggaatgtcagagcctcccataattcagtatcccacactattttctggttgtaccaaaaaataaacaaccagcaaatgatttcacctcttaagaaaagcatttacacttaaaaaatgggatgaggtgggattccctccttttaaaaatgtttctagagctactagaaaacttatatttacaaaatagtttatgaaaatattcctctaggctgggcacggtggctcacacctgtaatcccagcactttgggaggctgaggcgggtggatcagctgaggtcaggagttcaagaccagcctggccaatatgttgaagccccgtttctactaaaaatacaaaaattagccaggtgtggtagtgggcgcctgtaatcccagctacttgtgaggctgaagcagaaggattgcttgaacctgggaggtggaggttgtagtgagcctagaccataccgttgtactccagcctcggcaacaagagtgaaactccaatttaaaaaaaacaaaacaaaacaacaacaatgaaaaaaccagaaaattcctgtggatagtacaagaagggaaacaggaatgactcataagacaaggtatgtgatattaatcacacttggcttttttttcctctggctttctcagtttagtttctctgttttctgtaggtaggtaaatctttagtttcttggtttgccactgcgatgtattttctctgctttccttttcacttttgttttgtctgaagatgtatcctttcctgctgccttttttggtttcctgtccacttttgtaggagcagagttagctgagaactgtgctgggtctccacctgggctcttccttcactatcccttcagctgagctgaccttccttcctctttgatattttggtggtggagaggcgcgagagccttggtgaagctaggctgcctagctattgctgtcctgtcccgtcccatcccgtcccatcccgtcctccccagtctctaccagctactgagacctgctgcgggggttaggtcatctttacattctcttagcaatttgtagtttttggtgtataggtcttacagatttttatcttttgtcagatttttccctaagtatttcatttttattgatgctgttgtaattgttattttttagatttcagttgttcattgttaatatgtagaaatgcaatttaattttgtatattgatctcctaaagcttgctgaactcacttgttagttctagtccctttgttatagattccattgggttttttacataggcaatcatgtcatctacagataaaagtttccttattttccattcttatctggatgacttttatttctttaacttgtttggttgtactgactagaacttaatggtgcagtgttgaatgaaaataataaaaacagacctatctgttttatttctgaccttagatgaaaagtagtgggtctttcattacctgtgatgttaatgacaggtttttcatatatagtcatgtactatataactatgtttccatcagctatggagcacatatatgatgtggtcccataagattataattaccatatttttactgtaccttttctatgttttgatatgcaaatttttacctttgggttaaaatcgcctccagtgttcagtacagtaacgtgctgtacaagtttgtagcctaggagcaatagggcatatcatatcgcctaggcgtgtagtagctattccatctaggtttgtgtaactacaatctgtgatgttcacatgatgatgaagtcgtgtgatgtatttctcagactcttgttaagtgatgcatgtgtgtattttatgagattaaggaagttctctctctttttaaaaagtttttatttctatgtatgttcttatacagtatgctaaagaaaaacttttttaggagagtttctttaaaaccttaaaaaaaaatttcattgagcccaaaatgtcatatgacgttaaggaagttctcttctgttcctagttgaatagatatataaatgtttagagttcttacatcttcttgatgaattgactccttgatcattatgaaattacctactttctgatatattatttatcttgaaccaacttgtctgacattacaatacagtcactccagctttctgttagctagcattggctttaaaacagtttcattgagatataattcacacgctgtacaattcacccacttgaagtgtgtaattcagtggtttttagtatattcatagagttccagtacttcaccacaaccaattttagaacattttagtcacccgctaaaaaaccccttatgcccattagcagtcactctccattccctctgctccccgcttaggacccctcaacccttatctactttctgtctctatagatttgcctattctggacatttcatataagtggaatcatacagtatatgtggtcttttgtgattggtttctttaacttagtagagtgtgttaaagattgatccatgttgtaacatgtattggtacttcattcccttttctcactaaatattccattgtgcagatataccactttttgtttattgactcagttgttggacatttggattaacttttttactattgtgaataatgcttctgtgaacacatacaagtttttgtgtggatgtatgtttttatttctatgtatgtactatacggtatgctaagtacggcacttagtacagtatactgagagtggaattgctgggttatgtggtaaatctacatttaatattttgtggaactgccaacctgttttctacaaaagctgtaccattttacatttttattagcaatgtttgaaggcttcagtttctccaccttcttggaacacttgttatcttttttgaggcagggtctccctctattgcctaggctggagtgcagtggtgccattatggttcactgcagctttgagctcccagggtcaagtgatccttccacctcatcctcccaagtagctaggactacaggcacacgccaccatgcctagctaattttttattattttttgtagacacagagtctcactgtattgtccaggctggtctcgaactcctggcctcaagtgatcctcctgcttcagcctcccaaagcactagggttgcaggtgtgaggcactgtgcctggcctcaatggtttttttaaaatacttttttttttttaaatgagaaaagtttaaaaaaaattgtaccacattattactgtttccgatggtctttattcctttttgtagatctgtatttcatctggtgttagtttccttctatctaaggaacatcctttaacattttcttataggactggtctgttatgatgaattcattcagtttgtatgtgtctgaaaaaagtttatttcactatttttataaagaccttaattaattttttttttttagcagtttttggttcccctcaaaactgaacagatagtacagagatttcttatatgctctctgcccccacacatgcatagcctccggcattgtcagcatcccccatggagtgatacatttgctataattaatgaacctacattgacacatcgtcacccaaagtctatagtttatattaagattcattcctggtgttgtgcattctgtgggtttgatatcacacagagtagattccctgtgctaaaattctgtgctccacctatttgtccctcctttccccaacctcctacaacaactactaatctttttactgtctccatagttttgccttttccagaatgtcatatagttggaatcatacaatgtgtatgccttttcagattggcctctttcacttaataatatgtattatttaatgttcttccatgtctttccacggcttcatagctcatttctttttaatgctgaataatattccattgtctggatgcaccatagtttatccatttacctgctgaaagacatctggattgcttctgagttttgacagttatggataaaactcctatatacatttgtgggaaggattttgtatagatataagctttcaggtttttttgatgaatacaaaggagtattgttgctgatcctatggaagagttaatttttgttgttgttgttgagacagagtcttgttctgtcgcctaggctagagtgcagtggcatgatttcggttcactgcagcctctgcctccttggttcaagtgattctcctgcctcagcctcccgagtagctgggattacaggcgcctaccaccactcccggctaatttttgtatttttagtagagacagggtttcaccatgttgctcaggctggtcttgaactcctgacctcaggtgatccacctgcctcggcctcccaaagtgctgggattacaggcatgagccactgtgcctggctgagtatgtttaattttgtaacagactgctaaactgtcttccaaagtggctgtaccattttgccttttctgccggcaatgaatatgagttcctgttccacagccttgccagcatttggtgttagcagtggttttggattttggccattctgataggtaggtagtggtatctcatttagtttgcgtttccctgataacatataatatgggttacctcttcatatgcttgtttgccatctgtatatcttctttagtgaagtgtctataaaggtctttggcccatttttaagtgggttgtttgttttcctgttaagttttttatatattttggctaccagtctttcattagatattttgcagatatttcttcccagtctgtggcttgtcttttcattctcttggtagcgtctttcacagagcagaatgttttaattttaacgaagttgagcttatcagttatttcatggatcatgcctgtggtgttgtatctaaaatatcattaccaatcctaggaactctagcgtttcccctgtattaccttttaggagttttttagttcttttttttttttttttttttttttttgagacgaggttttgctcttgttgcccaggctggagagcaatggcacaatcttggctcattgcaacctccgcctcctggattcaagcgattctcctgcctcagctccagagtagctgggattacaagtgccttctatcatgcctggctaatttttttttttttttttttagatgaagcctcgctgtgtagccgaggctggagtgcagtggcgcgatcttggctcactgcaacttccgcctcctgggtcccagttcaagcaattctcctgcctcagcctcctgagtagctgggattacagacatgtgccaacatgtccagctaatttttgtatttttagtagagatggggtttccccatgttgtccaggctggtggtcttgaactcctgacctgcccacctcagtctccccaagtgctgcgattaaatttttgtattaatagagatggggtttcaccatgttggtcaggctggtcttgaactcctgacctcaggtgatccacccacctcagcctcccaaagtgctgggattacaggtgtgagccaatgcgcgtggcctagttttttattacatttaggtctgtgattccttttgggttaatttttgtgaacgaaggatgtaagacctgtggtttagatttgtttttttgcctgtgtgtgcccagttgttccagcaccatttcctctctttggacccttttttctttttctttttcttttcttttttttttttttttgagacagcatctcgctctgttgccaggctggagtgcagtggtgccatcttggcttactgcaacctccaactccctggttcaagtaattctcctgcctcagcctcccaagtagctggcattagaggcacgtgccaccacgcccagctaatttttgtatttttattagagacggggtttcaccatgttggccaggatggtctcaatctcctgacatcatgatccccccgccttgaccacccaaagtgctgggatttcaggcatgagccattgcacgcagcctggacatttttttttttttttgatacagatatttcaaatggcaaataaaattttatatatttatggtgtacaacatgatgttttgaaatatgtatatattgtggaatggctaaatcaagcaaattaatatacagatcatctcatatacctatcattttgtgttaagcacacttctacagtctcagcaggatttgtttttttgagacaaggtcttactctgtcgcccaggctggagtgcagtggtgtgattgtgggtcaccgtagcctggagctcccaccttagccttttgagtagctgggactacaggccagtgccaccctgcccagctaattttttgcttttttgtagaggcagggtcttgctgtgttgcccaggtgagtcttgaactcctggtctcaaatgatcctccgtcctcagccttccaaattgctgggatttcaggtgtgagccatcatgcctggctaatctgttgtcttaacagtcttcaaatgtacaatatactgttatgaactatagtcaccatgttgtacaatagatctcttgaacttactcttcctaactgaaattttgtatcccttcaccaacatctctccagcctttcctgtccccagccctccacacttattaacaaccattatactctctacttctgtgagtttggcttttttagattccacataaaagtgagatgcttatgtggtctttctgtatctgtcttattgccttaacataatatcctccaggttcatccatgttgttgaaaatgataggatttctttcatttttaagaacgtcggtctgttgtatatatagaccacacttttttgctccattcatctgagatggacacttaggttgattccatatcttggctattgtgaataatgttacagtgaacctgggagtgcagatatctctttgacatactgacttcctttcctttggatatatgcccagtagtgggattgctggatcatatggtaattctttttttagtttttttttttttttttttttttgtggaacctccatactgtttttcatactggctgtaataaattacattcccaccagcgatgtgcaagggtttcctttcctcagcatcctcgccaatatgttatcttttgtctgtttgatgattgtcattctaacaggtatgaggtaatacctcattatggcttcaatttgtatttccctggtgatgagtgatggtgagcatttttttcatatacttattggccattttatgtcttctttttgagaaatgactaagttctttccctattttaaaatcaggttgttttcttactattgagttatttttgagttccttatatattttggatattaaccccttatctgatgtacggtttgcaaatattttcttctgttgcataaattatctcttcactcttttgattcctctgctgtgctttttaaaaagtttgttgtaaccccatttgtcgccctgcttttgttgcctgtgcttttggggttccatccaaaaaatcattgtctagaccagtgtcaagaagctttttccctatgttttacagtttcaggtcttagtttcagtctttaatgcatattgaattaatttttgtttatggtgtgggataaaggttcagtttctttcttgtgcacatggatatctaattttttgagccccatttattgaagagactgttcttcccctattgtgtgttcttggcacctttgtagaaaaatcaattaatcataaatgtgtggatttatttctgggctgtttattctattccattgctttatgtgttcgttttcatgccaagaccttgctgttttgattactatagtgtgtaacatacagttgacccttgaataaggtcttgaactgcttgggtccacttatatgcagattttcccctgcctttgccacttctgagacagcaagaccaacccttcctcttccctcctcctcagcttactcaacttgaagatgagaagatgaaggcccttatgatgatccacttccactttatgaattgtaactatattttctcttccttatgattttctaaataacattttcttttctgtagcttactttattgtaaaaaatacagcatataatacatatatcatgcaaaatgtgttaatttagtgtttaagtcattgataaggcttccagtcaatggtagcatatttgtagttaggctgtgggggagttaaaagttatatgtaggtttttgactgcgtaggggattggcttccctaacgcctgtgtcatttaagggtcaattgtattttgaaatcagtcagtgtgaagcctcctcctctgttcatttttgctccagattgctttggctatttggggtcttttgtaggtccatatgaattttaggattttaaaaaatttctgtgagaaatgtcattggaattttgatggaagttacattgaatctgtagatagctttggttagtatgaacatgttaatactgttcttctaattcatgaacataagaatatctttccattcatttatttcaatttgtttcatctgtgttttatgtagtttttaatgtacaggtctttcacctccttggctaaatttattcctaagtattttattttatttttgtagccattgtaaatgggattgttttcttaatttctttttcagatagtttgttgttagtgtatggaaatgctacacgtttttgtttattgattttatatcctacaactttcctgaatccatgtattatttctaacagtttattggcggagtcttcagagttctttccatgtaagatatgtcttcagcaatcagggacaatttcatttcttcctttttaatttagatgccttttatttctttctcttgcctaattgctctggctaggacttccaacaccatattgagtgaagatggcaagagtgggcatccttgtcttgtttctgatcttagaggaaaagctttcaacttttcactgtttagtatgatgctaactgttggtttgtcatatatggcctttattgtgtggaggtaaattctttctatacctaatttgttgagagtttttatgaaaggatgttgaaatttgtctcatgctttttctgcatctattgagatgatcataggtttttgtccttcattctgttaatgtgattcacattcatagatttgcgtatgttgaaccatccttgtatccctgaggtaaatcctacatgttcatattgaatgatctttttaatgtgctgtttgttgaattttgttagtgtttcgttgaactccagcaccgtttattgaaaagactacctttgcaccattgtattttatccttttctttgttgaagatcattgtactagatttatgaggtctatttctgggctctctattctgtttcattgatctgtttgtctagtcttttgccaataccatgctgtcttgcttacgataaatcttgaagttgggtagagtcattcctctaactttgtccttttccttcaatattttgttggctattttggatctttttcctttccatatacattttagaatcatcttggtgatagaaaataactttctgggattgtaattgcattgaatctataggtctagttgggaagcactgacatcttgccaatgttgagtctttctttatagataggaataatacctctccagttatttaggtctttgatttgtttcatcagagttttgtagttttcctcatagaaatctcgtatatgttttgttagattcatacctaagtattctgttttttggggagtgtaatgtaaatgacactttttaatttcaaattccctttattcattgctggtgtataggaaagcagttgaattttgtatattaaccttctgtcatgtaaccttgctataattgcttattagttccagaggtttttttattgattcttttgaattctccatgtggacgactgtgtcatcagagaaaaaaagatggttttatttcttctgttcccatcagcatgcctttttcccttttcttgtcttactgcattcattaggacttgcaatacaatgttgaaaaggagtagtgagaggaaatctccttgtcttgctcctgatcttagcagagaagcttctagtttcataccatttaagtatgatgttagctgtaggtttttttctggatattccttgtcaagttgaggaatgagaatttttaaaatcgtgaatgggtgttggattttttttcatatgcttcttctgcatctattgatatgggtgtgtgatttttcttccttagtctgttgatgtgatggattttattaatgattttcaaatgttggaccagtaatttacacctgggataaatcccacttgatcatggtatatgattcgttttatacattgttgggtttgttttgctaatgttttgttgaggattttgcacctgtgttcataaaaaatgttggtctgtagttttgttataatgtatatttgtcaagttttggaatactctgatgttggcctctactgaatgagttaggaagtattccttctgcttctatcttgtgtaggagatggtacagaatgggtataatttctttcctaaatgttttataaaattcaccagcaaacccatctagtcctggtgttttctgttttggaaggttgattggttcagtttctttaatacaggcctattcagattgtttcttgtgtgagttttggtagtttgtggctttcagggaagtggttcattttatctaggtgatcaaatttgtggaaatagaattgttcatagtattctttttttatttttatttttttgagacagagtctcgctgttacctaggctgaagtgtagtggtgcaatcttggctcactgcaacctctgcctcccgggtccaggtgattctggtgcctcagcctcctgagttgctgggattacaggcgcccgccaccacacctggctaattttcatatttttagtggaaacggggttttgccgcgttggccacactggtcttgaactcctgatctcaagtgatctgcctgcctcagcctcccaaagtgctgggattacaggtgtgagccagtatactgtgcctggccagtattattttattgtccttttaatgttcatgagatttgtagtgattttctttctttgagttctgatattaggagtttgtgtcctctgtctttttgttagtctacttggctagaggtttatgatttaattggtcttttcaaagaaccagcttttggttttttcattgatttttctcagttgatttcctgttttcagttacattgatatctgctcttgtttttattcttctgctaactttggatttaattcgctgcttctttttctgttttttttaaggtgattgattaggtgattttagatcttttgtcttttctggtaaatgcattcaatgctatgaatttccctctaagcactgctttcacgtcatcccatagattttgataagttgtgtcttcattttcatttagctcaaaatattttaaaatttctcttgagatctcttttttgacctatgtgttattagaagtgtgttgtttaatctccaagtacttgggttttttttaaaaattatatttctgttattgatttgtaatttaattttattgtgacctgagaggaggcattttataacttgttcttttgaatgtgttaaggtttgttttatggcccagaatgtggtctatcttgatgaatatcctatgagtgtaaaaatgtgtattctgttatttcttctgtgacataatctgtgaatgttcattatatccagttgattaatgttgagttcaattatgtccttactggttttctccctgcttgatctggccgtttctgatagagaggtgttgaagtgtccaactataatagtgaattcatttatttctctttgcaattctatcagtttttgcctacacagacactttgttgttaggcttatacacgctaagcattgttatgtctttttatccttatttttatccttgataaaagttatccttgataacttaacttgtcttatctgctgtgtctgaaattattacggacaactccgctttctttttttgagacagtctcgccctgtggcccaggctggagtgcaggggcgcgatctcggctcaatgcaatctctgtctcccaagacatgtaccaccatgcctggctaatttttgtatttttagtagagatggggttttgctatgttggccaggctcgtcttgaactcttggcctcgtgtgatctgcctgccttggcctcccaaagtgctgggattacaggcatgagtcaccacgtctggccaactccgctttcttttaattggtgttaatatgatatatatttctccatctatttacttttaatctgtgtttttatttaaagtgggtttcttgtaaaccacatccagtcggttcttgttttgtgatccacttcgacagtctcttttagtctttattttttgccaaaatgccgatttatttagaatattgaactgaatattaactgtcaaattgaaatcagtgaaggaaaacattgtataagcaaaacagtttgcattttgggacatactgcaaactttcaaggaattgcgggactaaatataaaggtgtagagtgattatgttgacaaatataaaggtattttatagctgacctcttccatttcctgcccttactctcacccctgcattgtatgcaggcccagcttctatgtcagaacctgcatttctttatctgaggactttctgtggccactgaattccaattttgcatctgtgtgacaagttgcaggtactaggaaattaacattccccaacaaccttgaaccaatgatggaagatgatatataaataatactccagttccctcacccctgaataggatgactccaagatgtatctgacaatctcttttaattggtgcacttagactattgacagtcaaaggaattgcaaagatagttggattgatatttaccatatttgttactgatttctatttgttagccttttttttttgtttctagttttgtctttcactctttttctgcctttgtggttttaattgagcattttatatgatttccattttctgttctttcttagcatatcaattgtacttttttactttgcttagtggttgtcctagaatgtcctagattgtaaatgtatatttacaactacctcaaatctgctttaaaataacactataccttttaacaggtagtgtatcttactataagataatcctgtttctcccttccattccttgtatcattgctgttaactcatttaactttttttaaaaatttttatttatttatttatttatttatttgtttatttatttttgagacggagtcttactctgtttccctggctggagtgcagtggtgcgatattggctcactgcaagctccaccccccgggttcacgccattctcctgcctcagcttcctgggtagctgggactacaggcgcccgctgccacgcccggctaattttttgtatttttagtagagatggggttgcactgtgttagcccagatagtctcaatctcctgacctcatgatccacccgccgcctcctcccaaagggctgggagtacaggtgtgagccaccgtgccccgcctacttatttagcttatacagaaatgtttgtaatcttatgtatatacacattagcttacataatcaaatgcattgttgctattttaaacaaaattttacctgctaaatcaatttttaagatgttttaattttacattcacttattcattctttgatgttcttcctttatgtagatccaagtttctgacctgtatcatttcctttttgccaaagaatttcgtttaacatttcttgcaaagcaggtctactgacaataaatttccttagtattctgaaaaaaatctttatttttgtttccacttttgaaggatgattttgcaaggttcagagtttctaggttggtggttttctctctcaacacttcaaatatttcacttcactttcttctggcatgtgtggttatcattcttatctttattcatgtgttaagtacagtgtttttacccttgtcttttaggattgtttttcctttatttctgattttctgttgtttgaaaatgatatccctaggtgtagtgggatttttttggcctttgtccagcttggtgttctctgggcttccagtggttttgttcccagaccaaactgggttgggctgctgtttctcatggcccaataacaagatgcagatgaactggggaggaagagagtttttatttttgtacctggttacagggagaaggcctagaaattattgccagaccaactcgaaattacaaagttttccagatattatataccttttaagctatatgtctgcgtgtaagtgtgtattcatctaaagacataagtgatgaaacttcttttaatctgtaactaaggtctgagtcttgaagaccttcctctggagtctcagtaaatttacttaatctaggtgctgaggtgattacccttatcttgtctcctgctcgtggaggtttggggagttctttcagacatccaataaacttgtttgtggaggcctggggaatttctttgttatgctttaaggcccaggaaaggcctaggcaaaactcttggtgggcttttgttagattccagcctttgtataagggcactggctttttttagcttttaatatttaacttaaccagtcagtcagtactgaaacagttgttatggagccctgcattaatgagacatggcctgctacagtttggtgtctgatactaatttgggggaaattctcagtcattattgtgtcaaatatttcttttgttctttcctctcctcctgatagttccattccatgtttattataccatttgtagttgtttcagttcatagatactctgttctatttgtgtcagtcctttttctgttttcttttcagttttaaagatttcgaatgagatttccttaagctcagagattatttccttagctgtgtcttgtttactaaaaagtcgatcaaaggcattcttcatttctgttgttgttgatctcttgcatttctttttagttcttttttagaatttccatctctctccttacattgcctatctgttcttgtatgctgtccactttatccatttaaagcccttagcatattaatcgtagttttaaattcttggtccgataatctcaacatcactgccgtggctgaatctggttctgatacttgctctgtctcttcaaaatgtgttttttatattttagtatgccttgtaattttttcttgatagctggacatgtactgggtaaaagaaactactgttaaataggcctttggtaggtggttttggtattaagagtaatgctgatctcctagaatgagttgagaagtactgtctctgcttctgtcttctgaaagaatatgattatgtgctgattagtattaagttaaatctcagagagaacctcctgtagatcttgggtgttctttttgtgttgtactctgcgttatgaattttaggtctcttggccttctcagctctgaactgtgttttctcaaatccaaggagcatctaaactctggttgagtttacctttcctgcactgcagcctggaactgtctgcatagtaatctgaggcagtattggggcttatcttgggtttttctttctgagatatcactactctgtggtttttattgtccaatggctgaaacattattttatgtattttgtctgtttttagttgttcagcgtgagagagggtaagttactgttactccatcatggcttgatgaataaatgtgctgcccaggattcataaggatataatggtaatcaccctcgttggctgactttggagagaactagtctcctttgcctatacacattaacggagctgctttaaaggtagtgcttaagcagtcatcatttgttgccactggttgctggataggttgggaaggtcagaagccacagtccaccatctttggagattaggagggaagtattaagtcatttgaacatagtttttattttcattttccttggtacattgttaggactgtcctgatgtatactttacataaagggatgaggaaaatggccaagcatgacccagctcctttttccaacctttttttttttaatgtcatatagtgtcagacctctcttagtaagttttacattatcaagtgttgtttatagcatgttgtaatagttaattatatttgattataagactatggagaaatctgaaatggttactcatcagtaaaagctgacagctttagaattttaaaaatgattttcaaagacttcactttgaatggggtgcctagtatttgaatgttgaactcccttgtgttagaatttacatttacattgctaccaatcttttatctttcagttattcaagcggagaaatgttgctacagcagaagaagaaacagaagaagaagttatgtcagatggaggctttcatgaggctcagattagtaacatggagatggcaccagtaagataatgaactcttttcagtgtttttgtgatgaagatatgagatgtagatttccttttgagttttaaaaaaggttagatggctacaaaaagtacttggcatttcatttttaaaaagaatatgcttaatctcatggttcattaaatgtttattatattttggataaagtgcagttaaattataaagattaattctgctctaaaaacttaacaagctaattataagataaaattactctttaaaagttgaataagaatagacaccttatttatttatttatttatttatttatttatttatttatttatttatgttttagagacagggtcttgctgtgttgcccaggttggagtgcagtggcgcaatcgtaggtcactgcaacctcgaactcctgggcttaagtgatcctcctgctttagcctcccaaatagctgggactacaggcatgtgccaccatgactggcaaatttttaaattttttgtggagacaggatctcactgtgttgcccaggtgaactcctggcctcaagtgatccttttgccttggcctcccaaagtgctagaattacaagcttgagccatcacaccaagccataagagatactttaaagaaaataatgattttttattgatttacaaaattgacctgtttgtatgatttaaaaacttgattccacatcagaactcttggatttttctgttgtaaaccattttgttacttttttgaagttaacatgaagagataaaagtcatgctttatttgtatggattagacctatctagatttctagagtattgtaattacgtaattttaaaaataggttatatatgtgtacatatatatatatgtgtacacacacacagtttttttaaaaagaaaattatctcctaaaaggtactgttgtttgtagtaacaaaaaaagtacaattaaaaaaaatgaagaaaaatctttcttccgcttagccacctagtatttttctccattggcaactagtattactaaattcctatttattctttctgagaacttttgtatattaaaatgttctcctctcccccacctttttttttggtaaatggtggcatactattcatagtattttgtagtttttatttttatttcatttcatagatctccagtttacatgaaccagctttctttgagagttgggagggtagtattatttcctttggaattcatacagacatagccaatgccatcattttgtgatgaaagtttctaggcccttcagaaagccagtctttccaatttttttaagaagagagtgttaagtgaatataaagtgttttatggattgtattagggttctccagagaaacagaaccaatgagagaaagaaatttagtttaagaaagtggctcgtgtctttgggagctggcaagtgtgaaatctgtagggcacactggcccactataaattcaggttaagagttgatgttgttgaatcccttttcttcagaaaacctagtctttgcttttaagggtttcaactgattggatgaggccaacttggactacaggcgtgcgccactacccccagctaatttttttgtagttttagtagagacagggtttcaccatattggccaggttggtcttgaactcctgacctcgtgatccacccgccttggcttcccaaagtgttgggattacaggcgtgagccaccgcacccagccagattacaactttcctttgtgcaactaaaaatgtatggatggttcttgacttaggagggttcaagtcaggatttttcaactttacagtggtgtgaaagcaatatgcaatcagtaggaactgtattttgaatacccatacagtcactctgtttctcattttcagtacagtattaagtaaattacacgagatagtcaaccactttattataaaataggctttgtgttagatcatttgttcagctgtaggctaatgtatgtgttctgagcatgtttaaggtaggctaggctaggcaatgaagtttggtaggttaggtgtattaagtgtactttttacttaatattttcaacttatgatgggattagtggggcataaccccattcattgtaagttgaggcacatctttactaactccttctgcggaagaggatgcaaaatctttgggtgatgttcactcctgtccttgatagcctgtgacttaaatattataatgtaaagttaacaatacttaaatagtgtaatgtaaagtcagtacagcttgctataagaggatgagagagggaagaaaaagatatttgcttaatgtgtgtatatatatatatgaatgtgtttatgcaaacatattcataacaaatcatatagaaaccttgatttaggaatcagtcttgcaattttgaaaatagttacttttctgattcttgagtagaatgcgtcatatattcccctatgaggattcttaggtattgcttaccagtcatctagcatttacagcttagtgcagctttcttcacaattcatcttgttgactgctacccttcatgaaataagaactttgtttctttctgacaaatgaccctgagaagaaaattaactgctaatactggggatgagttatggtgggaaatggaaacattctaataaagcaagaaggtagtgggaaactggaaagttttaataaaacaagaaagaaattttaaataagtttaagagtcagctgttgaatttggcagtggctggatttatacaggaccactctatttactcactcaataagtattgcagagcatttacagtacaccagcccttagtgatagagtaagacagacagggtcttgggcttacaaggaagttacagtatactggaggaacacagaaaaatatctgggagtgtaataagggctggggcatacgattgaaatatggtgctgtgatagagataaagtggctactttaggcttggaggtcttgaaaagccatcttttaaaacttaacatttaattttgataagaaagaatagccagctatgtgatgagcaaggaggggaagagcaataagctccttgtcttatttactagtaagatcactttctactgtgagctttttaatgatagacaaagaatttggcttcattatattattaataatcttacacgtttctatatgtaaagattgtcctacctttatgtaacttctggggaagtatgattaacttaataacttggccatgatatctgttatctttctttcctttgaattaagggtgataatttattatatgttctttttgtttgtgatcgcagggtggtgtcatcacttctgacatgattgaaatgatattttccaaaagcccagagcaacagctttcagcaacacagaaattcaggaagctgctttcaaaaggtgagctatgaatatgttcagtatattttttcatctctctacaaaattactttcccatagtctgtttttcataccacaggtaatttgtgttggagtatttttatcaataaaagaataaaaatacagacatatatgtaattgtgaaccatgcctaaattttaagtttcctatttatttgtgggatctcaccaggatcagaaaacagaattattttcatttttgggttattttataaaagactttatagtgaatagtagtcagtatcatgttaattcaaattgagagactgacttttttttatagagtgactttaaaaatactccttgaaagagttatgattgttgattttaatgttagcaatttaccactgaaagttaggaatgcatttactggtgggcagggtgattacctttttttttttttttaaagacggctctgttgccagtctggagtgcaggctgggcgcgatcttggctcactgcaacctccgactccctggttcaagcgattttcctgcctcagtctcccgagtagctgggattacagttacacgccaccacccccagctaatttttgtattttttttttttttttgagatggagtctcactctgtcgcccaggctggagtacagtggcgctatctcggctcactgcaagcgccgcctcccgggttcacgccattctcctgcctcagcctcccaagtagttgggactacaggcgctcgccaccgtgcccagctaattttttgtatttttagtagagacggtgtttcactgtgttagccaggatctcgatctcctgaccttgtgatcctcctgcctcggcctcccaaagtgctgggattacaggcgtgagccactgcgcccggccttttttgtatttttagtagagataggatttcaccatgttggccaggatgatctcgatatcctatcatgatccgtctgcctctgcctcccaaaatactgggattacaggcatgagccaccgcacccggctggtaagtactttttttgatataattagtgtagaatggaatctgatacttgttatcaacctgggcaagtaaaaagaattctgaacccgattataacgttggtagtaaatacttaaaccccccagtattaagttatggttgtttagagtcattagtgatttaaaaaaatttaatatatcccttgaggttaagtggaataaaaaactactactatgacaaaaaaatattgtcttttgcagaccgcttattaaaaatatttgaaggaaatgtacacttcctcaccccttttaaaaaagtcttatctctttcaacatgctaagcttaatggttttcttctgtaatgtgcttttttttttttttaagggctttcaccattctgctaccttcctgcatgtattctggtttgccagcatacctcttaaaaatgtgataactagaatccaatatttcagatgtgttgttattaatgtagggtatggtgagaggttaccttctttgccctaagagtgtctattttgataatgtagtccaaggtagctagttattttgatagtcatggcatagtaatattttattgaattttcagcaaactaaactccctagtgcttttgttcacgaactgttgttaggttttgtttgtgaagtcatgtagatttttaaaaattgccatttaaaaaacttagatgctgaactttgctttatttctgtttttttttgttgttgttgttgcctattctgacttattgttctttttctgtgttatttctgtaactcagcatattaactagtttattgtaatcatcaaatttgtttttttgtgcttacctgcgtggttaatataaatgttcaaccaggtaaatgacatgtcattagagtcctttccaaatgaacattgaaccattagtcacctctttcagtaaggccatcgacttgggtaagaatctccctagtagtattgtgatctaattgccatttttctggcattgccacacgcatattgtcagtaactttgtcagtctctggctgaagttattaatctgattgtctatgacatttccctcctatttgccttataagtttttattgagtgacatcatttataggatactgtattatcatgaatgaaagtgagactaagttggcaagtcaatcttcgtgaattcttgctagctcctacaggtacaaaattaaattctgcaggcctattgagaatcttgtaatgcaattccttaagatgatttacaacagacaagagcagttagacttaaaactcatgtacaggaaacaggctagaaggaagtataccagaacacttaacaatggtcttttgaggggttttttgccccctgctttttaggttttctaaaaagtggaggcagtaatttaatttttaagaatttttcccatcctttattctcatattgagacttgtcttcattgtgaaacatttcagactaccctgtcctcaaagtgataaacccaatttgacatttcatttgttttaggtagatttccagcatgagagatggtaaatggagggagggatgttaagaagttttgagctgttaagttcttgcattgaaatcaaaggattttttttttcttttattttatggggaaacagaacctaaccctcctattgatgaagttatcagcacaccaggagtagtggccaggtttgtggagttcctcaaacgaaaagagaattgtacactgcaggtgcgaataatttttatttattgcctcataacttaattccttttgaaaatttttattttgtacacaaatttgttactaatttttatctgtatgaagaattaagtttgtttataatgatattcctgacaactacattgcaagctgctttcatagctttgttaacatgtaggccttcgttatactctttattattattataatttttaatcatttaaaatgtttatgattgtggataatacttctctaatagggaaatgtttacagcagaggagccattacagccaggaacttatgtgtgggctacataaaatttggtgttgagggagttttagatgatacttggtggctttctcaggatggtgtaacatgggctagatcagagtcttattaattcccaaatctgttcctaattaattcttcctccaccccacaaaaagccgataaggagataactttgtcaggaatctgtgtacttattgctgtgtcaatttaggctttcagtactgtactatataagggattccaagaggaaattttgtaatctctggattcagaattttcttttttttttttttcttctttttcttgagacagagtcttgctctgtcgcccatgctggagtgcagtggcaagatctcagctcactgcaaattccatctcccagattcaagtgattctcctgcctcagcctcccatgaagctgggattacaggcagccaccaccatatccagctaattcttttatttttagtagagatgaggttttgccatgttggccaggctggtctcaaactcctgacctcaagtgatccacctgcttggcctcccaaagtgctgggattacaggtgtgagccactgctcccagccaagtattcaataattttcataagaaaagaaaccaacagtcagctgactctcatcctagaaattctaaactactattttttttccccctggataaagttgggtttttagaaactgatgattttttagtaaacttccctggagtaaccaactgagtcagtgcctttattagttacaaatacatgtgatccctaaattctcacctgtaggatctaatctcaaaggcttgggccctgagactatgcagctataaaaattggttaggtaccaagttgatcacaaaatgggattatctttctaagtaaatatttgccaaaaactagttaatcaaagatatcccccaccccttgtgtgctgttctttactctaaggctggagccatgtagacactggggcatttttgttaagtgatagctcctgtccccaggttccttactgtctacaccattatagattattcatacaacttgatgatttgccttgatgttttctctcctttcctcctatcccttctttctctttgttttacactctttgttgcggtgatgagttccttccagaggaaaaacaagaaatccagaaaaggtagagtacttcaatgtcacatcagtttttcttctccagtttgacacttaccagttcccatgctcatttgaattaaggttctgttttgctagctgcctcctggattgtaattctggtccccatctaaggccaggatcatcagacacctgaaaaataatcacgttcaccctgagagcaagggaagagagacttttctcaggataaaaggaaatccagacaaccaacactgcagagaacagagcctgatcccctaagcaacctgccgagaaccagagggaccaaatgaggaaccttactgcagtttatcatttgaaatgctttgtaggaagagggaggtagggaaaattattttgttcatgctgaaaaaagtgtttctttcctgtctctgggaatgagagtagatgagagatactgaatttactccttgatctggcggtttttattaggtggtagttcttttatgcattaaatatagatggtatataacctttcagatctaaaatgaaaaaagtcggagaaatggatctttccccatctctgcattcccttgtactccttaaaaagtacaagtacattctccgacagtgccctcttctggctaagacattctacatctttttttaattcattactctgtaatcttggaacttgtattttaacacatctgaagatgaaagccttcagaaatctctaatttgcttctatgtaaactcccagattccacccttgtgcaaactaataattaggctgaaatattgcaaaatgattcctccggaagtgataacctcatgattttatgaggatagtcttagctgtcctaactctgagaaataaccaactgtttgttatctaagggccatctctagcttttttatgtgcacatttaaggacaccatggtgttctccctccactgtgactagtggggacctttgaccacctcagaagcaagggggcaaatatatcgagagagaccttaaagccaggagacttgatgatctaccatgctttcaaataattagacatgctctgggaagcttggaggttactccttcctctgccttcttggagagcagacagatgtaagctatccctgatactcttacctgcttactagaacttgaataatgcacctttggaatagggcttttgtcatttctcttccagaaggagagtcatgctatgtggtgccaagaggaaatttgatggctcagctcactaataaatcttgtggacaaacttaatttcttcattccatagataaagaactgtgaatcctattgaagggtctttttatgttctttctggcttcccaagtcagtaaggtacctcaaaccagggagataaaagtgcctgctttgagcattgctacccaggtgctgaaggtgaacatgggtggaatctaggattttggaagcagacaatggcttttagctaagcgcattctcaagctcagtgacatctaggtctcagatagacttgagcccttgtcatgagactggtctggtttatggcatggtctgtgagcctacttttttgcttctttgagtccaggcccagtatctttgtgctgtcctttgcaatgctgagatgtggcattcccaaactttcttatagaagtttataaaaatagctagaaataaatatattgccttctatttccaaatattagacagataatccttgaaaagttgtaaatttgaattacattggcttagtttccccttttctgcctttcttgtcccctctaaaagcttaatgtgataaactgcagtaagccttcatcctcctgtgtcttttcccatcttcattgatctctctgcctttcctggaaagttgctcagatgactcaggcactgttctctgcagagtttgctatctgggtttatttttctgatgtgagcctttcttttcacttgctctccaggtgagcctggcatttgctaggaaccagagtggaaccggcaaagtggccagcaacagagtcctgatccaaatggagaaagggaaccaggcgtacctcaacctggagtgggaaacttgataggaggtcagaagtacttcagctttggattctcattttccttatttaaggaactgagcgccagaaggtagagactaagaaagggaagagagaaaacatcaaaccttcagtgtgcagatttcaggtgtagccttatttagtgagttcaggacagtgaaaaataatgagtggaattacagtttataagtagttccagctgcatgatagcttgtttccttgtatgatgccattcttggatattaagaatatagtagtttaaaacaacaaaagaagtgaagattttatttggccaccatttgttacttcaggcaataccatttcttagatttttttttttcccaggttaatgatttcctggtaacagggttgcttactttaattaatttttttggctgtttctatcataactttatgcatatgtgtttgccatcaattctaggctttcccatttcacaactatttcatgttaaattctaatctagtacccaaggctgaaacatttagaaaaaacaaaaaaatagatggcaaatctcagtggaatacagctttaaagtacagactatgatgaaagggaagttatgtagtttaaagtacatctaattttttaaaaacataaatacgtttaacagttacttcttctaacattaacagaggcctatactcagggaaattctgttttttactccctcctctcatacatatgtggatacctgcataaacatacatacatatcacacatgtatagatgggtgtagaaaatttcacaaatacagcttgattagctttcacaaagtgaaaacagcaaagtaatcagcaccctgtgtgtgtgtgttttattgccttattaatgcatgaatatggttgtattttcagtggtcctcttgttacagttacccatctacttctatccccaataatagcaaaactgtttttgattttcattcctgaattgcattgagaggttatcatcattgtgtactacttagtgataagcataactggcatgttattcttttgctaagatgtaataatttcttttttttaccatctgtattcaggctgttattcacttacttttcattttcttagtcattgtcacttgaattgttttgcttctctattttattaacttgtgtagcttctggaattctccctcatttcccctgagatctttggtgctaaactcaaaatagcagtttgaacgctggcaccaattagaattctaagtaattttttctcaccaataactctgtactatatccctgtatacccaggttattattataatttcttttgcatccaaatctcactgtaatctttttcttgtatacagatggtatgtattctgatcttattttttttccagattgcttttccttagagttttcatttatttgactttatgtttgcagtatctgatgactgtttattgaactttgagcctgccttgtggtgggacagtttgcttttatacttacatcatatgactctggtttacaaattaattttcctagtaagcaaaagaaactacatcttaggtgaacttgttttttcttttttagtataaataatctggcatactgttatttaaaatttcttgaactagatatccaaactacaagcaaatgaaatatttctgggtcagcattatgtttcaggaaactatgactgggcttcgtaatgtattagattaggaggctgtaacttagtccttgtctttgactgtgtaacattactcgagtcattagtcaaattgttggattttttttcagatagtttcctcatttgtacacaagaaaagccagatactttacatctctgggttgttgtagggatcatctgcgagtatgtgaatagtactttgaaaatataaagtggccgggtgcggtggctcatgcttgtaatcccagcactttgggaggcctagatgggaggatgacttgagatcaggagttcaaggccagcctgacaaacatgatgaaacctcgtctctactaaaaatataaaaattagccgggcgtggtggcacatgcctgtaatcccagctacttgggaggctgaggcaggagaatcacttgaatccgggaggtggaggttgcagtgagctgagaacgtgacattgcactccagcctgggcaacaagactgagactctgtctcaaaaaagaaaaaaaagaaaatataaagtacggtacaaatgtcaagttttaattcagacgtactgaaagggactgagtgttgctttcattagtaatttaatcatagagataaatatgggaagaatttttatttcatgatatctggggtttaatctgtaagtccccagaatttttgttataacaaaaagggaccagatacgggctctttaaccgaagtactcctactctgggcctccctgctgctactaaaccaccttacctcactcatgtatgtcacttttatagttttctttggaacatccattggttatgtgtcttctgctatgaattttctatcactaacatggctttgaacgtgatttgatcagatggcccattttcctgtcttcctctattcccaaagattaatgaatttagttttctacctgacagctaccttttagttaatctggaagcttagaagaatcacaggtcatttgatgacgacttgttattttctctgatttaaaggacatgccatggaatttttctttttttctgtgtatgtgctttattaaatagaagacagaatggtggaagaaacaacctgaaatgtaattaagaactcttaactaaatagaaaagagttcattattggatttctcaatattaagctaaagagtcaagttagtgttagagatatattttagtaatatgctctattttttgttggccataatttcctttatatcttctgtttaccagtgctgtaatgctatatatcaacctttagtcagtttaccttcatttttccctccctattaagaatgcccaaaaagtcctatctctgtattttggtttggagctctctcatttattggaagctcttattctttgaagttgtcatttcttttcattatgtgctgttaactcctttcacctacttatcatttgataccttttgcctttttcactgtgcctgtattttatgtttcacactaacattctccccccattttactttgcccattctacagaagtttttaaatcttttttattagataacatacatggtacaggctaaaaggcacataaagctttccagtgaaaagtatctttttcatccttattccctagttaccatcacctttctatgcaggcaacaagtatttagtttcctctaactcattctgaagataatctgtgcaataagtaaattaatgcatatattcctttttaacgcttttagaaaatatggtataatgccatattaatgtacactgtttgcattttgttttcatttatatcttgggagatcataccatatcagcatatgtaacactctctcattctttttatggtgtcatgtttactctttcttgaactgaaattttagacaccctgaatattcttctaggttgaggtatttcttctggatattcttcttttaaaattaatatagtactcaactgataggttatgtgcaaataatgatctcagaatctttttttcatgtacagaaaatgttactgttataagtaaacaaacttttacattctaaaaagataatgaaaattatttttatctttatagtttgaatcagcttgggtactgacaaatattgcttcaggaaattctcttcagacccgaattgtgattcaggcaggagctgtgcccatcttcatagagttgctcagctcagagtttgaagatgtccaggaacaggtaaaaatgaaacaaaaagaagcaggtgaaagaaagtttttggctgggcatgtcgctcactcctgtaatcccaacattttgggaggccaaggtgggtggatcacgaggagttcgagaccagcctagccaacatggtgaaatcccgtctctactaaaaatacaaaaattagccgggcatggtggtacgtgtctgtaatcccagctacttgggaggctgaggcaggagaattgcttgaacccgagaggtggaggttacagtgagccgagatcgcgtcattgcactccagcctgggtgacgagagcaagactttgtctcaaaaaaaacaaaacaaacaaaaaaagaaaaacaaaaaaaaccacaaaatttcccaacataataaggggctgagtttcaccagttggctttggtaatctatggattgtcacaaaggagtgttctagaaatttagtcttaaccaaatagaaaatttcttagtgactgtaggcagaatttctcttagacacataaaataatcttccccttccaaacctgacattctttaagccctgtatatgtacttttttagaccatgtaagcagttactgatagaggttttttcttgtagaaatttcaagtgttgaaagtaggccaggtgctgtggttcctgcctgtaattccagcacttgggaggctgaagtgggcagcttgcttgagcccaggagctcgagaccagccagggcaacatggcgaaacccagtctctacagaaaataaagtaggtgggcatggtggcacacgcctgttgtcccagctgcttgagaggctgaggtgggagggttcacttgagctccaggaggctgaggctgcagtgagccgatatcacaccaccgcactccagcctcggtaacagagtgagacctatctcaaaaaaaaagaaagtggctagtctttgccacttttgtgcagaaaagtacagaaagcaagtttctttttgttcactgttttcttatgtaagcaagaaaatactctctttctgtctctttttttctttctgtctttctctctttctgtctctccatctttccgtctttctttctctccgtctctccatctctccttctctccgtctctccttccctctgtctctccttccctccgtctctccttccctccttccctccgtctctccgtctctccctccctccctccttccctccttctcttgcttcctccctccctccctccctccctctctcctccctccctcctttccctccctcccttccttccttccttccttccttccttccttccttccctccttccctccctccctccctccctccttccctccttccctccttccctccttccctccttccctccttccgtctgtccctgtcacccaggctggagtgcattggctcaatctcggctcactgcaaccttggcctgtcaggttcaagcagttctcatgcctcagcctctcaagcagctgggattacaggcgcctgccaccacacccggctaattttgtatttttagtagagatggagtttcactgtgttgcactccatactgggtgacagagcgagattctgtatcaaaaaacaaaaacaaacaaaaatgaattagttctttcctttaataaaccgaataccttctgtttgttgtacactttaggatattatttatcttcctcccccaatcctacaactgtttcatttgactccctgatgaacgtgttattgtgatatactggcatctgaaagaattatgagggaattaaactatgtaacctttattaatgaatgattctttcacaggcagtctgggctcttggcaacattgctggagatagtaccatgtgcagggactatgtcttagactgcaatatccttccccctcttttgcagtaagtttcttcttccttcttcctttttttttctttttgagaataaaaatgtaagagattcctcagaaagcattacatgtttggaaatcattttggattttctagtgttatttttaattccagatattttcttgtttagatcatttcctcaagcaccctatctttttccatgccaaaattctgaattctgaattacttgcatcagaattaatgaagttttaatgttctggagaaaagctatctgaagacatctctttatcaaaagtattattatttagtatttatgtcatcagataatcactgtctgttacatagtttaccattgtaccatcgtgcttttaggttattttcaaagcaaaaccgcctgaccatgacccggaatgcagtatgggctttgtctaatctctgtagagggaaaagtccacctccagaatttgcaaaggtaaggactatgcttttgggacattggcagaaaaaatacaattaaaagagtattgcaaccaatggtaaggtgaacaggaagataatttttgttaaaatttaaaatgttagaattttatctgtttttggagaaacagggttgttgttgtttttgttggttctctttattatttaaaaagcaaatttagagcatagcttgaaggtgcacatttacgatgggactgcaaataaagcatagcatgaaggaagaatttgtaaagcttattgaaattaggcttcatacaattagtatactgtttaggagactatcctttcagttctcttaaaacagtggttctcaaagtgtggtctgtgagttctctgggagtccatgagattctttttttttttccaataggtttttggggaacaggtggtgtttaggtacatgagttacttgtttagtggtgatttctgagattttggtgcacccaacacccaagcagtgtacgctgtacccagtgtgtagtcctttatctctcacccacctccgaccctttctccctgagtccccaaagtacattgtatcattcttacgcttttgcgtcctcatagcttagctcccacttatgaatgagaacatctgatgtttggttttccagtcctgagtgactttatctacttgttgattgatgggcatttgggctggttccatgtgtttgcaattgtgaattgtgctgctataaacctgcgtatacaagtatctttttcttataatgacctcttttcctctgggtagatacccaggaatgggactggtgcatcaaatggtagatatacttttagttctttaaggaatctccacactgttttccatagtggttatactggtttacattcccagcaacagtgtaaaagtgttcccttttcaccacattcatgccaacatctattttttgttttttggttttttgagacggagttttgctcttgttgcccaggctgaagtgcagtggcgcggtctcggcacactgcaacctctgcctcctaggttcaagtgattctcctgcctcagcctcccgagtagctgggattacaggcgcataccaccacacccggctaatttttgtatttttagtagagacggggtttcaccatgttggccaggttggtcttgaactccagacctcaggtgatccacccacctcagcctcccaaagtgctgggattacaggcgtgagccaccacgcccagctgcattttttaatatgtttgttggctatttgtatatcttcttttgagaattgtctgttcatgtccttagcccactttttgatgggatttttttttcttgctgatttgaatttcttgcagattctggatattaaaataaatgggtatttttgtagttgtttttaatttggaatcatttttcactgaacaaaaccttagcatttttggtctttaacaaagtatctaaaatacagaatttcctagttttcacatttgtgaaagttcctttacctgtttagtccacaaagaatgtgttttgatagggagtcttactccaagaattgatgtatataaaactttgctctctgaaattattttccttgggctttgactacagattagtgcaagatcactgacaacattgccaaagatggaaatgccacttaggtacttgctgcttcatctttagaagtgtaaatcaccctagaagtcaccaagtacatgcctggttgccttcttgagtatctcacctcacttctggcttttagtctattgaatttcataatcatcattttccttttacaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgtaagatatcttttagaaagtgtgtccactttctctcccttggtactagttttctagctgctaatacttaaatattaatggattgtacatgataattgatttattgtgctttgggctactgtttttgttacttgtttattttgatgtcagatctgtttgtcttgttttattgaggcttatagagaacctcttagtcctctgctgttagcaggcctttagcagaaacattgggaaaactctgatatgtgtagttccaggctcatactggatggcctgagatcaaccaccggacatcagaaggcatactgccactaaaatagtcattccttatctgtctgtctcatttagagcttattttagacaagtatcagaaattcaatcttattttgctttatcatctccgtgatgcttttgataatggagtggaagatttactcgtgacataaataatttgagactgtattaatcaaatttttagatactacagaagaaaaaaatgaaagtgataacataatggagaaatggtacagttacaaggtatgggagatttaaagtacaaagtagatgcaaagagacattgtcgcaaacatgacatttggaatatattagatagttataatgtattaatacaaaatagaaaactctgggattatagcaggctacagactggatgcagatcagtaatgtagtgctaatgtgaattaatggcagtatgatgctgcaggagtctgaagtacatcattcaaaatctgggaagtaatcctttgtattctttagtcactagactactatatattttagccatttcttttttttttttcttttttaaaaattatactttaagtcctagggtaaatgtacacaacatgcaggtttgttacataggtatacatgtgccatgttgatttgctgcaccaattaactcgtcatttacattaggtatttctcttaatgctatccctccccctgcccccaactccacgacaggccccagtgtgtgatgttccccgccctgtgtccaagtgttctcattgttcaattcccacctgtgagtgagaacatgcagtgtttggttttctgtccttgtgatagtttactcagaatgatcgtttccagcttcatccacgtccctgcaaaggatatgaactcatccttttttatggctgcatagtattccgtggtgtatatgtaccacattttcttaatccagtctatcactgatggacatttgggttggttccaagtctttgctattgtgaatagtgccgcaataaacatggatgtgtctttgtagtagcatgatttataatcctctgggtatatacccagtagtgggatggctgggtcaaatggtatttctagttctagatccttgaggaatcgccacactgtcttccacaatggttgaactaatttacactctcaccaacaatgtaagagtgttcctatttctccacatcctctccagcatctcttgtttcctgactttttaatgatgacgtgagatagtatctcattgtggttttgatttgcatttctctgatgaccagtgatgatgagcattttttcatgtgtctgttggctgcataaaagtcttcttttgagaagtgtctgttcatatcctttgcccactttttgagggggtttttttttcttgtaaattagtttaagtactttgtagattctggatattagccctttgtcataggaatgcttgtgatttttgcacattgattttgtatcctgagactttgctgaagttgcttatcagctcaaggagatttggggctgagacgatggagttttctaaatatagaatcatgtcatctgcaaacagggacagtttgacttcctcttttcctaattgaataccctttatttctttctcttacctgattgccctggccagaacttccagtgctgtgttgaatacgagtgctgagagagggcatccttgtcttgtgctggttttcaaagggaatgcttccagtttttgcccattcagtatgatattggctgtgggttagtcataaatagctcttattattttgagatatggtccatcaatacctagtttattgagagtttttagcatgaagggctgttgaattttgtcaaaggccttttctgcatctgttgagataatcatgtagtttttgtcgttggttctgtttatgtgatggattacatttattgatttgcatatgttgaaccagccttgcatcccagggatgaagccgacttgatcgtggtggataagctttttgacatgctgctggattcggtttgccagtattttattgaggattttcacatcaatgttcatcagggatattggtctaaaattttcttttttgttgttgtgtctttgccaggctttggtatcaggatgatgctggcctcataaaatgagttaggtaggattccctctttttctgttgattggaatagtttcagaaggaatggtaccagctcctctttgtacctctggtagaacttggctgtgaatccatctggtcctgggctttttttggttggtaggctattaattactgcctcaatttcagagcctgttattggtctattcaaggattcaacttcttcctggtttagtcttgggagggtgtatgtgtccaggaatgtatccatttcttctagattttctagtttatttgtgtagaggtgttgatagtattctctgatggtagtttgtatttctgtgggatcggtggtgatatcccctttatcattttttattgcatctatttgattcttttctcttttctttattagtcttgctagcggtctatcaattttgttgatcttttcaaaacaccagctcctggattcatttatttttttgaagggttttttgtgtctgtatctctttcagttctgctctgatcttagttatttcttgccttctgctaacttttgaatttgtttgctcttgcttctctagttcttttaatggtgatgttgggtgttgattttagatctttcctgctttctcttgtgggcatttagtgctataaatttccctctacacactgctttaaatgtgtcccagagattctggtatgttgtgtctttgttttcattggtttcaaagaacatctttatttctgccttcatttcgttatttacccagtagtcattcaggatcaggttgttcagtttccatgtagttgtgcggttttgagtgagtttcttaatcctgagttctaatttgattgcactctggtctgaaagacagtttgttgtgatttctgttcttttacatttgctgagcagtgttttacttccaattatgtggtcagttttagaataagtacaatgtggtgctgagaagagtgtatattttgttgatttggggtggagagttctgtagatgtttattaggtccacttggtgcagagctgagttcaagtcctggatatccttgttaaccttctgtcgtgttgatctgtctaatattgacagtggggtgttaaagtctcccattattattgcgtgggagtgtaagtctctttgtaggtctccaaggacttggtttatgaatctgggtgctcctgtattgggtgcatatatatttaggatagttagctcttcttgttgaattgatccctttaccattatgtaatggctttctttgtctcttttgatctttgttggtttaaagtttgttttatcagagactaggattgcaacccctgctttttttttgctttccatgtgctttgtacatcttcctccatccctttattttgagcctatgtgtgtctctgcacgtgagatgggtctcctgaatatagcacactgatgggtcttgactctttatccaatttgccagtctgtgtcttttaattggggcatttaacccatttacaattaaggttattattgttatgtgtgaatttcattttatcattatgatgttagctggttaatttgcccgttaactgatgcagtttcttcccagcattgatggtctttacaatttggcatgtttttgcagtggctggtaccggttgttcctttccatgtttagtgcttccttcaggagctcttgcaaggcaggcctggtggtgacaaactctgtcagcatttgcttgtctgtaaaggattttatttctccttcacttatgaagcttagtttggctggatatgacattcttggttgaaaactcttttgaaaactcttctttttactcttttttctctaatcttgtcttcacactttatttcattaatttgatcttcagtcactgatatcctttcttccacttgattgaatcggctattgaagcttgtgcatacgtcacgaagttcttgtgccatggttttcagctccatcaggtcttttaagctcttctctacactgtttattctagttagccgttggtctaacctttgttcaaggtttttagcttccttgcaatgggttagaacatgctcctttagcccagagaagttagttattaccgaccttctgaagcctacttctgtcaactcgtcaaagttattctccgtccagctttgttctgttgctggcgagaagctgcgatcttttggaggaaaacaggcgctctggtttttagaattttcagcttttctgctctggtttctccccatctttgtggttttatctacctttggtcttcgatattggtgacctacagatgaggttttggtgtgggtgtcctttttgttgatgttgatgctattcctttctgcttattcgttttccttctaacagtcagttccctcagctgcaggtctgttggagtttgctggaggtccactccagaccctgttttcctggattaccagcagaggccacagaacagcaaatattgcagaacagcaaatattgctgcctgatattttctctggaagcttcgtcccagaggggcacccgcctgtatgaggtgtctctcggcccctacttggaggtgtctcccagttaggcaggaagtcagggaccctgaatggaaggaccggctgaagccatggcagaaggacataaattgtaaagatttcatggacatttattagttccccaaattaatacttttataatttcttacgcgtgtctactgcagtctctgaacataaatcgtgaagatttcatggacatttatcacttccccagtcaatactcttataatttcctatgcctgtctttaatctcttaatcctgtcatcttcataagctgaggatgtatgttgcctcagggtcctgtgatgattgcattatgtgtacaaattgtttgtgaaaggtgtgtttgaacagtatgaaatctgggcattctaaaagaacaagataacagtgattttcagggaacaagggagataaccataaggtctgactgcctgcggggctgggcagaacagaatcatatttctcttcttgcaaaagcgaataggagaaatagcgctcagttctttttctcagcaaggaacagccctgggaaaagaatgcattcccagggggcggcctctaaaatggccgctctgggagtgtctgtcttttgcagttgaagataaggcataaaatacgccctggtctccttcagtgccctcaggcttgctaggattaggaaattccagcctggcgaattctagtcagaccggttttctgctctagaaaacactgtttcttgttaagatgtttatcagtgacaatgggtgtacagtgggacatgaaacctcatcagcagttctaatctcaccctggccttgtgatcttgctctgcccccattttccttgtgatattttattgccttttgaagcatgtgatctctgtgacccacaccctattcgtacactccctcccctttgaaaatcgctaataaaatattgctggttttgtggcttgggagcatcacggaacctgccgacatgtgatgtcacccccggagactcaggtgtaaaatttctctcttttgtactctttctctttatttcttagactggccaacacttagagaaaatagaaaagaacctacattgaaatattgggggctggttcccccaataggctacacggggttcagggacccacttgaggaggtagtctgtccattctcagagctcaaacaccatgctgggagaaccactgctctcttcagagctgtcagacagggacgtttacatctgtagaagttgtctgctgccttttgttcagcctatgccctgcccccagaggtggagtgtatagagatagtaggccttgctgaggtgcggtgggatccacccatttcgagctttctggctgctttgtttacctactcaagccccagcaatggcagacgcccctccccccgccaggctgcagccttgcaggtcgatctccagctgctgcgctagcagtgagcaaggctgcatgggcatgggacccgctgagccaggcatgggagagcaatctcctcgtctgccatttgctaagactgtgggaaaagcacagtgtttgggcggggtgtactgattttccatgtacagtctgtcacagcttcccttggctaggaaaggaaaatcccccgacccattgtgcttcctgggtgaggcgacgccctgtcatgcttcaccttgccctccgtgggctgcacccactgtccaaccagtcccagtgagatgaatcaggtacctcagttggtgatgcagaaatcacccgtcttctgcgtcgatcactctgggagctgcagaccagagctgttcctattcagctatcttggaacggaacccagccatttctttttaatcatcacatgttaaatttgaaggaactggcttagtttttagaagagtgatcggtctcattaaagtggagggaaaaataggacccttaaggaaaatcaaaagatagtgacttaatttagctagaaataaggacttaatatctgtcttcaaatatatatatatggctttgtggagtggtttttggaccagtaaggcagcttatttagtaagtttagttgaaagacctttgtatttagagtgtgactcctgacttgcattttcaagttagttcagctgttgatgtgtcacttttacgtctgaaaattaagacaatttataaaacttaaaaatgttgcgtaaatgttaattattgctctcaattatctcagcaaccatacaaaagccagtaaagaggaaatgaaacctatactaaagaatgagagggaaaagttggaatccaggtgatggaatacctgggaaagattcctaggaaagattggtagttttttccaaatgtactaaaataaggggaaagacagttctagggaacaccagacattccatcatcatgataagcgttcccttaattagccccatgggtacatttctgctctaaaattctatcacaatttttttgttttttaattttggtcttggaaggaaatgaaactaaggatagaactgtttgctataacattactttttgtttttgcaggcataatgattataaagtggtttctcctgctttgcgagctgtgggaaacattgtcacaggggatgatattcagacacaggtatgaagaagtggtaacttttttttgtcctttaaaaacagtatattgaacttcatgatcatgtttctattatcgtattttactccatattattagggaaacttgatactctgttacactaatgtttaaaaatgttgggccgggggcggtcactcacgcctgtaatcccagcactttgggagactgaggcggacggattgcctgagctcaggagttcgacaccagcctgggcaacatggtgaaacctcatctctactaaaaatacaaaaaattagccgggcgtggttgcacacgcctgtagttccagctacttggaggctgaggtagaagaatcgcttgaacccaggaggtagaggttgcagtgagccgagatcgcaccactgcactccagcctgggcaacagagtgagactccagctcaaagaaaaaaaaaaaagttggtttaggcatctactctcaatacctttagtatctctgacttgacctgttgcttgtagtagtttggggttgtcctatgatagtgactattttttggtcaggcagatttgtttttcttcactcctatttgaaatagttctcatgggcatcagaatcctctagtagcatcttttctctgtctttttcatctcaatatcaccttctctgatagctttctccttttgtacatggtaagtcccctgtgtgaggaagattcttccctcctactttctaatgtcaccatctactctattcaacttctgtatcaagacacaccattcacagtgcattgttctagccatatttcttcctgaaatctcagctgtgttgtgatgttgaagtcttttagttcttctgcctcatcgaccatttatttctccctagcaagctccttttcctcttgtctccttttgtggacatcttccacggggcaatccttctgcctcattcatagatcttatttataatgtcagtgattacccttgtgtgcatggattcagaattgggaattgggttttagccttagcgttttcttcaccagttctgactttcagcaatacatttaatgccttttctaatctctaaaattaaggagattagatttgttctctcaggtgtcttctaactgtaatgtatttactttaaatatattctgtacacaagggaactcatttccccttgcattacctgaacctctgcttatgttccctgtatcagtgaatggcaccatcagttcccctgaaacctggacatcagcttgattctttcctctcctccaactccatcatcagttactaagtcctgttgttctgtctctattcatcctttgcagggcttagttcagacacttcagaagagaataggagaagaaaagaatatatgtttgactatatttgcataaaatttctctggaaggatatacagggaactgaaaatgttggttgtctttgaggggaactggttggctgggatacaagaaggggaaagaggcttttaacaactatggagtcttttataccctctgaatttttgaaccctatcagtatctttctgtccctcacccacctccatatgctgtatgcttttgccatatttgttccttgaattggctgtggccactctcagctcagagttttaacgcatgctttattccctctgcctggaacatgtgtctccactgctaccccttgctctgactgccacctcacacatatccacattctctgctcctaatgttttcttgttcttcaagtcttggtattaacattattttctctgagaagccctgtttgaccctaaactcttaagttaggtacttatttttttttctttatccatcagaatattaatcacattgtattgtaactaattactagattttaagattctagaggtggattatgtcagtgtttatttctgtgcctctgtaaatctaataatttctggcacaatatatagggacttaaagaatatttattgaatgcaatgaagttctgaatctctacatctacttctgacctatctcaagtttcagtcctatatctgcagtagtttcttacatatttctgcttgcatatctcacgtttgtctcacagtatatcttctttcccccacaaggcaagttccaagtttttatttttcctatttcaggtaatgatataactattctctttacctacacatgaaactttgcagttacatgtggtgtctccctcccttatagtttgtatagcaagttgctgggtcttcttgattgttattgttactagatccccatcaaattacgtacttttggtccttgtcacacacacaggttgttgctgtacccatccatcctccgactgtcctaagcagttactcttctcaatttattccccctaataacagctgaatctttcctaaagtaatgttatttgcattatcttcctctagaaataataagctgctttagtgcctgtaagataaagaaacttgaaagattcaaaggaatttctccttaagattttagtctcattcttctttctagcctattatttttggggcatagaactcttttgtaatagcctcatcatggccaggtatgctggctcatgcttgtattcctagctttttgagaggctgaggtgagagaattgcctgagcccaggagttccaaaccagcccatgcaatatagcaagaccccatctctaaaaacatttttttttaattagctgagcatgatggaatgtaactgtagtcctacctactctactcaggaggctgaggcaggaggattgcttgcacccaggagtttgaggttgcagtgagctatgatcatgccaccacactccagccttagtgatagaacgagactatgtttcttaaaataaaatagcctcagtagtctgttcttacagtactttgtaatagcttgtctctgcattttttcatttctagcttatgtgcagtgtcagtccctctttttgctaatgaaatcctattgcctatttaataggcataaaagacttcattttaatttgcatttctttcattacttaggagataattttctattaaaattttagtttctcttttcagtttacacatagcaaccctctcatttgttgcaaatatttttcacagtggatggtgtacatttaaaatctgttacgatttttgacatgaaaacatgtttcatgaaatttttattttcccctataatttctttatttttatgctcatacatacagtcttttaccatccccaagtcagctattttctaatattctgctttatgatttcttttaaaaatatttactcttaagtagttgcaaatttattttggtgacttagggtttatattagtctgttatttcattgctataaagaaatacctggccgagcgtggtggctcctgcctgtaatcccagcactttgggaggctgaggtaggtggatcacatgaggtcgggagttcaagaccagcctgaccaacatggagaaaccctgtctctactaaaaatacaaaattagccgggcgtggtggcgcatgcctgtaatcccagctactcaggaggctgaggcaggagaattacttgaacccaggaggcggaggttgcggtgagcagagattgtgccattgcgctccagcctgggcaacaggagcgaaactctgtctcaaaaaaaaaaaaacaaaaaagaaataccgaagactgagtagtttataaagaaaagaggtttaattggctcatgtttttgtaggccatacaggacgcatatagtagcttctgcttctggggaggtctcaggaaacttaaaagttatggtggaaggtgaagagaaagcaggcttgtcttatgtgacgtgagcaggagcaaagagtaggagaaggtgctacatactagaacagaaccatggggatggcgctgaccattcttgaaggatccacccccatgatccagtcacctcctaccaggccccacctccaaccttggggattacaattcaacatgtgatttgggtggggacacagatccaaaccatatcagggttaagaaatgatattgaaaaaattgtctttaatctgtttagctttttattccagttctgtcatagccacaagtcattggaagaaaggattaacttattataaactttataaatagctgcatttgtttctagaatagatctctgttctctgtttagtgattaattcttaaatctgccatatactattttaatcaaacttatattattttagtttctagtagagtaggtctccttcttcatgtgtatttgtgttacctccttcacctttataaactgatagctgaggtcatatcttttttatctttgtatcctataaagcatctaatatacctcattaagtacgtattcgttcattgactaccaagtagtgtgttatcagaggacctacaaatctgagactcctgacttttctggccacttgatatatttacccattcagaagacttacgctattgggatgggaaggtgaatgagtaatgcttttgtaattacaatagtaacattattgtatcttattaagtacagtttagcagttgtgaatgtgtacaatgaaactgtactgatactcttagaaactaattcttattaacagtgaatacttttttttacctgtataaagttacttatttataaaatttcaaggggagatgttatgtctttcataaaatgtgttccttaagttaaacattgatatttagaacaatacaataagtaaaattttcaaactttttcttttaggtaattctgaattgctcagctctgcagagtttattgcatttgctgagtagcccaaaggaatctatcaaaaaggaagcatgttggacgatatctaatattacagctggaaatagggcacagatccaggtaacctcataggacctaacttctctttcagtatttttattgaaaagtaaggtttttttctcagtcaccctttaaaacacatttgtttttggctgggtgcggtggctcctgcctgtaatcccagcactctgggaggctgaggcccgtggatcacttgcggtcaggagttcaagactatcctggtcaacatgctgaaaccttgtctctactaaaaatacaaaaaaattagccagtcgcagtggcaggtgcctgtagtcccagctacgcgggaggctgagggaggagaattacttgaaccgtggaggtagaggttgtagtgagccgagattgtgccactgtactccatcctgggtgacagagcaagactccatctcaaaacaaaataaaacgtatatcgttttcattattgctttgaagaccactttcaatgttgttgtcttatttcatagtcagctttttactttatcctagcttatagatgttaagtcttttgaaatttacacttaagccttcattttttctgttgccgttaatatttgatgtttcaccaagacccaagaaatagttatcaggggaaccacctccagtgtttcatgtaggttcttttctgttttccctaagtgtcggccggtctgagaaataaagggaaagagtacaagagaaattttaaagctggctgtctgggggagacatcacatatcggcacgttccgtgatgccccccaagctgcaaaaccagcaggtttttattagtgattttcaaaggggagggagtgtacgaataggttgtgggtcacagagatcacatacttcacaaggcaataaaatatcacaaggcaaatggcagagcacggggcgaaattaaaattgctaatgaggtttcaggcatgcattgtcatcgataacatcttatcaggagacagggtttgagaacagacaaccagtctgactaaaatttactaggcgggaatttcctcgtcctaataggcctgggagcgctaagggagaccggggtttatttcatcccttatccacaaccatataagacagacagtcccagagtggccattttagagacctccccctaggaacgcattctctttctcatgactgttccttgctgagaaaaagaattcagtaatatttctcctattcacttttgtaagaagagaaataatagctctgttccgcctagctctcaggcagtcagacctgatggttatctcccttgttccctgaacatcgctgttatcctcttcttttttcaaggtgcccagatttcatattgtttaaacacacatgctttatgatgcaatcatcacagggtcctgaggcgacatacatcctcagcttaatgaagatgacgggattaagagattaaagtaaagataggcataggaaattataagagtattgattggggaggtgataaatgtccatgaaatcttcacagtttatgttcagagactgcagtaaagacaggtgtaagaaatgataaaagtattaatttgggggaactaataaatgtccatgaaatcttcacaatttatgtccttctgccaggcttcatggtccctccattcagggtccctgacttcttgcaacaaataatgtcttgtattttcaaaatgttttgatgggctttatgctgagcacgattggctttaacgctttccaagtaagatatttatttttccagtggacccatgtagattgcctcaaattttcatgaatttttggatacccatttttctttaaatagttacttggtttttacttttgtctttgtattggtgggagagtaactcaagtggacgacaagcagtgggccaaagtgttcagcctgggcaatgttcaaggatggaacagtgggtaggaaaagatataacacagacatagagggccttggagatgaatggaaacagagagatcatctaatccaaggttttcatttaccacaattttgtgtgtgtgtgtttgtgtgtgtgtattgaagcatccattacattgtatcccataaatatatacaattattatttgtcaataaaaaatttgaataaaaagatgaaacggctcatggaattaaaatgatttgctcaagagcacctctagtaaaatgacaggaccgggattaggtgtctttccagtaatcaactttgtcaaactttgttgacgtccttcacaggtataataagagtttttgaccaggaaagcattttgtccccaaaatgctgaattaggaactgagattaatagctataacaatctatagcattcatatgaggtgatttcatctgtatttgattgcctgtcaccaccaggcttttttatgcagaacttctcagtttcttaatgtaggaaatgatataaacccatgttaggtacttgagccaggaagaaacagggagaaagtaattttgggaaggctactttagtgttagtacatgaaggggattgagtaaaagtactccatccaactataagtcttattttggtaatctgggaggtggtggcttggagaatagcatggcaatgccaaaggaaaggaaaaagatggactcaggattttaaaaattgagaatgtaaattaatagcctttgtgaactagaggggtttaaaaggaaacttgatatagcgggcagatgatgtgtttgagatgactagcagacctaacgtaaactgctggctaccctgggctgatgctccagtgagaagtgaggactagagagttttcgcacatggaagttcacatgctatgagagaatggaatagcagaggagcagaaaattgagctcttaacaatttgttactgtgggcagaacaaaagaggaaagtgaaagagaaaagaactcagagaaaataggagattataagatcataaactccagggaagatgttttcagtgataccaagacagaataaggattagggataggctgggtgcggtggctcccacctgtaatccctgcactttgggaggccgaggtgggtggatcacctgaggtcaggagttcaaggccagcctggccaacatggtgaagccctgtctctactaaaagtacaaaaattagccgggtttggtggtgtgcacctgtagtcccagctacccgggaggctgaggcaggagaatcacttgaacccaggaggtggaagctgcagtgagctgagattgcaccactgcactccagcctgggcaacagagtgagactccatctcaaaaaagaaaaaaaaaggttagagataatgacataactcttttcaatttatttctgacaggagaaggggtgttaatagtcaaactagcttagaaattataattagtatcatgaatatttttataaatctcacagttttttccatttaagtttttctttaattttagactgtgatagatgccaacattttcccagccctcattagtattttacaaactgctgaatttcggacaagaaaagaagcagcttgggccatcacaaatgcaacttctggaggatcagctgaacagatcaagtaagtaccaatcaggcagcatattgtaagttaaagaaaaattattattgtgtctatcactttataacctcccacatattacctagagtaaaagattagctgcctttgaggggaaaagtaagtgagagacgatcttaccaaataagaatgtttagttccagtccttaggaaattgtccttggtgtcataattagatgtgtatttaattctttataactctcccatttctttttgctgaaaaacaatcctgggatataagaagtaggcatagtcgaggcttgaggcaatagaaatccttgcttcaacctactctggagctacttgtcagaaatatcttgggtaatataggttacttgtagaacttgagcccaagtttaataactcactcttgccctttttagtttagatgtcttaatagtagaattggatcagaattgaaagagtggtatgtctgagaatgaagtgccaaatttagtagaggcaggtatcttctaaagtactatggtattcttgttaaagggaggagctgtagcagctcaagacttaaatggctcccttggtagcagcttagtgattgactgattgagatggagtctctctgttgcccaggctggagtgcagtggcactgtcggctcactgcaacctccgcctcctgggttcaagcgattctcctgcctcagccttcctagtagctaggattacaggtgagtgccaccacacccagctaatttttgtatttttagtagaaacggagttttcccctgttggccaggctgatcttgaattccggagctccggcgatccacctgccttggcctcccagagtgctggaattacaggtgtgagccatcatgcccgacgagcagcttataagcttaatgagtggaagaaaacataaatatggatgggaatcagttcttcaaaggagcatcatataattaaatgcaaaattcaggacatctagtatttcagatagggaaaaaaagtaatgatgaagagaaaaatggagcctagcctagactcagccagtcttaactttatggggaatccaaaattaaggaaagatggtttcaaatgagtgctaaagcattaactccttactcatacgtaatatcagacaaacatagctactacttacattgttgctttgtggactgaatgtaggcattcatcagatgctagttttgagtgttctgtttggaattaaaaaataaaaatagtaacaaagtacagaaatttatcaggtagagaaaataagaaatatgtacctgaaagaataaaattacaaacagattaacatatgcagtagctattttggtgaagttcatcatgggcaggttatttcagggagacagaagcacatttgtcttgtaggttttttccaacctccaaaattctgattctagagtactatgattttaattatgctgtcaccagatggtaaaaataatgaagtactatagttatttgaataagctttatgttcaaattcacatttatagttattaattgtctctatattttatagcaaatatattttcttaattgaaataagccaggccgggtgcagcggctcatgtctgtaatcccaccactttgggaggccaaggcaggtggatcacaaggtcaggagttcgagaccagcctggccaacagggtgaaaccccgtgtctactaaaagtacaaaaattagccaggtgtggtggcgtgcacccgtaatcccagctacttgtggggctgagactggagaatcgcttgaacccgggaggcagaggttgcagtgagctgagatcatgccactgcactccagcctgggtgacagagtgagactccatttcaacaaaaaaaaaaaaagaagaagaagaaataaaccataaacatatatattttattatgccatctttcatgagaaagtattcaggagtattttgctctgttagagaagcgcagaattgctgctgtccctttttaaaattcagcatagctatttataataaaattaattaccaacctcctagcagtttcttcttccccacatgaagagttatcttgaaagaatgtcacaaaaatattacagtccaaattacaaaaaacaaactgactttatcacttataaaagacatctatctggcttctgctgcttcttgttgcagataccagatttggatgcaagaaacaattagaatattttaggaaatatcttggccgggtgtggtggctcatgtctgtaattccagcactttgggaggacaaggcaagcaaatcacttgaggtcaggagttcgagaccagcctagctaacatggagaaaccttgtctctacaaaaattagctgggcgtgttggtgttctcctgtagttccagctacttgggaggctgaggtgggaaaatggcttgaacccaggaggcagaggttggttgcagtgagacaagatcgtgccactgcactccaccctcggagacagagtgagagactctgtctcaaaagataaaaaagaatgttttaggaaacatctagaattttaggttgaatataatcaaatgttaatacatatataacacatgttcttaatgaaggataaggattattaactgaaattagagaaacattcatcaaagaagtgaaacttactatttgtatagagaattggcagttttggaggggagaatagcatgaggaaaagtgagagaatgcagtgtttttggaggtggcaggtcagtcttgctataggtcgttctttcacaaggatgattaagtaatcgactggtgaatactgggatgaaagcctcagtcttgggtattgggaagacttggcctgtctaagctcacgagtgacacaaagtaaggcctgtgtctaggttcattatttttctgtatggatgttcagttgttttagcactgttgaaaaggtggaatcctttctccatttaattgcctttgctattctgttaaagatcagttgactgtttttgtgcgggtgtgtttctgggctttctattctttttgtgtgggtctgtgcatgaatttgcagtttatctgagaaaccaaacacacaaacacacagtttatctgagaaaccacacacacacacacacacacagtttatttgagaaaccacacacacacacacacacacacacacactggtagtacagtataggaagtcctcacttaatgtcattgataggttccaggaaactttgactttaagagaaacattgtatatatcaaaaccaattttatcataggctaattaatataaatcagttgagttactacgtgatatttctggtcaaggaaacatccccaaccttcaaaatatagacccaaaaaccttctaatattaaacattgaaacagatgtcagctatacataaatgtaagaaagattaataaaaacaagtatgataatatccaatttttggtgaatccgtgaatgatggcagtagtagtggtggtgggttaaatcaaagaatacagatttacaaaacaaaagttatgagcatctcctaccatcctgccaccacacaattaaaaaagcaacaataacatataaaaaaggattcccagcactgaagaatttaatgaatgaaataaaaatacagttgagatattcagcagtggatcagatcaagcagaagaaagaattactaaacttaaagataggtcttttgaaataactcagtcagacatacatgaatgaatgaatgaatgaaaaaaataattaaaaaagaaagcctaaatggcatctaggataccatcaggggaacaaacattcaagtattgtgaatgtctgggccctctattttgttccactggttttttgtttgttctttcaccaataccacactgtcttgattagattatagtaagttgataatgtcattcctccaactttgttcttcagtattgtattgactattctgggccttttgccttcccatataaactttagaatcagtttgttggtatctattaacatgctgggattttgtttgggagtatcacattgaatctatagatcaagttgggaagaattgccatcttaacaatattgagtcttgtccatgagcatggaatatttctccatttttttttttagatcatcagttttgtagttttcctcatatatatcctgttgtacatatttattagatttacacttttttgatgctgatgtaaatgagattctttttttttttttttttttttttgagacagagtttcgctctttcgcccaggctggagtgcagtggcacggtctcggctcctgcaacctccgcctcctgtgttcaagcaattctgcctcagcctcccaagtagctgggaatacaggtgcccgctgccatgtctggctaatttttgtatttttagtagaaacggagtttcaccatgtgggccaggctagtcttgaactcctgacctcaggtgatccacccgcgttggcctcccgaagagttgggattacaggcttgagccaccatgcctggcctgtttgctgagtttttatcatgaataggtattagattttgttaaatgcttttttgcatccgttgaaatgatcgtaagttgattacattgattcatttttttaaaatgacggatcagcctggcatatttggaataaatccacttggtatataattctttgtatacattcttggatttgatttgataatgttttgttgaggatttttgtattcatgttcatgagacatattagtctgtaattttcctttcttatgatgtctttatttaattttggtattggggaagtgctggcctcaaagattgagttaagaagtatccccactgtttgttttctggaagagatggtagaatactagtatcgttttgtccgtaaatgtttgccagaattcaccagtgtgaaaccctcatcctgatgttttctattctgggaagttattaatgattcaatttatttaatacatgtaagcctgttcacatcagtcatttctccatgactgagttttggtggtttgtgtctttcaagaaattgttcattttatcatctgaatgatcaaatgtgtgagcatagagttgtttgtagtattcctttattatccttttaatatccatgagatcaagtgatgattctctttcatgatattagtaattttgtcttttctccttttttcttgtttggctagagatttatttttatatatttttgaattcttcctcccccacacaaaaaagcaatatgtgagaaagaaatagattagcactagcagtaagtttcaaaatgaccttaccaaacattcacataatgcaactggattcattatccctgcctctctgtactcaacttgagaaaccagaatgataaaaaatgacatgactatttactgtgaatgtgatacagtaatcatgtctctgaagttcaagtatgattaatcttgattacatacggttatacattctgcttgaattaaaggaaaaataccagttctagaatcctctgacatttgtttattcttcccacaacttactttactaaaattctaatcatctttgaaagatttggcttatcaggcttgtgctggcttttagcaccaagagtgtcatgtttgagaggtgtggctatctatggaaacaaagatgaaattactcaaacctatactattttgatgagtcgctcatttcaaggtattaataagtaagtattcctgtttttggaatgcataaattgtgaagagaaaagaatggagaaaggtgccagagaactggtttgggataatttatttagagggttttttgtttttgttttgtgaaaaggtatagcttgtatggttgaaagagtgcttgttttttgtttttttttttaagtctctgcagtgaagttgaggatgacttgctcactaatttcataagtttaacaaaattaaaagttttgtttgactacattattctttgtatttaggtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcattt

SEQ ID NO: 36060 - DNA, 89249 bp, Homo sapiens; identical to SEQ ID NO: 36059

SEQ ID NO: 36061 - DNA, 89249 bp, Homo sapiens; identical to SEQ ID NO: 36059

SEQ ID NO: 36062 - DNA, 62289 bp, Homo sapiens
aagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcgggtcagtatccgccccctcgggctgaaggcccagagcctccgccccccagcctctacagccggcggggccgtggggactccaggctcgggaccccgttctccctgggcacatctcgcactgggctgtcactcgctctttggctttgcttggcctgcgccaaaggggctatttaggaaggtggagtggggtggaaaaagaaggggcggtcaccctgcccacacctctctcccacgtaacaaactttgcgcgactcttctcacgaacgcggaattgactccaaaggaatgaatcctgatacaggagcccgagtggagcttcctcgaccctggggtagaggaagggtctggtctagaactctgggcttgggaattgtaagttaaataattgacaaacctggagctgtcactttggggcagaggaggatccatccagaccaggatgttgacagtagtttgcttaacacctgagatggtccctggtctgtctgtttaaaaacgaagacttttgatctcatcgtagccactttttacttttttgaaaccttcctgagaaagcggtgacctgtcacagtgtttctgagttgccccatgtttgttgacagtcattttatgatgtttgggaaaatcttggttcttataagatgcgttttatatagatacagaaatttgtgtgcttttgaattgattttccagttagctaatgtttattctggttctgcttttttcccccttttttaatgttttaatctgcctacatttgaaaatttccattttgagagtgttcatgaaaacttcgtgtttctaagtgttgataaataaaaattagtacagtaaaactttggaattttaatcagtttcagttaacaggacaggtgttctgtggcttgacgttttggggggacaacacggagtataaatgtcagctttttctttttttaataaatgtcagcttttttttaacagaaaatttcccagatggttatctgaatccccaaattacctgtcctagttgtaaatcaatgccataacgtcattctgcttctaaaataagaggcttaaacctaaattctatccatgatgtggtttgagataccatttcaaaagcaccaaccctatgctaattactttactgccaacatcattctttcaggtccactcccctccctccagtagtagtgatggtttgagttaatgaccagatctttagactatacttaactctcgaagcacttttagcagttatttaatatttgatcaaaaagcatgaaatgaagctgttgagcttaatgagtagagtacctgctggaccatggacctcctgcatcagaattcctcttatgggtttgttaaacattgggttttaggtctggaacagctcaggtatacatagattaacaatctccatgagggattcttcacactaaagagaactacagtaatgaaagagcacggtgtgtatccctctgaatttaattggcagagtttaaagaaaattaaagcataggaattgtgctgtctgtctttgactgcattttatatacttagagctccatgccagtggaaaagatatttgaagatcaacagttggggctttcaggatgttgtaataaaagacttaacactgatatattaaatccttgggttgtattgatgtaggtagaggactgtattcaagaaatgtctgctctgatttccatcatagttaaagctgtgccacaacatttcaatggtaaaggcagaagccttagccagaactaaaacaatgtagatgtgcatgctaaaaggtaataaaggcagtgctgtgctcacatgaagttcatatatcataaaacacctgtgcgggcccagctcatacctgtaatcccagcactttgggaggctgaagtggaaggatcacttgagcccaggagttcaagaccaacctgggcaacatggcgaaaccccatctctacgtaactccaggtgtgatggtgcacacgtgtagttccagctactcgggaggctgaggtggcaggatggagtgagccccaggaggttgaggctgcactgagctgtgattatgccactgcactccagcctggacaatagagcgagaccctgtctcaaaaaaaaagaaaaaaaaacaaccctgtgttaaataaagttgtgtaaattaagctatggattttcaattgtgattttcattcacagggtttcggcctcaaagtttaaagttttactccagtattaaaatcaagtttttggttataattttgtgtttgaacattagtggttacccagggcaggtcgcatctctccaggtggagtatggtcagccaacaaagagaatcttgattctattgctgttgatagctgttagctagtatcatgttttagaagcatgtaaaaatatgatatagtcacatgctacataatgacattttggtcaacaatgaaccccatgtaagatggtggccctgtaagaatataatggagctgaaaaattcctgtcacctagtgacattgtagccattggaacatggtagcacactttttaaaaaataaatttagtgtagtttaagtgtacagtgtttacaatagtgtatagtaacatcctaggcttcacattcactcactcactcacccacagcaactcttaatcctgcaagttccatttatggtaagtgccctagacaggtatatgttttgtaatcttttacaccatattttcactgtagcttttctatgtttagctatgtttatgtacacaaatacttactgttatgttacagttgcctacagtagtctgtatagtcacatgctgtacagatttgtagcttaggaacaacaggctacactatgtagcccaggtatgtagaaggctatcccatttaggtttaagtatacaaaaaggaaatcgcccagtgatacacttttcagaacatatcctcgtcattgacacatggctaatattagaaacattttctcttttctattaataaatttaaaggaggacactaaaaagatatttcttcattttctcaggataatagtgaaaaggttataatttttctcacaaatgcatgctttcttatttttggcagaagaggcaaatggcttaacctttttttttctttgtgccaagcagtgttagtcattttagttaggtccactgccaggtatttcaggtaataattataaattcagagagtagttttcagacagcagaggatgtttaatttcactgttttggtcgttccttaaaatattgtgagtcagcgggacagaggtgttaccccttttgacagattgagaaacagaggctgagcaagcttttgttactgaaccatgtgtcagaattaacatgtgatgaagccaggttccagacctagctctccaggtctcagaattgaagaaatttagaatcgagagtatcttaggatctgtaccaatttagagctaaagcagagaacaggatatctggtctgttttcaccaaactatttagactttctgtgtttaaaggttatcagtctgtttaatttacgtgatgaatggaaaaatgattttgtagtgatcacttttccctgaaagcatatctctggtactttgcagttttgttagctaatacaataaaaataaaaactggtccttttcaaaggaaggtgtacagttaataaaataatatgaaccatttggatgtgatgctgatgagcgagaagcgcataacttaatccttttgcatttttttcttgttgcttgatatctgtgttctgatgaaaacattactgtttgctttttatttatgcataacttcagtctctttaatccttacctgaatactacttatcagaagttcctaggttataaacaactctttaaaaagtgttgtgtgaatgtttatatcagtttgaaaaagaaaatagcttatgctttgagactaccatctggagtaggctttcccagtttagtaactgagaattatcttattcaccagtaatattagcatatagtccaggttgcgaagagagagggagagaaagagaagcatgatgcaattcacatgaaataactctgatgttacaaatcatgtttcttggagtttgaaaacacgttttgctactctaatgcctaacagcttgtgctgtgtgaaatgtacatgtctttaagtgtatttacagatgtgtccatatgattcacctgttagctacctatgtaacctgttgtggtgaggtactaaatgtagcaatgtagtgatagtgatttagagttccagctaatctaaagtttcattcagtatttgggggtatttcatatatgtttaaacatttaatatctgttttgatatattaactagttgaagtttgtgattaattacatatacttacagtacaactttgatatattatagagatgggttttttaaatttatctaaagatttgctgagaatggaatttgaaccacatgttagaaattgggctttgggtaatacttgtgaagaagttagcatgaaggacaattgttaattaactgacatcattgcctaatgttatgggcgctgtgggactaatatgtggcatacccttctctccacctgccagaagtaaaacatactttgaaggtaatctaaaagtaggtgaatatgaatagtagctgtaatttaaattttctttgacttgacagcactttcatatatggcaaaacctcactaatggactagtttcctcaaatattcgaaagaaatattgtgaggtagtgtcttgtattttgtgcataattgagttggttatacttcttagtcttaactcagtactttgataacaaactctaacacaggttttttgttatattttagagttgcaaattacaaatgatatttaggatatagccatatgaagtaaagtataaatgacaactatagtagcaaattttctagtaaaaaatgacatggtcttacagggttttgtctactggttaatttctcatacagcttatggagcaggtaaaactgaaactcactcctgaataaaatcaggtaattttaagagcaagagggaaacttaaagatgatctgacagattcgctgttttaaactggcaaggaatacaaaaatcaagcatttccatctgaacattgagttgttgcatgtgtttatgtaagagcaggaagaagagtaacaagcagccagaaaagtaatagtcagaaaacatggaaaaagtaacagaaggaaaattaatgtaatcagacaacaccaaagcaggctgtgtgaatgtgtaagcaaggtgtaaccggtggctgtttttcattgtttaatgtaagttattgatttcttactacatagctctcaattgagtgaatatatgataggaccatgctgctttttacctgcatctggttatctctgagtagagtagaacacaaatcctaaatataattgttttgcaactctgctatcaaataataattcttagtttccatccttactatagtagtaaacaatacaaatactaatgagcactaaaatgggctactctaactcaagatcctgagcagacaaacagaataggtggaagcccggagtatgaaattagagatttatttttatgaacttagtaactcattctcagaaatagactaaatagacccacaagaattggatggaatgtgaagaaatacctgtttttgttggtggaggctgttggtcttcctacctttgtaacagatggagctaatgtcttttctggagaaagagagaaactaaacccccaacccattttttttttcctttcacttgatcttttctgaacaattgctgaatatagctaactttaaaataattctatgtttatttatccaatgtttgattattatttgctatacttttcacatgttttcttttaataataactaatttcccaacaagaaagattactaaattgtcttaaaatttctttgcagatgaagaaggcagccaggatgaatccttagattccaaggtatgtactaaaatgtgtattggccagtatttgctgcctgatttaaaaggatgaattatgtatcttagaaaggatatgaggtctgcaacttttgagtaacagttgaattaaaaaggacagaaaaagacagatggtattagtattagttctagtttttctggaggaagaaaaaattactgacctacaagagggaatagtaaatatttcatttcaacttgaatgtgctctgtgtgtgtgtgtgtgtgtgtgtgtgtgtgtgtgtaagtttgaagatttaacctgtgtcatttgtttccactttccagttctcaaaaataaatccagtgagctaatgcacttattggttgattgagctctcccttccaagtactaaccaagcccaaccctgcagtcagttatgagctctgatctttagatttgagggaatgtagataaaagcaggaagtagaagtataaggtatgttgggggcatgtggaggaaaaccgaacccagactttgggaattaaggaaggcttctgggggaagtaacatctaagttgaaattcaaaaaggctacaagttaggtgatgaaggaaggcacgtgatggacacatgccaaagcctatagagatgagtgagtgtggcacttcaaggagctgaaggagatgtgatatctggattagtaaaaataacggtcaaatagggttggggaaagtcttggcattgttgataactaaaaatactttatattctcagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccaggtagtctggacattttccttgctttttgatttatttaggggacaactgaaaattttaagctaatgaataaagaggctgaagaagactggcttcactgattattacccacaaataatatatggagtgtagtttggagagaatttctagattttaatataccaaagttattcacttaacagatttgacccaagttacataagctgaattcaatagatgagattgcatttatctttttattaatatcctgacgtttctttttggaatcaagtatgtaaatacatttctcactgagaaatttaaaaaaataatatgtcagggtagcatacaaaacagaaactcaggaagaactgtctaacatgccactatggttattttcaggattgtggtaggattattactacaataaccttgtcgatcatcctaggtaatttgatttaggtgtttatccctcagctgacgcttgtgtgtacttccatcctattctaactttcacaatcttgaaacctctacttttcaatttaaaacttgacctttttcacaatagtcttctaaatattaatccttttaaaaattattaatgtatgcattctaccatgtcttgttgcccttctgtcatttattatttcaatgatcactgccttatctgtttattattccattactaaccactctcaggaactgatccaaatttgaactttttaaaaaaatagaatttttttttactacaaatataccattctcatgaatagaaaactatttttaaaaaattaaaagtacctgaatcccatcaactagaaataacagctgctcacatcatggagaatattctctcaggatttttttaggtgtatcagtagttttaagaaaagtaaattgggtcaaaatgtgtattctatgttgcagcctgcattttgcacttaacagtttaccatgaatgtttttccatgtcatttagcttattttcaatttgatagttaatggctataaaaaattttatttgtaaatatatggtaccataaaccaaaacgtttatgttttgctgggagatcattttagatgtatctttgtgcctatctgtgaaaatttccttagaattcttaaagtaaatttgctgaattggatgtaaaagtttaaaagacagtagatacacattgttaaattgttcttcagaaaagtgattctgtttacttcctctgaaaatacctctttccctgtacctcacccaagtgtgtattaccattttaaaatttttactaaatataatttaattcattcttcattttttaattagggattttttttttttttttttagtttttatatttttagagacatggtctcactctgtcactcaggctggagtgcagtggcacgatcatagttcactgcagccttgaactcaggtgatctccctctttggcctcccaaagtgctgggattacaggcatgagacactacatcaagcctgggaaatttttaaacatgcataaaagtagagggtaaaatgacaccccttaccaaccctcactcagcttcaataaacatcaacattctgctggtcttttcatctttactaccctacacacatttgccctttttttctttcctagaatattttaaggcaaattccgcatgtgcttttacatctctgtgtctctctctagtaagaatgttcttttcagcaaaatcacagaattagccattactcctttattacctaatacccagactgtttaatttttctagttgcttcaagtgtctgtttacaatttatttgtttgaattcatttctaagctaagacctaggtttctcttaatctgttgctgttctccctcttttgttgttgttctttttttttgagacagagtcttgcactgttgcccagtctggagtgcaatggcatgaccttggcttactgcagcctccacctcccgggttcaagagattctcctgccccagcctcctgagtagctgggataccaggcgcgtaccaccatgcctggctaattttcttctatttttagtagagttggggtttcaccatgttggccaggctggtctcgaactcctgaccttaagtgatctgcccaccttggcctcccacagtgctgggattacaggcgtgagccaccgcacccagcccctcctttgtttttaagtgtcattttatttgctaaagaaatatgcagtatcctttgtgctatacagtttcccacgttttggatcttgctggtcatgaacttgtaatgtcattgagcttgttccattatctgctgtttattctataaactgggagttagttctagagacatgggtagatttggttctgtctttttattgagagtatttcataggtaggtggtggtgtgtactttctgttgctttacattgagagacatgtagtgtctgatttttccacttttactgatgttaagattaattagcgaggtcaggtggtatcaccctgatctcaccattctaaagttcctcattaatcttttgcctaggggttttggcaaccatttatgtttgttgcctggatcttttaattattaggggttgcaaaatggtgactttctaattctaccattcctcctgcatttgttacctgggattcttttataaagaattttctctcatcaagtctttgattaccctgaaatatagtctcatccagagaaagctagataaattcttatttcctttgcactgttgtgaaatgaaaatttggtgcccaagcaatctctgaaagagactaatgagtatgtttttgtttgtttgtatttgttttgttttgctttgtatttgagcattgtaaggatatagtaaaaaccaaaccaaggtgtgtttttctttctctttctcactgagttaacacttctgacaccagatatgttgtgggtatttccccacataccaagtaagcaatcagttctgcagaggattctccatcagagaccagcaggatgtctgctgatttaattcaattctgacactacctggagatagcattagatctcacaagtttagggctcagtctcacaagaccagtccccgctacttgagatgccaatcataagccccgggttgtctgtgcttctgacagactggctataaatcagggttcccacaacccccttcttgggttcaattaatttgctagcacttaggactctgggaagcatgataaatgggtaaatgtaaatataaatttacatttattataaaggatattacaaaggatagagacgaaaagccagatggaagagaggtgtagggcaaggtatgggagaaggactgcagagcttccatgcccactctgatctgatcacgccacccaccttccaggaatctccatgtgctcagctttccagaaactcccagaactcagctattttgggtttttatggaagctttgttatgcaggcataattgattaaatcattgcgcgttgatttattggctcaacttttagctcctctgcccttctgaggttgggggatgggactgtaaattctaaccctctaatctaatctaatggttggtttccctggcaaccaagtcctatcccaaggctctctaggaacctccagccaccaattttctcattatcatacagaagacattcttatcactcaagagatttcagggattttaagagctatgtttctggaaacggatgaagatcaaatatttttttcacaatatcacaagcatcattatgaattcatggattcttacatacatgtcagccctctgtatccatggattcaaccaaatatttgaaaatatttggaaaaaatgggtggttgcaactgtactgaacatgtccacactttttgttcttgtcattattccctgaacaatgtagcgtaactatttacatagcatttccattatattaggtattagaagtagtctagggatgatgtaaaacaggaggattgcgtaggttatatgcaagtactacgtcattttatctaaacaacttgagcactcatggattttggtaccaccaggccaggtcctggacccagtcctccagtgatactgagggacagtcatgtgtcacttaacaatggggatgcattctgagaaatgcatcactagttaattttatcgttgtgcaaatatagagtgtacttacacgaacctagctagtgtagcctatacctcggctatatgttatagcctattgctactaggctacaaacttctacagcttgttattgtattgaataccgtactcagctgtaacacagtggtaattatgtgtatatctaaacctatctaaacatagaaaaagcacataaaaatatggtataaaagatttttaaatggtacgcttgtctagggcacttcccatgaatggaacttgcaggactggaagttgctgtgggtgagtctgtgagtgagtggttagtgctgagtgaatgtgaaggcctgggacattgctgtacaccactgtaaacttttataaacaagtacacttaggctgcactaaatttattttcaaaattttttttcaatagtaaattaaccttcgtttatggtaacttttttagtttataaacttttatgttttagcttttcaactattttgtagtaacacttagcttaaaatacaaacacattgtagagctatacaaaaatattttctttatatattatccttattctataagctgttttctatttttaaatttttttttaactttttaaacgtttttgttaaaaactaagacaaacatacacattagcctacgcctacacagggtcaggatcatcaatatcactgtcttccacctccacatcttgtcccattggaaggtcttcagggccattaacaggcatggaactgtcatctcctatgataacgatgcctgtacttcctgaaggacacacctaatgctgttttacagttaacttttttttttaataagtaggagtacatgctaaagtaaggatgaaaagtatagtaaatatgtagaccagtaacatagttgtttgttatcactatcaagtgttatgtaccgtacgtaattgtattactatacttttatacaactggaagtgcagtaggtttattcacactagtttcactacaaaaacatgagtaatggattgtgctacagtgttgtaatgactaggacatcactaggtgataggaatttgtcagcgatataatcttatgggaccaccatggtatacacagtctgtcattggccaagaagttatgatgtgtcacatgatcatatttttgttcattgcaatcattcttttttgttgattgctcagaattttccttttttggccattggtaatcattcctttgtctttttgactagatcctggtgatctttcgtaactttttttttccaggcagaacaaggatgtcctaaacttattttgtacatttcttgacccagaaatgaaagtcagctatttctccaaggaacccagattgcttttggtgggttagataatataagcaccagtgatctgcattgctaaattttcattacttataggcctttttggtgcattgggttaggaaatgtatctttcataccgataacttctagttcaaattaaatattacaggcaagataacaaaaatcagattgacaaattgaacttacaagaatcagagatcctaacctagtatcaagcttggcaaatattttcaaagataaaattatcataagacgtgagcggggtgtagagaagtctgtgactgccagagctgctctcgggtcgtttctttcctcaattagactgtgctccagcccagagttcaacactcaaggcctctaagtaatgcctgtagagtgtcaattccacgaaagaaagctgtttccgacatgagacatcactggtttcttctttgataattacatagtgtatgtgatattttctagagagtcatgcctacatacatcccaggtttttgtataatgagcaatgtagacagatcaagttcatcctgctgaagcatttcataagcaaggactcttccaatagtaaataccttcagtgtgtttgccagaggtctctctttaccatatttctaaggtgatttgatgatgcttggagagaggtatctgctcactctgttttgggccagtgagaagaaagaacagactacaggtctgctgcgagccctttccaccttatcagagtttttgcttcttttgtgttatctcctttcactggtgctgaaaatcttagtacctaatgacattaatgttattttgttttatcataataaatatgcatatatagtttcaaaataacagtggcccttaccactaactgtgggaccacagaatgcagcccaagattcctttatggtccttcttattcttggtatatattttgctagggacttgtaataatacagtgttttaaaatcactaataattctctggttatatcaacaactttataaacatttagattaatttgtaccagttttcacttttcaataatgatttagatttgtttttaatttattcttaatatatgaaaatgcttaagtacttatgcatatatatgacataaattgcatatatatggctctgtgtacagttccagctacactagaactgggttatgtgacagttactttgaaacttttgccctttgtcagcctctcaatcatgttgctaccatattaatctttctcaaactcaaatttgaccccataactcccctgtttacaggcctccattacttccctgtttgcctgagagatgaagtatgcagtccttagcatgattcacagagccttcagtgtaccccttccctaagcagcctttttcagcaatacaaaacccttttctgttctccaaacacaacataacagtttatgcccctgggcctttgtacagattctcctcactgtttaggatgccttcctcattcctttgcccaaatccactgtcacaaatttctgttcattcttaaaaataaatgtaggttttctcctttctgaagtggttcctgaaccaaagtgtttactatatgtaagagcttcctatctggccttcttccttttgctctttcccccactatcagttccctaacagcagccagactgagactacttcctgctcagaaacctcctttggcttccggtcctactcaaagtaaaatccaaacttcttctatttacaaggcctgacatcaggcccttcctgtctctttaactaactcttctgccactcccctttaggtgactcccaccaaacttgccctcttgctatttcttgaatatttcacacttattcccagttgtgttggggaaccccaagaccacaccctcaggtgcagtaatttggtaggaagtgttcctagtaaatctatgctgactcaaaggactcagtgtagagttgtgttcacagctataatttgtcatagtggaagactagaaggcaaaatcagcaaaggaaaagtatggaatgaagtgtaggggaaaccagatgtaagctttcaagggtcctctcccggaggagtcacacggagtgcttaaatccagcagcaacaagttaagataacacatgtgaaatgttttccacccaggtagcttattagagaactagagtttttattgggggctggttaagttggcagtctcttcctggcatgtaccaaacttgcagaaggaaagcaggtgttcaacattgtacagtttgggtgagccactcttatctgtaggatggtgagaactctccagaaatctaaatttccagatgctaaccaagggccaaccttggaagccagccttctcaaagagagaagtttatgtctgtttttttaactcttctctgcacagtctactccctaggtcattggccaaggcatctttatagcagagttaccaataagacccagatagtagtgagaccagcctgcaatattgattttaggtatgccttttaggaggcctggacttagccagttaaaacaattcccatttatcataatggtctatcttagaaaaacaataggcttcctccctaagttttaacctttctaatctttttacctttttttttttttttttttttagacgaagtctcgctcttgtcccccaggttggagtgcagtggcatgatctctgctcactgcaaccttcgcctcctgggttcaagcgattctcctgcctcagtctcccaagcagctgggattacaggcacctgccaccacacccagctaatttttatatttttagtagagatggggtttcaccaggttggccaggctggtctcgaactcctgacctcaggtgatccacccacctcggcctcccaaagtgctgggattacaggagtgagccaccgcacccggcctaccttttttaaaacacattttacctattatttgtttttgtacgtggtcttaagtttctgtattaactttttttttttttaatcagctgcagcacaactgtggcctagtaagtggaagctgacctaaaagctttccagggctgagtcagtctcatgagagtcagagtacaagaagttccgtcccaagccgggcgcagtggctcatgcctgtaatcccagcattttgggaggccaaggcaggtggatcacttgaggccaggagttcaagaccagcctggccaatattgcaaaaccccatctctggtaagaatataaaaaattagctaggtatggtggcatgagaatcgcttgagcctgggagacagaggctgcagtgagccaagatcatgccacagcactccagcctaggtgacagagtgagactgtctcaaaaaaaaagaagaagaagttcagtcccagagggtacacatggtaaccctggaagcaaaccatcaattacagatactctgtttccaaaactcaaaagagttcaaattccagtcctctcactggcagcaaaaagcaaggaagttgtgtcccactaaacatttttttgcagcttcccctgatcaggattattcctctggtatttacaaaattacaggtgtttaacattttattttaatttttacaatacatctagatgcaatagccacaaaatataaagctattttaaaaatattcttctttttcttttttctccctactgcagtttactcagcctcctagcagtaaattcagtgtttgcactgttaacattacagctgccagggaagatcctggaatgcagtggaggaagggaggtgggggaggatattgtagcaagagcagcagccaggctgaaaaaaaactgctggattgttacctcccccagtttttttgtttgttttctggtttatctaaaattttgttccagaccagatttaactttttaaagagagcagttcaaacttgtaacgtttttggtttggcccatccttgggaatttgggggtcctttctcttcccatctagaagagagaacaaaaactacaggcctcacctgcaatacactgccttttccctcattttagccagcaggactaaaagcagtcaggggcatccagcaagccagctttcctggagctggatcttttactttcagattctatggctctcaacaaacagcagctcagctactgcttcatactgtggatgactccatgaccactcaggccccagagattcatcatattctgccctttagccttcctcttcttaacgctttcaccatatatcagtgagtcagggtcattctagcaaatcccacttctaatgcatctgtgtcagggaacccctaaaccatccccaggtttaatgatttggtagggggatttgacatatagttgccttcacagctatgatttattacagcaaaaggggacaaagcaaaatcagcacaggtgcaaggtacatgggggggaagtctggaggaaacaaggtagaagcttccaagggtcctctccctcagaactgatgcaggatcacttaattaccccagcggcaaattgtaacaacgcatgtgaaatgttgtctaccagggaggcttgttagagacccagtgcctggagtttttattgaaaactagtttgtaatcaccctctgctagcatgtaccaaaactgtagaatcccagaagaaaaatgggtagtattgcgtgtaaaccacatgtttgtacggtttgggctccgtacacttttataagttagaatggtggcgtgtccggaatttgttccttctaatgcccagacttcagggttgattccctccttaagcaggggacaacaaatgggtaacttgttccccatattcatgtagataatagctccagctttggctaatatatcgctccctaataagggtcctgggacttccaggcataacaaaggcatgtgaaaagagcaaagtctcccaattacaactgaggaggtgggagaaatacctggttacaggctgtcccaggattcctcggttggtaacggtccttgaggacagttgtctgggacaggaggttaacactgagaaggccacagtgtccaggaggaagtcaatttcctggccctcaatggttaaacgtacccggggctcggtgagggtgatgacgtgagctggcgcttggcctgggcaccctcagtcctgttgttggatcatctggttgggggcttctggtccagagaacctttgtcctctggggcagtgcaccttccagtgattgcctcggcatagtggacatgggcgagggggcagcttgtttctcactggacaattttttaaagtgtccttgcaaaccacactgataacaagccccaccaggtgattggcctcctctattttctgtcctctttgaaccaccaaggtttgtttgtctggagggccatgactaaggctgcagcctttctctgatctcacttttcctttttggcctgttcctcttggtccctattatagaacaccaaggttgccaggtttattaatgcctccagattttgttcggggcccagggctcacttttggagctttcttctgatatctgcggctgattgggtaataaacttaccctttagaatcaattgaccctcaagtgagtcaggtgacaggggaatatgttctcttaaggcctcttgaggaaggcagaaggattttcttcctttccctgagttatggtggacatcattgaataattcatgggctttttcctaattttccttagtccttctagaacacaggtcagcagatgtttatgactccagtccccatgatctgagtctagatcccagtggggatccatactggggacggcttgctgactggtagggaatttgtccctttcttcagctgtcagtctgtcatttacttgactaagataccaggtgtctccaaactctcaggctgcagctaaagctgcattcttttcattaaaggccagggtttgatctaacaataacataacatctctccaagtgagatcgaaggtttgccctagaccctgtaggacatctgtatacctatcaggatcatctgaaagcttccccaggtctgccttgatctgctttaaatcagagagggaggaggggacatgtacccaggttgggccaaattcccctcccctacagcttgaaggggacataaccaatagcctgtgggggtttgtggtcctttggagatttctttgcttgtttccttctgggcaggggagattagaggaggcttatcattaataggaaggggagctatagggaggctaggatatggaggtaagctaagaggtcctcctgtgggatgtaaattgtaagctttgcatagttgtggattctccttcaatgaaaagaaagcttggacataaggtatttcactccatttgccttccctcttacagaaaaggtcaagctgcaagatagtattgtaattgatacttccctcaggtgaccatttttccccatcagagagaatattggggccaggccatagtgcagaaaaaaatgagctgcctctttttcagggtttatgggtcaaattggtcccaatggcttaggatgcatttcaagggtgagcctattgatgcctgtttcccatctgaaagacagaaccgcccgcggttttggtttgtttctctccctgcccaagaacccacaagggtccctggaccctccggatcagaatagttgcgctcactgacaaagcagcagaaacactagttttcctcctagaccacaaagaggaccaaggaagattggatttagtggcccttaccaacgcattctcaaaatcctgcactcttgtctgtcctcctagaccccaaagaggactgagaaaaatcggatttagtgacccttaacaacgcattcttgaaaagctgttagagtcctaagcattctcctgttagtagtgggattttacccatgtcctataaagatgttatgccctgaaaatgaagtggagggccataccctaagggaggggagggatctccagagttggaagagtgatgccttttgtcctcacttgaataggaaggatatcatttctgaggctccccatatcctagcttcaggaatagcttttgttaggcctgctaccctgaggagggatcctaaaattacagataagttagtcccccgccccgatggggctttgggcaaaaattgtgtctttctggttagtgagcccaggtgcctaaagaagggaatagagtcctggagtatatactagaaatcattctcataggagaaactagaaaagcaccagagacagggagttgttttagaagcaggactagcctcagagaagagaggcgagaggaagtttgtctgacaagcattaggacccaggaagcaagggtcaggatagataggatagatgggcgagtctcacttgggcgacgtgacttcgagagttccgctcatggccacagggtcaacaaacttgtcgggaccccggagctgaatggctttcctctctgtccacccttggctcagccgagaagtacagggaaagcggaagctggttccaggcaaaccaacgctcccaattccgaagagttgggggtggttagagagctctttcccagaaagcctgacatccgtgtctttagtccggcggccgcgctagtcgcttttaactggctgacaggtgccagtatttagcccccgaattctaaggaaaagtaggacagaatagcaaacgaaaggggtctgatggtactcactgcttgctgattgtcccttcgtgggtgccaaaatgtgtccagaatttattccttctggtgggttcttggtctcgctgacttcaagaatgaagccacggactctcgcggtgagtgttacagttcttaaggtggcgcgtctggagttgtttgttcctcctgtgggttcgtggtctcactgacttcaggagtgaagccgcagaccttcgcagtgagtgttagagctcataaaggtagtgcggacccaaagagtgagcagcaacaagatttattgtgaagagcgaaagaacaaagctttcacagtgtggaaggggacccgagggggttgccactgctggctcaggtggccagcttttattcccttatttggccctgcccatgtcctgctaattggtccattttacggagcgctgattggtccattttacagagagctgattggtgcgtttacaaacctttagctagacacagagcactgattggtgcgttcttacagagtgctgattggtgcatgtacaaactttcagctagacacagagtgctgattggtgtgtttacaatcctttagctagacagaaaagttctccaagtccccacctgacccagaagcccagctggcttcacctctcagtgggaacccttccaaaatctaagtttgtagatagcagccgagggccacatgataagcggtctttcaaaagataactagtcaggcttgctgtgttaactgttttctgcatatcatctcaataaacatttgttgatcatgaatgaataattaaaacgccatcataaggagaatgattacattgtggtattccctattatagaatacccatagccattttaaaaggaacaggttttgttgtaaataaaaaaatccatcagacaatggcagaaccagaagtttatttggctcatgtaactagaactcacagataggcagttcaggacttgtgccatcagagactccagctctccctttcttcctgttcagctcctcagtagactggcttcatcctcatgtttgttccatgtggtcaaatctgatagtggctgcaccttcagggcctgggtcctcaggaagaagtgttgcctgcatcagaagagcagaagcattttcagaagacactaggagaattctgaaactatttctcctggggaagtggttcagaatcagtaatgaggcagtctgccctgtctgccacctacaagaatgtcaatgatatgttaagcaaaaaaatgtcctattgaaaagtagttcagttagtatgatcctgtattagtcacagttctccagagaaacagaaccaaaggccatttgcttggagaatttcttcctcatagggttcagtcttcattctgctcagtccttcaactgattgggtgaggtctgtccacatcatggaggataatctgctttactcaaagtccaccaatttaaataatttcatccaaaaatcaccttcatagaaacttccagaacaatgatatactcaatatctgggcactatggcccagccaggttgacacacaaaattaaaccatcacaaatcctttatgtgaaaagaagccatttgtaaaaataagtttgcaaatgaaaaaggtccagaacttcttttttcagtaactgtcattacctcttgacagaaataacttgaagtgataggtaaagataactgtcatttttctttaattttgtatactttcttactgtttgtctctgcagtaaacacatccttatagccttaaaaaagaaaaatagagtaattggcatcttgatctatttcaaatggcacaaaaggaactgagtttaaactgactacatcttgcttaaaattgggttctgaagcaagtttgttgagcaacagaatggcatttctacttcattgttgcttaaatggggatggcagggaaggaacgacctttaacctagcaatcatattaaacagaagatagaagaataggcagttgcctgcaacaggtcctgactttcatgaaaaggctttttttgttattgtttctttggtttgatttggttttacaagcaaattatttgtgcaaggaaactcctttaggagaccatccttgtagatcccagccacaccacagctttgaaaactcacgtgtctttaaagccgttgtttagagaaacccactgttcttaaacagcagctttcctgagcaagttttactctggatggtttttgacagtgcctgtcacctgattaatatgaagtttgccactttattctggtcacatgggccagtgattgtgctgctttctctttgtattttaaaatgattagttgcttctcacagaaagagctgagctttgtatgaaccctgatcttaacgttttgttcattctgcatatgaatacatcttctgaaaaatacattttaatctgtaaagtggtggctttcttcgtatagcgtgtgtttatttacaaagatagtttctagaccttatttagcagttttcaacttttggtgaaagcagtctgtagcaaattacataccattggtattttccccaaaatattactatagcatattcccagacaacagtaaaatattgcctgtatcatttggcctatatcacttactttaagtcaggtactttgtttcctttaaaccatatgtactggtgctttgttcatagtccttgggagattttttttggtgacaatcgtttgcttggttgagcttttatgttggtgtttactaaaattgatgaacactatgacagttgtcttgaggttggtagctttttaacattaaataattgtttctcagctatctttgactacaggtatatttgattcatatgctacttagtactctatgtttggaagtaccagattgtttcagagagacagcctaatagataattttcttatttaaatatcacctatgtaaactgtaaaagttcttaaaatgagaaatttgcaaagctaaattatgtttatctgtatagatcaagaaattaacttttagttttctgttttgattttacaatttaaagtgagaaaaagatgtgcttatattcccctagcctttaattgtctatatatatatatatagagagagagagagagagagagagagagagagagagagagagatcagcattctagctatgtttaccttttttgtcttggattctttccttcaatgttcaagcatactgtaatatcttatctgttaaaaacaaaaatcttgtatcccttagtccccctccagctaccatcccactcctctactcccctttatagcataattctttgaaatcgttctctataatcactgatttccctttctctcttcctgttctgtaatccagctccagcaaggcttgagcctcctccagactgctaaatctactcttctccactagtcacattctaattgctgaatacctggtcggttcctgatcctcatcttaacccctcactagtgttcttttccctgaagatactttcttcagttggctgctggttccttagaatttgtctgatcttgaaacatgagcttgcctcaggactcagcctttgatcctcttccctggcttcactactctctagggacctttaattccttccgtgttgacgatgccccggttttcgtttaatggctgccccatagtgtatttacccagtttcctatcagtagatctttgagttcatttggttttatgtttttaaaattaggatactgtacaagtattctcttgtacataatctctttgtgtgtttatgggagcatttttttaagtaaacatcctggaagtggaaaagctggatctgaagatatggacctttacattttaacagatattaccaaatgccccctcttgaagagattgtattaatccatacacttgctaagagtatgaaagggcctatttacccatcttctggccgacgctgcatattttccgttttattttgctttttactttttcttactttcttgactgattttaattgactttgcaagagcagatttctactagttgaagtgtaaagcattctgttcattattacaataagttctgtactataaatatcttcctcttgaggtctaaatagattgggatactgtgtcattaattgtagagccaaaatatgattcattacctagaaaatgtgaatttttacatgaagctgcagaactgagaacccatttttccctttcacggtgtcagatttgatactggttatcgctaatttaaattgcataacctgtcagcttcattataccagagcagtgattaccttgtttttaaaattgatactcttctggtggaggtttttaaaaggatggctttgaaattattgcaggatttctccatagaaagaaaattaactgaaattaagactattgtgaggagtttctgtttgagataatcgatttgaaactagagagttccaatcagtaacttttggaagattttagaacaagtttaaaaggtagtaacactttccatattgtgatttcccttggagaaggtagctgagagaaacaaattttcttcactaatgaattattttgacaggttgcagttttgactaaattgatgaagcaagtgcctcctgaggattcttcctccttatgtcagtgctgaatcagcagtagatgaaaaccttttgttgtcaaattttttttactctctccagtttcttttctgtggtatagttcatcacatgaaagggaattatttcatatatttgaaacatttagaaaatacaagttttggcaaactggaattcctatgataagttatttgtttttaagacaaagatttctattatcatagaagtgttaattcttttaaaccatcatttgctatttaatttgaaattcaggtttacaaactgcagttctacagacgctttctcggctcactgcaacctccgcctcccaggttcaagtgatcctcctgccttagcctccccagtagctgagactacaggcatccactgccacacccagctaattttttgaatttttagtagagacagagtttcaccatgttgcccaggctggtctcaaactcctgggttcaagtgatctgcccacctcagcctcccaaagtgctgggaattacaggcgtgagccaccgtgcctggctctcagacactgtctttctaaagcagcggcagatttggatctagtagcagtgtatagggatgtcctttccaaattctgtagtcagaatgactcctctgaagttgttgctaaaggattccttgcctatacattgcattagagatcctttctttaaaacatagacaaagcaaaggtaaaaaaagttatttgcctcttattaccaggatgatgagtgacatttacctggtgtaaaccatttgaaattcattttgtctttcatagcttattgaaagtatgttttaatttagtattgtaggatatgtcttttttcacactggaaagatagaagggatactttctagccttcagagcagggatgcccataataatagcagctgtcatctcttgaactcttattacctaaagtgataggcaccataatgagtcctttacatgtattatctcagtcagtctttgcaaacaataaggactgttattcctatttggagataaggatgttatctctaagtaatcttaagagattaaataatttgctcaaagtgcacagctaataagtggtaggatttgcatcaaatgttctgaccccggaatctatacccttcatgaccgagctctgctacccaattaaattctccatgtaaaagcaaccagtggaagttgacatgggctcatacctactgtgtacagttttaggcttagtcctggacctctggtcttctcatatacctctcatgcagcattcttaggcatacccttgaattcaagtgttatctgtgtactggagaatttttttttttttttttagctgtaactgaaacatgtttaagacattttcacttattttttgtttttgctgttttttttgtgtgggttttttctttgttttttgtttgtttgtttttttaatagccaccttgaatgtagcagtacctacccagtaacctactcctcctttagaattctgtatcttagtaagggcagccatctatgtacccctaacgcacctgggtatcttccttgactcaactttcctcttatccacacatctagaaagtggtaccatatctacctccttagaatcacttgagtacatccacatcttccattccattcccctctctgggctaccattgcttctcagatgactgttaacaacctttaaactggtcaccttgcatccagccttactttttacatactttccactcttttaataaaatgtgagcatgtcactcctatgcaaaacttttcagtgagtttccattgttctcaggataaaagttcaaactccttaagacatgtaaggtcttccccagtctgtcttcctcatgctgctttagcctcttctgttgtccactttgccattcatttgattcttgtcaccttagcaccaatctgtttgagtactcctacccaccccacccatgagcctttcattcactgctactcctgcacgcccttcaggttcaattgaaacctcagttcctgagaggggaggctttcctttccatagcatccatcacacatttgcttagtatctctcttcctggctaggcagtaagttgtgtgtagcaaagatctctgatgcacctcatttctagcacctaccataattttcaacacctaagagatactcataaataatttatagaataaattacagatgcagtctctacccttaacaagctcaaagtccaatgggaactagagtatggtaaagaagtaacttccatacatgtgataagtactctaataaaatgccacaggattgcagaggagtgtgtgagtggttagctttgccttggggggagcatttgccctttgtaactctgtattactgaagaaattgacttacagcattcagaaacaaggagagctgtgctgagcagtagaattgattcacttgcattttgccttattttttgcttactttttgggcaggagttttacagtagacctttaatattctaaggttatatatcaggaacttcagaaagtctaacctagacacagatgctatgtagtcagctagccatgctcactaaattgactaaaccaagtcctccctaatcaaaatcattgctagcccttttatgttcccagttacaaatcaggcatcatgaatctttgcttcaaattccaacagccaaaattgatggcattgaatccatgaataccagaggtgttgtttcatgtttagatttttatttcttgtcattccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaagtaagtattgctcagtaggaggcagatctgcattgctttatgtctagggcaatgtttttaaggcctttttctagccatcctttttccacattggtcagaaatggccagcattgctgatgtcattacagccttaaagagtggacttaagagtgggaaacttggtgtatttattttcaggctgtcactcaagtcacactcacgttttatttagagatggttttccattggtatacacaggttgttttgttaaacccttcaggcagcctgataaattattaaacataaaacattttgggggcagtaaaggaaactgggccattatggagaaggttaatagtgattagaagaaaaataaataactttttaaaaatacttaaggtgaaatatgctataccaaggtaacatttgacaaatacagtgtatttaaccatctttagtataaatgtcattatagagatgctgactctaaggaaagctattttcaggaaaaacttcctaactatgaaaaaacaacagaaaatcttgaacataatcccttaaataccaatttttaaaaaaataatggctgttatagaatatttgggcaatcctaaaagagcacatcaaatatagtccatctttagatgtaggccagcgtgactgggtactccagttaatgcaccagaatttttttatattataagaagaatttgcttctgtttctataaatactggttctaatgaaatgtttgttttgatgagttcttacagtagcaaaataacttttgaaaaatctataacagttctatgattttcagtgttatatcagtttgaaaaattggtgaacttgaacattaaatcagtttctatatttaataaaaattttttactaacttgtattatatagttaatcaaatattttcaccttgtaaagatatacagtatttccaatagagctaaagtgtcctttgatcccaacagtatttttctgactactgtgttcgtatgtcttgaccttattttagctgaccttggcatattgtgttagtccattctcacactgctgtaaggaaatacctgagactgggaaatttattaataaaggaggcttaattggctcacagttctgcaagctgtacaggaagcatgatgctggcatctgcttggcttcttgggaggcctcaggaaacttaccatatgagatgcagccgtctcatatggtgggagcaggaacgagagagatgatgaggagcaaggtgccacatactttcaaatgaccagatctcgtgagaacttactatcacaagaacagcaccaaggggatggtgctaagccattcatgaaaaaccacccctatgatctagtcgcctctcaccaggccttacaggtgagagagattgtaatcaccagggattacaattcagtgtgagatttggtggggacactgatccaaaccatatcacatataatctgaaattttagttgaattatatttaaaaagttagcattaccaacagaaaagtaccctctaagagtggcttggtattggtatttctataaaaaagtgatttcagtgaattttatatatgtgtgtatatatatatatattttttttaagttttatcttgtgtcatgtaaaggccacacttaagtgtttttagaatcatgtttgggaatagtgaaagatcattcattttgtttgtatgactgcccaaaagaaagaatactaatggttgataattgatagaattaaaatccatttaaatgcatctgacgttttgtttttagctgaagaagaggctgctaagagacggcagatgcaggaagcagaaatgatgtatcaaactggaatgaaaatccttaatggaagcaataagaaaagccaaaaaagagagtaggtagcactgctaagtccacttttcccccatgacaggccattactgagacaaatagcaactacattctttaaaaagtgcactgccagagacgcagaagatttttttaagttccattacaaaaaaatgtaatataacttacgggcattagtagcattgcttttaccacactttagttaaggtaaaattgttatactgattacagtaacaaacaatgagtaaaatggcaatgattgactcaagttgtagtagtttctaagaaccaagcatgcatatactatttagaattcaaaatgacataaaacaaaaagaattgttgtcaagtacgttttttgtttttgctttgtaatttttgactggaatttaggaatttgtgcttggaaaaaacagaacaagtgattatctcgtaacatcttatgtccttttaatttcagctgacatttttatagtctgcaaagatttaaaaagaaaattgcaacagttattattagatcgtatactggacaccatcatattctcttattgcaaatcggttaactttttttaatagaagtttttaaaattactgttagtataattagactatttcaagatattaggataacagggagaactggtaccttatatgaaaaacaaaatagctagccaatctgggcagcatagtgcaaccctgtctctaaaaaaaatttaaaaattagccaggcatgatggtgcacactgtggtccctgctacttgggaggctgaggtaggaggatcacttgaacttggaaggtagagaggctgcagtgagctgtgatcacaccactgcactccagcctgggcaacagaggaagaccttgtctcaaaaaaaaattaaaaaaagggatgttttttacatgtataagtaatatgactgaatagaaataagattatcagagggggtggctaggcgtggtggctcacgcctgtaatcccaacactttgggaggctgaggtgaccaggagttcgagatcagcctgaccaacatggtgaaaccccgtctctactaaaaatacaaaattagccaggcacggtggcgcacgcctgtaatctcagctacttgggaggctgagggaggagaattgcttgaacctgggaggtggaggttgcaatgaaccgagattatgccattgcactccagccgggacaacaagagtgaaactccatctcaaaaagattatcaaaggggttttgtaacataaggaaattatttatgttgcgttttagtagatcaaaaaaacttaatggcagtttcaaaacattactaatttggtttttaattgtttacatttgaagagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgtaagtacattctcagtgaagaatctctctgcatgtaacacttgttagttttaaaagcagtttactctctatgtcctgacttcttttaaaaagtcagactggaagataaataccaattttgtggctgaccattttatcagtcttcttggatagtctttttccttagtctgggaacatttatggtcatggaagacatttttgcagttgtgccttgctacaattacatttgtactcttccaaattagatctgtagagaatgaaatatgaagataattactttttatctgaaattactcaccattgcatttttccaaagttcagatgttgcagctcatgttaatcttggtgtttttttaaaaaagtattttattacagaagcagtacatgtccattataggaaactagaaatacaaactaacaaaactaagaagtacacatcacatatgtaccacccaaatatgagtaataatatattagtgtgcatgcatatctttctgtaatagatctttctctttgtgtatatatacacgatatttttattaaaatgagatatcactgtctattgttctggaacttcaccttttcatcccagcacattttaagtcatataatacccacactatgttcatatgatgttgaacccaaaaattttctttatacctgttttgtccaaaccagtattcaatccaggactctaccttacatttggttgttatctagtataccccaatgccttttttgtctatattagagatagggccagtttttctgcagaatatcctacctcagtttgttttcatggtggcttttagtttgtttcttcatcacctgtatttcctgtcaataggatgtcacagctaaaggctgatgaatacaagtaaaatatttttggctagactacattacaagggatgttctgtattctacattgtatcacatcagttgctaacatatctggttgtttccccattaataatgctaagattgacacctggatttagggggccatcatatttatttaaaattccttcaataattcaagcttattcaagctgcgagacttgcttaaagataagtgaaatatctaatcacaagggaagtctgttttcaaactatataaacaataacaggagtcataacagttgttttcttagaactgaatacctaacaattctgcagctctttcctcggtattttattataagcagattatatcttaattgttcccctttgttttcaaaggtttttctcttctttgcgtgaatcagtttatataaaaacatatatattcttattttcagaggtattctgctctgaagaacggttttactttataaggcatcagttccctctaatattagaaccttacaaagccacagcactttatatgttgcaaagcaccctctccatgaaaattagttctagttgatgcaacagacaaaacccgcaaatcacagtggcttaacactacagagagttatttcttgctcatgctagatttgatgtagctctcctgttggcatcactcttttctgagtagtgactcctggtcatgggctgtttctattatgtagctacactgattgctacacggggcttccatgccatgatgaagtgagaaaagagagcctcaggattcattagggtgttttcaggcttacatccctgacagccataccccaggcatgtgattctacggagaggctggaaaacgtagaggagctcatgatttcagtgagcactccagtctctgccacacctgcctttgtcatgttagcttatactttcctatcatcaaggatgatccatagaaggcaaagggttgaaaaggttgaacttcaccaatgcattatttcttccatttttgtgtttttatttttagaaaatcatgtgtgctctaacattgtagagcagcctttttcccttgacctcttcagcttgaccccttgctcctcctttttatatctgagatagtttatcttggtaattcatatcttgtctgttttcatagtgtattcctttctgcatatatagagaaatatgctgatgtacctatagcgggagttgtcttcataatggctgttcataaagataaagtcatgtttacatgtattcagctttgtctttctagttagtattaaattgtcctcaagctaaactttttgtcttgtttaaagttacatttggctgggcgtggtggctcatgcctgtaatcccagtactttgggaggccaaggcaggcagatcacaaggtcaagagttcacaaccagcctggccaacatggtgaaaccccgtctctactaaaaatacaaaaaggaaattagctgggcatggtggcggcacctgtaatcccaactactcgggaggctgaggcaggagaattgcttgaatctgggaggcagaggctgcagtgagccgagattgtaccactggtctccagcctaggcgacagagcaagactctgtctcggaaaaaataaattaataaaaataaagttacatttaattgtggccgggtacagtggcttacccctgtaatctcagcagtttgggaggctgaggcgggtggatcacttgaggtcaatagttcaagaccagcctggctgacatggtgaaaccctgtctctaccaaaaagtacaaaaactagctgggcgtggtggcatacgcctctacatagtcccagctacttgggaggctgaggtgggagaaccacttgaacccagtgggcgaaggttgcagtgagccaggatcgtgccattgcactccagcctggatgacagagtgataccctgtctcaaaaaaaaaaaaaaaaaaaagccacaaataaataaaattttttttaaaataatgctacatttaatttaattgtgtaatgtgtaaaactctgaatgcttttccaaggctctttaatccatgtttgtacatacttgaattcaaatcttttagcatttaaagactcttgcattttttcatagtatataaaactgtgtctgtctgtgtctgtcttggataaaccttcaccaaagcaagatttcttacttttatcatctatttcaggctcttggctttctgtatgcctctggacttggtgttaattcaagtcaggcaaaggtaatactattaaaactttattgcatattacaatttgaattgaataaatgcgtgcctatgttcagttaaacatgttttgttctttcacaggctcttgtatattatacatttggagctcttgggggcaatctaatagcccacatggttttggtaagtagactttagtggaaggctaataatattaacatcagaagaatttgtggtttatagcggccacaactttttcagctttcatgatccagatttgcttgtattaagaccaaatattcagttgaacttccttcaaattcttgttaatggatataacacatggaatctacatgtaaatgaaagttggtggagtccacaatttttctttaaaatgattagtttggctgattgcccctaaaaagagagatctgataaatggctctttttaaattttctctgagttggaattgtcagaatcattttttacattagattatcataattttaaaaatttttctttagtttttcaaaattttgtaaatggtggctatagaaaaacaacatgaaatattatacaatattttgcaacaatgccctaagaattgttaaaattcatggagttatttgtgcagaatgactccagagagctctactttctgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaactggttctaagcaaaagcccttataatttttctcttatgagtaaaatgcacacacttcaaaaataaagtttatgacatctattttgattgctctaggaactatattatttatttccttgctcttagctatggccttcttgttgaagttgctgaatccattacctcaaaacctaacacttagcataaataaggtgttagtgtacttggatcaaatgacagcaaaattctgggtatgcttagctttatttgttccacgaagaatgacactgaagtacatgaaactgctgcctcctcacgtgaagttgttttacagggttacagatactgggctggcatcggcgtcctccagagttgtgaatctgccctgactcactatcgtcttgttgccaatcatggtatctatgtttccccttttaccttttaggaaaaaaaaataaatggaattaactttaaacatttctatttttattgttctatttgaagtattataaatggctcttttatgtggactcatctttaaactagttgaggttcagaagtacttttttctttatataattttgctttaggttctatttacgttgtgaaaaaagttcaatttattaatagattactgatttgcgatctatatagactactgtaaaaacagcttcctttaacaatgtgttcgtcaacgtttggcagctggaattgtacttctctctctctggaacaattcttctgattttcctccaccttattgttttatccctctatttcagttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggtacgtgtttgaacatctcaccaaatatctttactgcattgtatattttaatctgtgggggacgggagcaagcacttatatctgtaagttacattttcattgccctgagcaattatgaactacatattagaatcacctgagccccttaaaaaaaaaaaccaagagtctcacactctcaggagattccatttgggttagtgtgggatggggcctaggcattgagggttcctaaaactgtccaggtgactctcccgtgtactgcccctaaaaaaatcactgcttgaacagagcagcattaacaccgatgatgaaggctgttactggagtcaccaatgatgaaaactgtcactttctctaaacaagaagtccctggaatatttgcaatatcagatgctcttcagagctatttaccattcgtgtttctttggctcatctaaaatcataatttcttcaaggtcaagaacagaagtaagctcgtttaatggaagttgtataatgtccgtcaaagtaccatgtgtgcacacacaggtttcgtggcttcttttgatattaaaataaaaagaactttaacatttatatttttttccactaagtttgcaattatttctaatttaggacatgtacagatgagcattagatacttattaagaacagttggttttaagactagcagtggagtcttaaggaaaaaaaaacgtagtgaaacgtagatctaaatgttagctgatagaaattataataaacttgttcaattaaacatcttatttttacattattgtaaaatttagtttacttaaaattttctgttttacttgctttctgtgtatcttgcttgttgtgtttactcttctctcctttcttgcccttttttggttgagtgctttttcctgttgcatctcttcccctctgccagcatgatgctactcttgtagtggttatctagcgatcacaacatgcatccttgacttaccaaagtctggtacgatgagcacttttaccatttccaggacagcacagagatctcagagtattctgtgtgtgtttgattttatatattttggtaccatgagatactgttgttttgtacagtccatattaatttacatttattttcaaatttaccttttcattgctttttatttatttttttattttttattttttgagacagatccttgctctgttgcccagtgccactatctcagctcgctgcaacctccgcttcccgggttcaagcgattcttgtgccttaacctccccaagtagctgggaatgcaggcatgcaccaccacacccagctaatttttgtatttttagtggagatggagtttcaccatgttggccaggctgatcttgaactcctggtctaagtgatcccacccacctcagcctcccaaaggctgggattacaggcattagccaccacacctagccagctctttatttcttactgtatctcccagcttctagtaagtttccttttttctgaagagcacccatttgtgtttcctttagagcaggttcactggggacaaattcagttttttttttgtttttgtttttgttttttgagacggagtctcgctctcgcccaggctggagtgcagtggtgcaatctcggctcactgcaagccccgcctcccaggttcatgccattctcctgcctcagcctcccgagtagctgggactacaggcacccgctaccatgcccggctaatttttttgtatttttagtagagacagggtttcaccatgttatccaggatggtctcaatctcctgacctcgtgatctgcccgcctcggcctcccaaagtgctgggattacaggcgtgaggcaccgcgcccggcccaaattcagttttaatttatgtgaaaatgcctttatttcacttccactttagcaggatactttgtgtttttgttttttgttttgtttattcatttgtttgttttttaagacaaagtcttgctctgtcacccaggatggagtgcagtggcacgatctcggcacaccttaacctctgcctcccaggttcaagcaattctcctgcctcacctaccaagtatttgggattacagatgtccatcaccacacccagctaatttttgtatttttagtagagatgggatttcaccatgttagccaggctggtcttgaactcctgaccttagatgatccacccacctcagcttccaaaagtgctgggattacaggcatgagcccatcgtgcctagcccgttttttgtttttttgagaaaacatctctctctgtcgcccaggctggagtgcagcagcacaatcacagctcactgcagcctcgacctctccaggctcaggtgatcctcccacctcagcctctcaagtagcagggactacaggcgtatgctaccacgcccggctaatttttctatttttttgtggagacaggattttgcgatgttgcccaagttgttcttcaactcctgggctcaagtgattcacccatgacctcccaaagtgttgaggttacaggcgtgagccaccgcacctggccgcaaatggtactttgcaattacaagtacacgtttttacttttcaaaatttttaggttaattaaagtagaatagcattttcaggagttaagactaaatctttttgttttttgagtcatgaacagaagccattttacgaccaaatcatttcttgttggtctgattttaattgtgtgccagatggtaccacttacttttgccttgtttgtgatcattttcaggttggtcttggacaactgcacctgcacggagggcgtggagtagaacagaatcatcaggtaactaccctgttcctagggctttgcatctcagttttagcaggaaatgatgttcccaatgtatttcttgctaagtcaataccagtatcaaacttctgtcatttaaacacccatcacaaatgagctttcaagatgtaaccaacccctaagaaagctgaagaatacaaatattagtacctactatgtgccattcactgctaggcattcaccatgcaatattggacaaaatagttttggtctttgaccttttggagctttaactttaataggagtattagatattttttaaatgatcacaccaaatataaattgtggttattcttacaaaggagatttaaaagatacaataattggttaatgggtaggaggtaccgcttgccagggaagacttctgtaaagagaagtagaaaacatttaagttgaccctggagataaggtccttccaggccaaaaagaacggtatgtgcataggcccagagacaggaaggaatatggctagtctgcccatactacaggaatatgactggtctgcccatagtacatgaaacagaactgagattaagcagtgcctgatcacatcagcatatccctgcagcacttcaaggagctacaaagatcagcatgttcagatttgaaaacaatggctttggctgcagtatagaaagtgaattagaagaccccaagaataaaatcaggcagatcagggaggggaatattcgagaagttcaggtgagagagaatgtggcttggactagaactacggtaaaggaagatagtagtggattcaagatgtatttggtggtaaatgtaacaggccttagggatggatgggatataagtgaaggggagctgatatcttaagcaaccagtaagatggtattgccatttgcttaaattgagttgctggaggagaagcaagttgaggtcaagaagagaagattttagggatatgttcaggcattggatagtgtgttcagaggtagtcgaatagactggattgaagctgaaaatataaatttaggagttgccatcatctcgatggtgtgtgaatctatgggaatagatgagattgcttagagaatgcaaagtgagaatggagtccaaaactgagccctgaagaactttaatgttcagaagtcaactgatagaaaaataaccagcaaaggagacttaggtggtacaggtagacttaggatggaaaccaggagagtgtgacatcttgttagccaagctaagagtctgtcgagaaggaagccatgatggactctgccaaatgttgcagagaaaggtggagtgaggtgagctgaaatttagattggcagtatgaagatcatcactggccttgatgagctgtctttttgatgtagtgtatggaagccaattaagactagattgcagagtgaattgaagtgcatgtcaccaatttattcgagaagcttggctgtgaaggaaagtagctaacagaacagtcatcattggagagaaattgggggtctaaaggagatacatatcttgtgtgttttggtttgagttttattttttatttattttatttatttatttatttattttgagacagggttcactctgttacccaagctggagtgcagtggcgcagtctcggctcactgcaacctccacctcctgggttcaagcaattgtcctgcgtcagcctcctgagtagctgggaatacaggtgcatgccaccatgtcaggctaatttttgtatttttagtagagacggagtttcactatattggccaggctggtctcgaactcctgacctcaagtgattcgcccgtcttggcctcccaaagtgcagggattacaggtgagagccaccgtgccctgctgagttttattttttgatgatgagattatagaatgtgattgagggggaactggttccaaaagagggagaagttaagtcagcaaggaaaataagaggaataaccaatggtacaaggtccttaacaaaaatgggctgcaatacagttgagagtggtgatgatgaatttctgctgatgctagtgtgtttacttaagtgatttttaagtagggtcaagaatttttctctaaacagtacaagaggaatgtattcctttagacaacaatgaaaatatgctccatgtcttggaaagacttctagtttttcctttctcccaggttatcattagagaaatagaccaaagaagtcaagctgctcttaaatgtcttttaagcaggctgatgttcgctttgcctgtaagtaacaggaggcttgttgtaccttacgtttaggcagcacaagaaatttctttgcatctataattatgcagatgacttaatgataaatggtactgttatttggtaaaataaaacttctagatgtactgatttctctttcaaaatattggcaactgggtattcttgtttttaaagcactgtaatataacaagattttttaaatgttcctgaaataattattttggctgaaagtcaaaagcagattctgttaaaaactaattattttaataaattcttttctcatagagagcatttgactacttcaatttagcagcaaatgctggcaattcacatgccatggcctttttgggaaaggtactgtacatcctgtgaatgttttatgtaatagcaagaggtgtttgcataattagcatgtattgtgttcaggatctacaatttaccaaaaataaattggaaataagatttctagtgcaagactattatatcttaaagtgctgttctgaggcattttcttaggcaacttaaatataacatagtgtttgcagccaggcgcggtggctcacgcctgtaatcccagcactttgggaggctgaggcaggtggatcaggaggtcaggagatggagaccatcctggctaacacggtgaaaccccatctgtactaaaaatacaaaaaattagccgggtgtggtggtgggcgcctgtagtcccagctacgtgggaggctgaggcttacagtaagtcgagaccacgccactgcactccagcctgggcgacagagcaagactccatctaaaaaaaaaaaaatagtgtttgctcatcagtatgttaattcttcattgaaattagctctcactgagctcttactttttgtgtattgtatgcaataatgaggaatgtattcttgatgctgtgcggttttttgctaagactctcacagttgtctgtttccttccatgctgaatagaggcaattagagtttgttgaaatttatctgcagagtttttaattgtcttaaatgtgatagccatgacccacctcttctcattgtagctgtgttctcaatcaagggaacagaacatttaagtctagaaactttataaataaattccatatgtcatggaagaatctcaaaactttttcattattttgaaacatagtataaatcaatgggtattttcacttataactaaatcctaaagtaaggaagtttagatggaatatatcacaaaggtttttacaatagggaaatttcatcatgatttgcctcatgatcatactagtaattggggtgtggtaactacatttaaatattccagctgttccatagcatagaacttggtatttccctctgtttttgttaagcatttaagaacgtttcattcctcctcttttggttcttgctctgaattactgtcattgtctttaaaaactattttttacatttattgtttctttaacatatatgtgaataaagacagtcttgaccattctgtttttctttctcttggccctttatcattctccatacctgatgctctaattgtttagtgtttaaaccctcttcaagtaaaccttttagttacttcgtttcctgaacttaagacccacttgtgatcttatcctggggaaagtagtggtagaggagaaagaagaatgaatgccgcaagcagcttcccctttccttgttgaatcactgatctgatcctaagcaacttactaaccatttgacttccctggaatagagtgagaaaaatgattcatgttgggcttaaagatttcttctgagactaatatatgagctgattttatgtattcatgtttataaataagtcataaatttgagatggcaacagagtatataattactaaaatgtttgcttttaagagtttgcttttaattcttttgttttttttgtttgtttgttttgttttgatatgaggtcttgctttgtggcccagtctggagtgaagtagcaagctgtcagttcactgcagctgcagcctcctgggcccaagcaattctgctgcctcagcctcctgagtagctgggattacaggcacacgccaccacgcctggctaatttttgtatttttagtagagacagggttttgccatattggccaggctggtcttgaactcctgacatcgggtgatccacccaccttggcctcccaaagtgctgggattacaggcatgagccactgtacccggcctttgcttttaattctaaaatatcctgtggggaattctaaattttttggaaagatttaatgagatctgacaaaactcaaaggagatgagaaaggagaaaaatgtaattggagagagggttacagctcttactgaaattgggatctgttttccagatgtattcggaaggaagtgacattgtacctcagagtaatgagacagctctccactactttaagaaagctgctgacatggtaaggctttgtctcagtgtactgaaatgtgtaccatattactaatattttaataaatgaatttgttatattaaagggttaatcataaccaactcatgctatacattattgaaactgcatattaagtatgattcatgtgaatgtattaattaaacaaagccctcccgataaaaggcaatttttttagggaccaagttgttgatttttaattgtgaagtttcactgagaagtttcctaatcggggaaatactgatttttagtaatggaacttgaacttatataatctaccctatttgtatcacaacatgaaatttaaaagcttacataatagggtacttttgataatcatagtacataatttaggctttctttggctcagaaaactgcatatgagtacctgaaatcttgtatgtcttcagtatgtacacttacctctctgtcaactattatacatgttactgtagttccagatgtcacttgaatgcttcccaaaggaatgctatgacaatctttttaaagatgtcttctgtccctctgagtttaggcaaattctagatttttttctttctagtcccaaaacagtgattttctttgttccatgacactccaataatcctaagtatatctttgtcacctgatagcagcattgctattattacatgattatgctattattacaaggtgttccatgatatcctccctctttattggagtgggatgttaccagtgaaaaactgcaaaaatgtgacctgcctttcattttgatgaaatacattagtcatgctttatgtcataaattcatggtacagatggtcataaagtaagtcaacaaaatgtaattctaaatgaatttactatttactctttttcagcaaattacccaaagcccccagatgtctaaaagtcaatattatgtttagtctgatgagaagaagaaagttttgttttgaattgaaaagtactaagacatgtttttgaatatgcttataaatgatttattttgcagttatttattcttgcctatttttgaatgaattcttttcactcttttgtctgatttctctgctttgcagggcaacccagttggacagagtgggcttggaatggcctacctctatgggagaggagttcaagttgtaagtgttcagtctgacattctctctttaatgagcagtcagctggagaggtagggacatgttccttaattagcttccagtcagcccaggtggggctgttccattgtaagcaaagctgaacctctttctgttgtctgagtttgtctcactaccaccccatacccgacagacaccatctcaactgtcttagaacagctctgtgtctggcactttctcccagaggtatggagttgtttcttgttcttccatctctgctctctaccccacgtcctctaaccatctctcaggacttaaacatctccttgcctgcttttttactcaatcctgacaaaatgcataactgccttccattgaggaggaggaaagctttctgttctgccctttaccccttctagctaccacctgtcttctcccagcccttcactcagagtcaaactaagctgctgtcattcactcttgagttcttagcaatcgaacttctgcttcatggaactatactctctgtacagatcaccagtaacctcctaaatgtcggtccaattgacattttttggttctacctcacttgacctctcgcttccctggtgttctgtctgtgtctgggtttccttggccattgcatctcatccttctgtgcagcctcctcatgttggatgtccctggattcacgttgcagtttccttctctatttgatctttccaagtaatatgtgcttttaatttgaggctgaaactaagagctaggtttaagagctaggtttttaatatctataggtattctctaacacaaaagacagtaatgtgttctcattttgcggccttctagtcattctaggacactaaaattcagtagtaacctttattttaacttttcttcttggatacatatgacctttgaagtataatagtcatagtgtttggtaaggtacacggaataaatgaataaggagataattttctttctttaattttaggaaaattgaggtttaaaaagggttgattggttagcagagaagattgactgtttcttaattcctggtctgatgttctactagtttttatgctttctgagagcagcatacaaattgtttcacaaaaactctatttacttttcttcaccaccttaaatattaatccccctatgacttaatgtatattattatctattataagaattagaaagtggtctttttaatggctctttgggaatatttttttatatgctttgttcatttttttaaataaatctcttaacttttgagtatgtctgccttttgagctttctcatcatatgacatctttttctacagaattatgatctagcccttaagtatttccagaaagctgctgaacaaggctgggtggatgggcagctacagcttggttccatgtactatagtaagtaacactggaattaatgatggatacaccaagatctaaattaagctgttttctactagatggcattatgatgtggaaatgggtgctatcaaattctggctggttaaatgttctcccagttcaatgatttgtacatcttgtttttcattgtaaattatattaatctgtatcagtgtgttagcttgtattagattcacatatttactcagtaagaattctttcattagagttttattcttcatatataagccttctctgatacttagctaaatcttaagtctattatctcgtgtgatttttttttttcttacagatggcattggagtcaagagagattataaacaggccttgaagtattttaatttagcttctcagggaggccatatcttggctttctataacctagctcagatgcatgccagtggcaccggcgtgatgcgatcatgtcacactgcagtggaggtaaggtctttcctaccagcttgtgtgtagggagttgatttgcccagcaggaaagtctgcgctttcaattctggtttttttgtatgttttcttctgtagttctagactcagcctacctagctttgatatactgagggaagaccgaggggtctgtgtgtaattaccatacttatttattcagtgtctccctattacaatcaactgtataaggggagatactggtgtctgcagtatctctagcacctaagacagtatctgataataatcagcatcaaaaaaatatataagctgagcacaatggcacgtgcctatagtcccagctacttaggaggttgaggtggatgaaggcttgagcccaggagtttgagaccaacctggacaacatagaaagaacctatctcttaaaaaaaaaaaaaaaagaaagaaagaaaaagaagttgaatgaatgttccaaaaaggaatgctaatatctcctaattggaaattgtctcttagctctctcttagacttggcactttagagtgacattgataaatgcttagcaaagtttctaaatctctgtgctttagtttactcacttgtcaaatggggcttttaacaggacttacctcctagggtggttcctcatgaatctcatgggaagattaagaatggtaatatacataaatcattacaacagtgcccgggcagagtaaatggtcatttttgtagtacaataattgtgtactgttttttttttttataaacctgttgacttctaaagagtaagtgaaaactttaaataagtatctcaaacttttatgtctgttcaagaaagctgccagaaattgaaggagcaagcttaatagtcatgtgtaaccaaagtgcataagtgattttctggtatatctttcttattttcttctactgatattttttttccccacctcacacagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagtaaggttcattttagtcctgccttaggtttagaatgtacgagttcacaccagtaaactgtttaatgtattcaaaaagaaaagctactaggaaacattctttattattgtaactggaactgaacacacaggcttaagttattaatattttactttagccatcaaagttagttttataacgagttgactgtagaaatggatttgacattcattttaaaattaagcactttgcataaatgtatttttcaaaatacagtggatacaaaaatgccattttcccaacactgtagaagagtgactcagtagtctcatgactggttctatagatacaacatgtttcacaaagtagtgccctcttgcatccagtgattgctttgaactcactattttagttcagtaattaatttcagtatttgttttaatttttatatcctaattcttgtttaacttatgcttcacctatccttcctactttgcaaatgaaaattaagtctagtgccttttcttaaatgcctgatttgtatttcatttcttttcctgtaggagaagcaagcattgtaggtgagaatgaaacttatcccagagctttgctacattggaacagggccgcctctcaaggtaagtgattaattctaagataagagtttcacccagggacctccctatgttgtttatctcccatgaacattaaatcatgaagccgagtactgtggctcacgcctgtaaccctagcactttcggaagccaaggcaggaggatcacttgaggtcaggagttcgaaaccgaaaccagcctggccagcatagtaaaaccctgtctctactaaaaaaaaaaaaaacaaaaaaaattagctgggcatggtggcaggctcctgtaatcccagctactcaggaggctgaggcaggagaatcgcttgaacctgggaggcagaggttacagtgagccaagattatgccactgcactccagcctgggcgacagagcgagactccttctcaaaacaataaaataattaattaagcagagatactgtgacttaatttgtttgcatattattggtatttattcttaacagaagtttctagagccagagtttctaaattgggttgtaaagtctttgtactacacatttccatcaagctatgattcactctttgttttccagtttgaggccagtatactgtgtgaaatgggaattaaatagaatgtatgatagaacattagtctgaaacctaagagacttttctttttcttttgaatatttattttttatacatgttcctttcaacattctctgcctgttcccttctccaaacctaaatggtcaagctggactattttaaaatgtaaatgacattataaagtagagcctgatcatttacataggagtgtttgtgaaagaagggagtacaggttgagtatcccttatctgaaatgcttaggaccagagtgtttcagatttcagatgtttttgttttttttgtttgtgtttggcatatttgcacatacgtattgtttgagcatccttaatctgaaatctgaaatgctcctgtgagcgtttcctttgagcatgacctttgaatgtcatttcaggttttggagcatttcagatttcagctttttgaattagggatattaaacctgtccccctacacacacaccaacttggttttacctctctgtattccaaagccttctgcagaagagctacacttctagtttaaatttttactggactttataacttggctgaaaggatttgttacaaagtttgtgtactatgaattaaaattctttgttttatgtaagcatgtcaatgggaggagaaaaaagtttgatctgttttaaacatactttatttattggcagttctgcatttaacttttgtttaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggtgagtgtggcttccaaacacgtttgaatcacataattgtgattggggaaaatacttgcatttgtatagaaaatagactttccttgacattcagttggatttcaggccactaaattatgggactgatttgtaatatttcagaagactgcccttccatctctcatcttccagcacgcacagatactgctatccacgctgttttatttagggattaagctgaagacagactcatgaaaatggaagtgcagtgcttcctctgctgataactacttgtttgagaaactatctgtccatcgtcagccaaattctatttttttcaaattattttgaaatgaattaaatgtattctactgataaatttatttctgattcttacacttgcctaatgaagtctgtcattctctggactcatgacttaaggtttttcctgtgtgccctcaaaagaatttggaaaaactacagacccccttgtacatttttaagttggcatttaaattttttcttaagtttcaaagggtctaagttccagctattttaagcattaacatttttaaataaaattaattacccttaaaatatccaatagaatctaaataacaataatttaatacccacttaccattattaattttttagaaatatacaagcaagttttttaattgaaagctaggtcttttcctgtttccctaaatttatgttttctaccacgacttctgtagaatgtaatactaatgtattgtttttaatgcttaggtcttttattgattactgtatcatacttacctgaaacaaacaagtgtataaattcattttgaattttattaccagtgatctaagtgttaagaaaaattcatgagatattactagtcacagttggtcagttaatgcattgttgatcaaatctacaaaatacattttgataaaactttgctttttgtattattaattgaaaatgcatcttttaatgagataaatggagtatttgttaaaaattgagatttcacattaattctgtttttcatttttttaaatgtatgactagaatgtcatgtatgtgaaaatgggaagaatttcactatagcatggtcacttaattcttcaaactaccttaagagttagatgccaaaaatcagagtgacttgtcattagaaattatttttaatgatcaatctcctgactacttgataggtccctcttcagttgtgttgaaagcaaagaattggaaaccagagacttgtgaaagcatgcattccctgacactgggacctttcacttttcttattttctaggaagagtacaaaaggctttaccaagacttatgaaataggctgttaattatactccttcctgtgtcacttagaggccctttgttgacctaaggattgagggaaagttgttcatttttgctaatgcggtattttcttgacaaaatgctgctgctttgttcacatttggacattttcttttaatttcagtatgtaaatatttatattttaaacttaccttaatacttagaatattactaatattagatacttaaatatagttcagtcaaggctcaggagcagcaaactcagtacattcaacttctggaagatctctgccacttaatgtagtaactgaagcttctctttattgtcaaaccagtcatccagtgtcccaaattagacttagcttctatcagaaaggctgacggatttttgtcgttttttttaaatggagatggggtaccactatgttgcttaggcttgtctcaaacccctggggacttaagcgccttggcctccaaaagtgctgggattgcaggtatgagcccctgcacccagctgactttatttttaattcaagtgaagtttaacatgactaatataaagatcacatgtaagttatggctttcatggagtacatctagtaataatttactgactgtagtcaaaattaaaatgatataactaatctgtttttataatagcttataaaacaagaaaatgtgttctaatttaatttgtaatacactgtatagctaataatagaaattcttgtgaataaagaatatgataaaaggcatagtactcctttgataagagtagggggagggaacttttgtttagcttttgagaataaataatcatttatgaaaataaataatcatgtatgaaaatcagtaactccattactttttttttttttcggtgagatggagtctcactctgttgcccaggctggagtgcagtggcacaatcttggctctctgcaacctccgccctctgggttcaagcgattctcctgcctcagcctcccgagtagctgggattacaggcgcctgccaccacgcccggctaatttttgtatttttagtagagacggggtttcaccatcttggccaggctggtcttgaactcctgacctcatgagccacctgcctcggtctcccaaagtgctgggattacaggcgtgagccactgcacgcggtcccattactttttttataagacatcgtgatcaccttttctactttttttcttttgaggtttaaaatattcatgctactaaaaacaatcccccatttaatatagttaggaaaatattaaatatgaggattgactataattggaaaaaatcatcatattatttgataagttttaattacatactagtgaatctatttaattaccctagtgaatcatccaatgtatgaatcacatgaagtttgatccatgatcttgaaaaatatagcagtcgaaaaaaccatttgagttatatttttctaaaaactcagacactaaccatactgttagcattatttgaagatgctcttctttttaaataatgacacaccctaaggacaagaataaggaatagctgaaaataactgcttgtatttaaatatgtttggagggggagtcatttttggtctttaacctttcttcctcatatctcatggaattctttcttaagagtttggtattctttgataatagggagtagaagtgagatttttaagtgaaaattcccaccatcccattctattacatatctgaattcagaacactccagcctgggccaaaattaagaatgcctggtttcaccctttacagaaatatatctaacacagggaaacacaagatgccctaataagggtttataattagtcaataaaggagccttctccagaaccagtatttcaaggtatctcttccggtggtagcccctgaggtttctacaccccagggcaatgcacttgaggaaagagtggggtagatctcttccggtggtagcccctgaggtttttacaccccaagacaatgcactggaggaaagagtggggtagataagggctgtgccttcctttagcaaagcgaagcagagaaacgttgctgtgcatacaggcctattctcagcagatccctttcaggaaaaagcacatatggaagctgcagaactgcagaatcgagtcccttaacatgtccatgcaagtacctcttgtaaaatctgtttctttttttggaaacagggtctcactctgtcacccaggctagagttcagtggcaccatctcagctcactgcaacctctgcctcctgggttcaagcagtcctcccactcagcctcccaagtagctgggactacaggcaggcgccaccacacccagctaatttggcttattttttgtagagacagtttatgttgcccaggttggtcttgaactcctggcctcaagtgatcctcctgcctcgctctcccaaagtgttgggattataagaatgagcccactttgggaggctgaggcgggcggattacgaggtcaggagatcgagaccatcctggcgaacacggtgaaaccccgtctctactaaaaatacaaaaaattagccgggcgaggtggcaggcacctgtagtcccagctactcgggaagctgaggcaggagaatggcgtgaaccctggggggcggagcctgcagtgagccgagatcgcgccactgcactccagcctgggtgacagcaagactctgtctcaaaaaaaaaataaaaaagaatgagccaccgtgcctgtcatctgttgtaaaatcttgagtgtttctaccccactttgaagatcactgtccagaactgaaaccagacgttgctaatactgattgaagttttaagtagcaaaaaattagtgtgagtttcagaagtcgcccttggaaatctctaggttaacagtgttaatgcatagatatatggctgtatgcagcatatctacacagcaaattagatgttatgttgggggaaaatgagttttttaattaagtttttcaatattaagcagttagataattaaacgaattttacccaagtaaagcttggcatttttgtttaggtgagggaaactcattttaaaatgaaaacctcaaaggtaaaataaattcgtctaatatgttcactaaatatttttacttattttgacaagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtcccttaaaaagaaaaggaaaaaaaaaagaagaatctgagaacctccccaggttgttgtacttcagattcttccgatagtgaagcattaagttgaaaacaccacccaaattttcttctctaaaaatagcgtgaattatttaaataggctaatggaagaacctatataggaagtgggttacccattttcttcaaaattaccaactttagttggcaatactggtatgtaggtactcttgggttctgccagctttatattttgtttccagtactatagttcctagaatggattaactggtagagcatttcactctgaaagccctaagatgttcagagcccttgtttctaacataggcttattcaggacaaggaaagtttcttcaggaccagaaaaggatgatgtttcacccttttgttaatgtctttcagttttagattcaagaatgggctttccctcatgtgtgtcacaggtataaatgtagtccatgctgctccagcatcagtgaaaagaaatggacttgtctagtccatgcagctgaagtcctccacagatagggttccagagcactggtcttgtgggactctggcctcccagtcgcttccacatgtgtaatgtcagttgctataattgcatggtagcatgagtcaggtgtgctgtaaccgctgccaattgaaacaatctttgttcctttaattaaaagctgatcgtgtggcagcctcctctttctctttcagtaccatttcagacctttatctctcacaatttttattactaactgttggttatagtctaggacttcatcttataatatgctgtactgggtatattgtatctttgctgttttttttaatacagaagtataaagaagacagtaaaaacgccccataatcctaccacctagttattccaactaaaaagaaaaagagagtataagactaataagtatcgatcataagaaagtcaaacagtacagaagaacacaaatctcccatcccagattcttccccagagaacacaattagtggtttcttgtcattttttttccagaaaaatttagcacctgtacctacaaacgtgttatagagatctttcaaatgtaattttatataaaattataccccatgtttactttcttaatgggtaagtataataaaagtcagaaagtatcagtgatactaaaacaattaaaatattataggctaagaacataactttcaggtttcaattcagatgttaaatattttgtgttttagttaaatcctaattgagaagcattattcattcagctattaaatgtttgaattcctgctattttcaattacatgggaattgtgaaatggccccactgtcatggaacagagctttccagctggtgtgctgtcactgccagtaggttcgctgtgccaagatactaatttctccccttggctcaccactgtttttttcttttttctttcctgagacagagtcttgctctgtcgcccaggctggagtgcagtggcacagtctcggctcaccgcaacctccacctcctgggttcaggcaattcttgtgcctcagcctccagaatagctgggattacatgcacccgccaccatgcctggttaatttttgtatttttagtagagatgggatttcaccgtgttggccaggctggtcttgaactcctggcctcaagtgatacactcacctcggcctcccaaagtgctgggattacaaggcctgagcccccgcgcctggccccagtgttgttttgttttgttttgttttccaaatattttctgtgaaaaatgattaaaattagcgtattggattactggtggaaagaacactgtcagacattttatattaagtgtcagctattataaattagtagcttaattcctcagacacattattttgagcttcagttgaaggcttttaaaaccgctttaaacacacacacacacacacacacacacacacacattgcaaaacgtttttaaaacaaattattttaatttctgtacttacttctggtgatgtaactttcccagttccttgcctgacattttagtgataataatggtttctatattattttcattaagattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgtatgctgtaatataccacaaccaagcacctttccagacagactttttttaagctgaatgattcaattttttaatgttttttggaaattcagaagcttctgaaaacattcacttgtggcaatttgaatttatctttcattttaaactcctgaaattcagatttttacaagtccaatattgccctagggagaacatgaatttgctaagaaatgttatcttttaaatctctgatatctttgtcttgaagcagccttgatatgtagtaagcgtgattcactttagcctgattataatattatttatctaaagtttgtttatgcattgccttgtcccaggaattttttaagaggacttgcagagacacgtaccacacagtaacatttagactaaatatgctctgagtaaaggagaaatgaaaaaatattaaatcaagagtgaacatgtacacaaagtgcaattggaagtgggctacaaatttggcccccagcttcccagcaggcaactcaaagaggtaactgaggtaaaatgttccagctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctc

SEQ ID NO: 36063 - DNA, 62289 bp, Homo sapiens; identical to SEQ ID NO: 36062

SEQ ID NO: 36064 - DNA, 21165 bp, Homo sapiens
gttgctgcggagccaggaggggaagcgatggctgggcccgcgtggatctctaaggtgagcgctggcaggccggcgtgtggcaggcaggcaggccgcgagggctggcaggagagccggtcgcgtgccgggtgtgggcgggcgcgtgggccagacagggaggcggtggctgcccgcggggacagcttgggagccggtcctggtcgcccgtgccccgcgctccgtggccggctcgcagtgtatgggccgccccgggccgggtcagcagcgcagaggcggggacggcgtcaaggtcaaggcgggggggcgccggccctgctcctgccgagacccggctgccgtcacccgcatccgcccaggccagagcccaggcttcgcgccgagcccgggaaggtcacgggagcctctgtcccggctccgccatccgggccgcttccccggctgcggccctgctgcgggactgatcccctcagcactgcccacacctctcatccgctgtctgcgcggcccttggccggggaaccgcaggtgccacgggcactggcgttgagcttgggaggttttcccaggtgagagaatccgggggcccttttccctatcagattgttttccctttggcgctcttcccagtcagacctctagtgctcttgtagctatttccccttcataggatagggcatcttacacctcggaattaccgtctgaaccttcggagagagagaccagcagagccttccttttacctttcattggtgggaatcctgcaatctggagcgctttagctctccttgacagctcagatgccagagctggaaagggtttcagatcatctatgcagttccgtagcttctcagtggaactaacctgtgcctgaagaagaatttgctcaaggtcacacaggaggtcggtgtcagagcagggagaggaacctaggtgtcttggttcccatttcccaaggtcacatagcaaatgatggtacaggccatcaggcctcaagtctcctgttgctatgaaagggtggtcccctagaaatctataaacaatttaacgtttttctgtaagtttgatactacttttctcccattttttcggtttaaagagaggtccagagatgcactgttatttaaggaaaagatctctgtactggaatttaggagtctcagatttaaatcctagcaatgccactgattggctgtgtgaccctaagcaaattactaaacatctctaagccttaatatgcccatctgtgaatatctatacttacatcacagaattgtttgagtattaaataaaataatgtatgtgaaagcacttggtatgtacagaaggaaaacaaaaatctgaagctttcttatcaatatgtttatctgtctccaacagacagtggttttcatgggcatcattaactggtttttttgttcaataactagattctactttgtcaccctcttcagacccagatttgcttgtgatgataactcttatgtcacatttgctcctaaaagtaaagcaacttctgtgtcactgtgaaaactgaactcagtcctttaatctctgaacttacatttaacacccaattcatctttggtaggtacatttgccttcacagtgaggcactaaagcaacacttgataatgattgtgctggtaaatctgttttgcctttagtgtgatctgcatgaaaaaaccctcatagtaggtattcagaaagtgttgggttgtggagtcagaagatgaggttctctgacatgcactccctgtgtgacctttggcagagtcatttgacttctgggccagcttctcactttagggattggagcagaaggtggctcagaggctgaccccaggatggtggaggtgctgagctggatgccggtttcaatcaggacagttcctctgttgagtttccatttcaggttgtggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtaacagcaagactctgtctcaaaaaaaaaaaagattttttttttaaaacccatctcagaacccatgtacaacactatttacatgtttttaagttaaaaaggaaatgagttgtggattaagatggcccacgacctgaagtccaaagttcagggttttggtccaggcttcatgaacctggcctcagtttcctcatctgaaaagtgccaataatgcctatctctacaggttttatataaataaaatgatgtgagatatatatatatatatgcatatgagtattctataaagtagaagtcctgccatctcagccttccatgaagctgggactactggtgtgtgccaccatacctggctaacatttaaaattttttttgtagaggtagggtctcactctgttgtctaggctgattggtcaggtcttctgtcacagagacataagctagttttgtgtgaatgtcttttccctcttttttgggctgggagaggagaaaggactcatgtcaattttttttttttttttttttttttttgagacagagttttgctcctgttgcccaggctggagtggaatggtgagatcttggctcactgcaacctccacctcctgggttcaagcgattctcctgcctgagcctcccaagtagctgggattacaggcacccaccatcacacccagctgatttttgtatttttattagagacagggtttcaccatgttggccaggctggtcttgaaccctgacctcaggtgatccaccggcctcagcctcccaaagtgctgggattacaagcgtgaggcactgcgcccggccttttttttttttttttttttgagatggagttttgctcttgtcacccaggctagagtgcaatggcgcgatcttggctcaccgcaacctctgcctcctgggttcaagtgattctcctccctcagcctcctgaatagctgggattacaggcatgtgccaccacgcctggctaattttgtatttttagtagagacagggtttctccatgttagtcaggctggtcttgaactcctgacctcaggtgatttgcctgcctcagcctcccaaagtgctgggattacaggcgtgagccaccgcatccggcctcatgtcacttttatgctctgcttgtcacgaagtaacctttaaatggtgctttggaaaattttattttacttaaagttctgggtcattgtgatgacttaggtgcagtactgctttattctaagatcatgcaagagagatgacaaacatggaaaagactggtccttaaagaagatcattgcaagtattaaggctacttgttggcttggaaactcttcagatagagatgtgactgaggctggactcagttttgtttgattgttgttttgtttttttttaaattattgaataccttctatgagccagggactgttctagacactagatacaacagtgaacaaaacacaaatccttacactcctgggtttacattgctgcccccagcatatgcaggtaggatgggtttacattttaaaatcagttgtttgagtcgggtctttttcattctttctttctttttttcttttttttgtccattacctaggctggagtgcagtggcataatcatagctcacagaagcctcaagctcctgggctcaagcagtcctgagctcaagccgacttagcctcccatgtagctgagaccattggtgtgcaccaccatacctggctaattttgtagagacagggtctcactttgttgcacagcctggttggttgggtcttctgtcacaaggacatgagttttgtgtgaatgtcttttccttcttttttgttcagggagaggagaaaggacacatgtcaattttcttgtcacaaagtagcctttaaatggcctcccttccaatagcccactcgctggtggatgaatcatgccctaggattaacattttggccaatggttttggcattcttttggatttggcccagtcttattttcaatgcagagtcatgactatagataccagaagattagagaataaaattcattcatacctttcttggctgttggttgttaccaataaatatttcagcaaaggttcagaccccagaaaaaaacatcaagataggatataacaaatgtgtctttgctcatgtatctagcaggagaaaaagttactttttaaaaaatttaatgcagccgggtgtggtggctcatgcctgtaatcccagcactttgggtgtccaaggcaggtggatcacctgaggtcaggagtttgagaccagccgggccaacatggagaaaccctgtctctactaaaaatacaacaagattagccgggcatggtggtgcatccctgtaatcccagctactttcaggaggctgaggcaaacccaggaggtggtggttgcagtgagccgagattgcaccattgcactccagcctgggcaacaagagtgaaactctgtctcaaaaaaaaaaaaatttaatgcattttaatacctttggtctatgtacccagtttctttttttatattgtttataataatgtagtatgactttgtaccagttctcaaggactaagttattaaagtttataataaacctttaaaatttatatttctggcatatgatgttaattggagagagaaaaaaaaaaaaaaacacgtaccagtggtaatatcttggtgtggtgggattactgggtaacttttattttatattttgtatcttttcctagtcccagcaaactgacagtaatgaccacattacctatattatcagaagaagcagtaatttatttaaaatctttattctgtatggcatgggcatcagatggtattaaataaactttcttagattttactataaagtgtaatttcttaatattcacagaatagatataatgtataattgaaggagcactggaccaggagtcagaagacctgtatgtgggtttccattttgccaattattcgctgtgtgaccttaggcaaatgcttttctttgggaccagcatctccgcttatgaaataagcaagttgccaggtgtcgtggtgcacacctgtaatcccacctactcaggaggctgaggcaagagggtcacttgagcccaggagttggagactgcagtgagttatgattgtgcctttgaatagtcactgcactccatcctgggcaacctagggagaccccatctcaaaaagcctaaaacaacaacaagaaataagtgagttgtgctctggatttcatgaggaacatcctggctctaaaattaatggtaattttcttagaatatatgttacccctaaattgaccgaatggtcaagaatgttggcacaaaatgatccactcatctgagaagaatctgtatgttgagctgaaaaagtagttttattctaccttcaacatcttttatttgacaacttatattcgttaaattgactttgaaaatatacagtactcaatctaaagtaaaaatctgagtatttaggctttcaaatctgagatagcttgccacattgagctaatacatgagatttgtattcctgggaagctactgaatatatctgtgccaagttgcagcattaccatccatcaggacttcctcgctcttgtttactgtatgtggtttaattctgtgtgtgatatttctctgttgatattaatataggtctctcggctgctgggggcattccacaacccaaaacaggtgaccagaggttttactggtggtgtgagtataattatgtcttttattttttccttttagaagtttctcaagaaagatgctctaacatatttattatatagcattttatctccattcatttagaatttgggaaaattggccatatttataatgtatgttgaaattactggctgacatgcacaaatctgttaggttacttgcgcatttgaaagaattatcttacagctggctatgtaagtttgtcacattaatatcttgagggagccttgttaaaaatagaaagtacccttgagcctgttattttatttcacaatctcattttggtgagacagcttttttcaaaactagtacaagttgagagaaaattgttgagaagcttcaaaacctgctttgcatttttattttatgggcttccctaaacccagtagattgagtgccaattaggaatgcctcgaacatctataagccttgtaggcttatacttgccttatataggctttgtagactatcacagtagtagatcatctattgttcattaaatctgctgcttttagaattcccagcatcagaattctgtgctttaaaagctgataccacatttttggaacattctaagactgtgggtcagtgacttcctatttgttttgatccccgccccgccttttatggaatctgatttggatttcataattcctatactcccatataacatctatgccgtgaaagatttataagaccatagtacattttttcctccatttactttctgtattgtggaagaaaagcagattttctggtgactggatgacatttattattacatgttgggagaacaggaagaagtagccaaagcgttcttttggctctgcttatgccaaaaatgcaggatggggcttgcacttcaagctcaaggatagccatgctagcatttcaaacgcattctgaaagctaataagatgatcattgctctctgctattatttaattttcaggctatttatttgaaaaaaaaattagcttgatggaggaggttatttttgaagaaataagaggatgtattaatttttttaaagacttcttcaacccgagaaaactggtatgagccttagccctggctaagactgaggtgggagatttgcttaaggccaggagttcgaggctgcagtgagctgtgatcacacctgtgagtagccactgtgctcctgcctggcaatgtagtgagtcctcatctctaaaaaataaaaattgaaaattagaaaaatgaaaaaaataaaaatgtttcttcagttgtacagaaactaatcagaaataattagtccacgtatctgggcagacatcattggaaggcaaaggaccaaggaaacttgaattagtgactttttaaaaatgcagttcaagcaactagaactgaaaaaaagccaagcccctaggtggggtaaagtcccaagataataaaatatgtggttcccaaatggaaaaagaggtgctgatcttctcccttacatatttttatttctgcatttgaaatgctggcttcgttttgcctgaagccttagaataaatcattgctgttacattataaaaacaataattgtcattctaagtgtgactcaggctttgcaggtatgatgacatatactattctttttggttgcagatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagtgagagaacattgttaattttttgttgttgttgtctttggtttaaaagatttgaattaattggtctctttgcagcttgtctgaaaagaaatatcaattaggaaatctacttggtagtttaatttattttcgttttatgtaaagagtatcatttggttctttttaaaacctctgaactcaggtaaagagtaggattgcagagtctctcctctgttgattcctgcctcccctttgatgacccccggggaggtatgtttgttttcttaacagcatttgaatcttcctgagacatctcataaagtggatttctctgtcaaaatattcttttttaagccttcaaaaacaaaaattcttactgtcttctttgatgatttcttatgttcaggttcagacagtaactttaattccaggagatggtattggcccagaaatttcagctgcagttatgaagatttttgatgctgccaaagtaagtgggcttaaaaaatacatttaatgatgactcactgaaaagttttcttagccagttggattctgtgaacttttaggatgcattgtacccatttctatgaaatttagtcaggtctgttgttaatctccaccgattgtcactttaacagtgtgtgtctcagtgtttgctactgccattatttctttctttcttttttttttttttttaaatttagagatgaggtctcgctctattcccaggctggtcttgaactctggggctcaagcgatcctcccaccttcacctcccaaagtgcttggattataggcgtgagccaccgcacctggctggctgctcctgttgttgatagtttaaactcctgcattggcatcagttatatgtaaagtaatcaaagtagtactgcagtatttgtggatctttaagtcctgcttgggtttaagatcttttaagccctgccaaatcacccacctttttgcaaaaaataaaataaaataagactagaattgctgtttccaaaatctatacaggcgcttttgaaataatctctttaaaataaaatttctgatgtgttatcaagaatggaatgttattacttctaacagctgagcctttgatacaggtagataatttaaaaattctgtaagtggattcagctgtaagctgcttgtgaacagcaccgtgtctgtctgagctcgtgtcctaggacatgttcagtgtgctagctgtatacacatgaaggatgtaggtagagagaaagggatgcttgtttatacctccaactggtacattcataggttatgcaatacatacatacatatatatatatatattttttttttttttttttttttttttttttgagacagagttttgctcttgttgcccaggctgaagtgcgatggagcaatctcggctcactgcaacctctgcctcccgggttcaagcgattctcctgtctcagcctcccaagtagctgggattacaggcacatgccaccacgcctggctaatttttttatttttagtagagacagggtttcatcatattggtcaggctggtctcgaactcctgacctcaggtgatctgcccaccttggcctctgcaccgggcctggcctatatatatattttaaacaatgtaatattgttttttaaaaacagctttatggagatatcattcatcctttattttttatttttatgtttcatttgttttgagacattgtttcgctcttgttgcacaggctggagtgcaatggcatgatcttggctcactgcaacctccgtctcccaggttcaagctattcttctgcctcagcttcccgagcagctgggattacaggtgcctgccaccacgcccagctgatttttgtatttttagtagaggcggggtttcaccatgttggctaggctgggctggaactcctgacctcaggtgatccacccaccttggcttcccaaagtgcagggattacaggcgtgagccaccacactgggcctaattcatccttttaaaatgtacctttcaatccagtggtttttagtacattcacagagttatgcaaccatcaccacaatctaattttggaccattttcctcaccgaaaaagaaaccccataccctatgcagtcgctccccatttcgtctctctccctccctaccccctcctcctttttcttcccccaccctaggcagccaaccactcatctactttctgtatctgtagatttgcctatttgggacatttcatataaatagaatcttataatatatggtcttttatgattggcttctttcacttagcatgatgtttttaagtttcatccatgtatcagtactatatgatgtttctgtgaaccatattcctctgctacttatgatattctaactatagccactgttaagagcccttgtgaaaagaaataagtgggcaggtggtagctgggagtgatgactgggcacagataatgtagagaatccctctgggcctgctagagaatgacatctcttcttgcatgccaggaaccttctggacctttactgtttttagcagtcacatccaaagttgaaaaagggctgggcccggtagctcacgtctgtaatcccagcactttgggaggccgaagtgggcagatcacctgaggtcagtagtttgagaccagcctggccaatatggtgagaccctgtctctacaaaaaaaatacaaaaaaattagctgggtgtggtggtgggcgcctgtaatcccagctactcaggaggctgaggcatgagaatcgctggaacctgggaggcggaggttatagtgagccaagattgtgccgctgcactctagcctaggcgacagagcgggactctatctcaaaaacgaagttgaaaaagtttgttcatcattgcagtatgaatgccagtttcctttaagtctctccagctcactgtgctctgtgatgtggcatctaggcacctattcagtgggaggagcggaacgtcactgccattcaaggacctggaggaaagtggatgatcccttcagaggctaaagagtccatggataagaacaagatgggcttgaaaggtagcactgaagtagagacgggggtttttacagatttccgctacaggggttacttagttttgaaaatttatgcatttaaactgaataaggcctggccatctgtgaaggtaacgccattcttttatgaagtaactactcatagtaagatgttttattcatttgggacatttttttcccccagtaaaaaacattaaagtattactggatgatgccaaataacagtatctctatttaatcttcaactatatatatcttttgcttaatttttacatttgtatatttatttatttacttaatttttttgtgacagagtctcgctctgttgcccaggctggagtgcagtggtgtgatcacagctcactgcagccttgacctcctgagctcaagcagtcctcccacctcagccgcccgagtggctaggactacaggtgtgccaccatgcccaactaattttttaaaaagttttttgtagagatggggtctcactatgtttcccaggctgatctggaatacctaagctcaagcaatccttctgcctctgcctcccaaagtgctgggattacaggcctgacttagccactgtgcctggcctacatttttattattattttaattaatacatgtttaaggccataattcaaaaatactagcatgtggtagatttaaattcagcataggctttatttttatattttttgagagtctcgctctgttgcccaggctggagtgcagtgccgtgatctcggctcactacaacctccgccttctggattcaagctattctcctgcctcagcctcctaagtagctgggattacaggcacacaccacaacgcccagctaatttttgtatttttagtagagacagggtttccccatgttggccaggctggtcttggactcctgacctcaagcgatccgcctgccttggcctcccaaagtgttgggattacaggcctgagactgtaggccagagcaagcataggctttaaagccacagacagaaccaacattgaatctcatctctgctacttactggctagaaggcttgggcaaattttttattcttattttttcttttttcgtcatttttaaatgacagtaacagagttgctgttgtacggggtgatgataaggattatatcatgtcaagcacatgattacaatgcttgatcctcaggaagttctgaagataagaaacgcagttaatgttccagaaagctcccgtgaggaagtgttcctccttcatttgaatctcaggtagagagtgaactagaggcagaacacatttcacaaggtagccgaggtgggttagtaggtcacacgtgagaccagaattccttctagtgtcatctgggttttcttctgtataacaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtggtatgttcactccagattcttttttattcctgcttggactgctttctgtgcatctgggaccccagagacagatctgctttatctctgtgaggagttgtgggtgtttgtcttggtgctgggtgtctggctgacagtactcaaacaaatgtaaggcatggtggttcgcgtcacaagcttgggaatatgccctctgaattttgaatcccccacttcacaggtgcgctcttccgcagatgactgtctctgcatctcagttttcttcatctgtgcagtggggctcataatacttacctcttagggctggagttaacatgaaccccattgtcgtagcagtgtgtgtgattagtcatgctagctggcactgtgcaggcctgccacaaatgttactgtctactccccaccctctgtctcccactgcgttgctgtcacactctttccagcaaggtgggacttcctgtcttgcagattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgtgagctccttgcgggggccggcaccccatcttgctttgttgtgggagagcagtgacagggcttccctttctcctcttcagcttgttccttgattcctaatatctttgaaaaagaactttgtaacaatccaaagatacggcatctctcttctgtcggagtctcctcttttctcctctgttttttttttttttttttgagacggagtctctttctgttgcccaggctggagtgcagtggcgcgatcttggctcactgcaacctccgcctcccgggttccagcaattctcttgcctcagcttcccgagtcactgggactacaggcacatgccaccatgaccggctaatttttgtattttcagtggagatggggtttcaccatgttggccaggctggtctcaaactcctgaccttaagtgatccgctcgccttgggctcccaaagtgctaggattacaggcatgagcctctgcgcccggcctggagtctcctgtttactgcgcctccctgggcgaatgacaggagcaaatgaggaggggatggtgattcaggtcctggaagctcaaggaaggactgagggttatcaggaaaggaaattggagcctcggggtccccagatgctgtggccatcagcagaggccacatagcgtacgttttagaagtggaatagtgggaggcttaaagtagtgctaacaatacctgatgtgttactccagcaacttaaattctcatccagaggctgttaaagtcctctgaatatattaacagttttcctaacctaagaaaagcattgaacatgcaaaatagtaaaactatttaaattactatgttaaccttttaaagcaattttaataatattagtgggtatttcttcattcttgttagataacactataaaaatatagtcttctctgttatgatcaaactattttacatttttactcttttatactttcagaaggatcctaaaacattttcagcttatattttattaactacctaagaaataattttattgtaattgggatcaggtagcttggcttctggaacttaaatgtcttgaacttactttacttctttgatttgattcttttctttctgtaagacttttttttcagcagtttttatttgattaaatacaggcggatgtcagatgggctttttctacaaaaatgcagggaagttgcagaaagctgtaaagatattaaatttaatgagatgtaccttgatacagtatgtttgaatgtaagtatatattcacacttacctgctactttttatggtgaatggtgtctgtgtgttgtggggatgcagattttgattactaaatgcacaaatgtattccttgtagatggtacaagatccttcccaatttgatgttcttgttatgccaaatttgtatggagacatccttaggtgagtctggctgcaacctatttattttagcctatgatttacttataaacatcctaaaataattatggcttaacattttcaattgagtattgtgaaatagagtatttgttgtaacatatgaattgaattctaacagttcaggttgtgatatgaatgattacatgttgggtggcttgttccttcattgatttgccaaatcattgctgggctctttctccctaatcattattaggtcactcttcccagtttttaaatgtttgattgattgattgattttaaggttttgttatgtatagctaggtaggtgggtggtcattgttactattttttggtaacttttgacataatttcagacttacagaaaagttgtaagaatagtacaaagaattcccttgtactcagcaccctgattccacattctccagatgtcagcattttatcacatttactttattactccttcccactttccctcccttcctcttcctcctctcctttgtctgtgcttctctctctctctctctccccccccgacacacacagacataagatgttggccaaatggtgattttcattttttttttttttttgaggcagagtcttgctctgtcgcctaggctggagtgcagtggcacaatctcggctcactgcaacctctacctcccaggttcgagtgattctcctgcctcccctgagtagttggtattattacaggtgcacaccaccacacctggctaatttttgtatttttagtagggacggggtttcgccatgttggccaggctggtctggaactcctgacctcaagtgatctgcccaccttggcctcccaaagtgctgggattacaggcatgagccactgagcccagctgtggacatggttttctgttttattcagtgatatatccatcatcataatcatgaatattgatgcataggttgtcctaacttggctgatgggggtcccttcaccatgtcttctgtgtcctttagacacggccctttgttctttgagccttgccttgctttctgacacagtaagatgctcgaggctcatctgtattttcctaacctttgccctggaatcagccatttatccaaggaatgctacttccttttagtggagaatgataattaaaaactaaaatctgggtgctaggtgagatgttttatttttaaaaacattctttgaaatgcttttcttccgctagtgacttgtgtgcaggattgatcggaggtctcggtgtgacaccaagtggcaacattggagccaatggggttgcaatttttgagtcggtaaggaccctgacacctgaaacagaactcaggtcagaacagcgtgtgaactcaggaggagttatctgtataagtatgctttaactccagtttttcaaattgtcaaaacaaaatgatgctttttttttttctcgagacggagtctcgctctgtcacccacgctggagtacagtggtgcgatcttggctcactgcaacctctgcctcccaggttcaagtgattctcctgcctcagcctctcaagtagctgggattacaggtgtgagccaccacacctggctaatttttgtattttagtagagatggggtttcaccatgttggccaggctgttcttgaactcctgatctcagatgatccatccgccttggcctcccaaagttgctgggattacaggtgtgagccattgcacccagcctatgtttgtttttatatacacccatatataaacatatatatatgtttggtttatctcttcatttccctccaggtatttattatgtatccttccttccttaaaatattttaccaaaaattgactgaaaaagattgttggtccatatttttatacttaaaaaaattactttagctctttatttctccaagtctttatttatttatttatttatttttgagctagggccttgttctgtcacccaggctggagtacactggtgtgatcatagctcactgcaggcttgaactgctaggcttaagcaatcctcctgcctcagcctcccaagtagctggcactgtagtcaggcaccaccatgcctggctaattgctaatttttttgtagaaatggggtctcactatgttgcccaggctggtcttgaactcctggcctcaagtgatcttcttgccttggcctatcaacgtgttgcgattacaggtgtgagctatcacgcccaacccagactttatttcttcagtccatatcagatgaattgcacgcagtagctttcagtgcatattttgtattgctgaggaaagatggttaagactccagcttccccagaagaggactgttagtttttgtctctcccttgatgatgctacttttcccgatgtgtaggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaaggtaacaggaatcttgatttacttgtgctgggtaaaatgcattgcttccatgtgttttatctgagtgaaagggacagtgacagataatagttctcaggcgggcccaagcatttgatgttgaacaaggattcttaacgtgggtcccagattgaacagggtatgtgtgcacatgtgtgcattttctgaggtgaggatctagatatttcatccaaaaaaagttaagcagcactgatgtatagacatcagtgtacagtggaaaggtcagtggtttgggaggcagcatcaggtgcacgcccaattatcctattgttagctgtgtgaccttggccaagttcattgattttttttgagacagagtcttgctctgtcacccaggctggggtgcagtgtcataatcttggctcactgcaacctgcacctcccgggttcaagcagttctcctgcctcagcctccctagtagctgggattacaggcgtgtgccaccacacccagctaatttttgtatttttagtagagatggggtttcaccatgctggccaggttggtctcgaactcctgagctcaagtgatcctcccgccccagcctcccaaagtgctgggattacaggcatgagccaccacacccggccaagttcattgatttttatagacaactttttactcttcacaacaaacgtctgttgagtgtaccttataaggtgtgaagagtaaaatgatgaatagggtaagatgctgagcctcaaggagctgggaatctagtggcagatacagatgcagatgtacctctaatacaatagtcttatatgttacactgtgtgcatctataatacaaaagcaatacagaagttttataaaagtaataactaatattaattgaatacttatgcaacttttaagttctttatatatcatctcagcaaagtttttctataactctttgaagtagatgctataattccattttatagatgaggaaactgaggtacagagagaataaataatatgtccaaggttttacagctcctaaatgacccaagttggtattaacacgcagtctgggccttacccaacaagctccaccgcctcggtaagcaattgtggcctgtggaagaagtgtcgcgggctattccgaagttagaggaaataatgcacttgaagactcatccctaatttgaggtcctttttaacaaaaattgtgaaaaatatgcataacataaaatttgccattttagccgtatttaggtatacagttcaataatgttaagtacattcacattgtaatgtaaccatcaccatcagtcatctccagaccagtttcattttctcaaactgagactctgcacccgttaaacagtaactttcccttccccctcccatcctctgacacctgccattctgcttcctgtctctatgaatttgactactctaggtacctcatgtaagtggaatcatacagtatttgtcctttgagtctggcttatttcacttagcgtaatatcttcaaagttggtcccttcttttaaaaaaattctgtaatttgaaattatatcgtgtggccaaaatacaagaaattcaggcttgtttttaacagcctgatagtcacattggaggtcatatgattttcttattctttaaagttatatttgggaagttataatctacagcccagtagagaggtgcctgaattacatagtgggcccttttattgtgtaggatggaaagataaagagaattaaatatattggggtctgtatgcaggaaagaaaggataagctggtagaacagatcagttgtatgggaggctttctttcctaaagagggaggtttaagagttaatgatttaggcaggtgtggtggtgcatgcctgtagttgcagctataggctgaggcaggaggatcaccttagcctctgagttcaagaccagcctgggccacatagtgagaccccgtctcttaaaaaaaaaaaaaagagttaatgatttaaatatttctttcgtatttgtgtcccagcctccaaaaatagatcagatacaaaaattagttgggtatggtggcatgcacttgtaattccagctattcaggacgctgaggcaggagaatcgcttgaacccaggaggcagaggttgtggtgagctgggatcgtgccactgcactccagcctgggcaacagagtgagactccatctaaaaaaaaaataataataaaaacaaaaatagatcaaaatatgtctcaggtctattcctgagacatatttcccaaggatttttatgaaacttcttatttagattcgcttttatttaaatatccatgaccaactaatctgggttagggtctattgtgtgaacaaagggaaaattttggtaaagctccctgcctccctttgcatcaagagcaccttattctttgcagagtgctgttgtatacactatgagattggatcccgatcctcctgggctgggtagatggtggtggagtggttcctcactttgaaatgaggaactaaatgaaagagcagccgagtaacttgcccaggtggcatctcactgagggctttaaaatctccttggtttagtttagtttgcggatacatcttttatttttgctttttccttttctcagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactg

SEQ ID NO: 36065 - DNA, 15951 bp, Homo sapiens
ctcttttcgatccgggacggccggtcaggctcgccgccgagctggtaggggctgggggcgaggggtgcgggaaggtgaccggggcactggcgggcggcgccgcgcgcggccgggggccagggtccgagcagcggggtgggggcggggcggtggccgggagcgcggggggtgcgggtcaccaggccgggccggcggcctggaacgtgcggcgccggggagaccgttccgccgtgctccggccgtgcgcgccggcgcgaggggcgtccgggccggccgcgggggcggggaggggaggggccctctctctccccctccccccaccgcattcctctgacgttgggacggagcgaccccgcccttcgtcgcgaccggcccggcctcctcccgtcacgcgggccacgtgcttcagacgcggccccgcccccgtctctgttccgttggcgtggtcggatcttcctggtgtccgggggagctgaccgaggtccccagcaaggccccctcccctaactttatttcccctcaccggcagagccaccaggcctgtcccctcttgtattgccataaaccccattttttctgatagggtctcgctccgtcgcccacgctggagtgcaggggcgcgatcacggctcactgcaacctcgaaatccggggctcaagcgagccttccgccttggcctccccaagtgctgggattacaggtgtgagccaccacacacggcctccatttcaaacttagtttccacccggacctcaactcgaaatcccccatcagccgggcagaaaggtcctggagcacttttggggcgtccgccgcgtttctcacgacgctagcttcgcttttatttcttttcccccctttggcgatatcgtcacttgccaatagcttcgctaaggtgttcccccccacaccctgcgcgggcagccccataatgttaaatgccgtaggacgggatcccgggttaatccccgtttgaccccgctgcctgcgcgtgataactggggcgcgctcctctccaccccccaggctccgccagttgggcttcgccggagtctggagataccctccgacattctcttggtgcagtgcgggtggtcttaccccgcccttgaggaagaaaggcccgacgcaggcacagatcacaagaacgcctcccctgtgcagggggcttgcactgtgccaggtgctgtactgggcgcttggtaggtggccaccctctccagggtcggggccaggacctcctgtggtgctcagaggggtcgagctgtcaggtgaaaaccactggcccgagttatggctttgaagggaatcctgggggtctgggatggcagggacctgttaatttagatcgcacggacaagatgacttggcccttagctcctgcaggaggggtagtggactattgcaggtggaagggactgcatgggcacacatggagagtgcgcggaagagccttctcccaagggaaactgaaaggggttgcggctgaatttagaactggacagggtccgaagacagtcggcagcagcgagtggttttctactgaggaaaaggctcagatttgggattttaacaattcctcctagaggtagaaatgaacacggtatagtgatggcgacagagataccctgggagttcctgtcaatcttggtctagccttccggcgcacacacagcggtcgctccataagggggccccgcctctgggcggtgcctgaaagcgtatttgcgcatgcgttctcgccttcgctcgtttcgtatactgcaccaaagagcgcctaccctggggcggggctccccatttcatccaatcagagcgtatcaacagtcctaccatctggtgagagggtgcgctccactctccattgaccaatcagtggagacgcagaagaatgggcatctgtaaccaccactggagagagaccaaaaaagggcggggcttccttgtctccttgcgaagtggcgcgggaaggtcgtcattgtgactggtgctgacggattagcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggtgaggccagggccctaggcgctgggaaggccgggaactgggggacaatttcccagcttgagggcattttattttttgaggggggcctctgcgcacgcgcccaggccatcgcgtcgttgacggtgtgggggaggggcggccgttgggcaaacggcggggtttgcgcgaggacaggcgcctgcgcgtgcgcggggtccggagcggggtgtgggggagcgcagaggaagtagctcgtgaggcgaatggcccagtgcgcaggcgccgcgggctggcgtgtgggggccgggcacgcggcccggccggtttttttcccctttatcattttcttcgctggctccatgcgcaggcgcagtgttcccgcccggcctcgtgggcggttaggggagcgcctggtgagcgggaacgggtgggcggcggccttgttctctagagtggggaattccgtctgatggcagcttaatctctaaggcccagccttgtgtctatacagaaatggatgtgtttgagcctagatgctctcatttttgtaggcattgaaaatgggaagaggacttgtgaaatgcacttttagccttttaggagttgagcgaagccttgaaaccatcacaagtttgcttacagtttccggggattcactgggtaccgaggatttgataaaccaaactatttcctggccatgttggaagcatttcgaccccctgtaatcagtccctccgaaaacaccagtcgttgcttttggagtggggcccagtccccactctttccaaaatcttgaagtcttacagggccgcctatttgcagggttttccagggtttaggggttacgagttgctagcgttttaatcttggccttgtcccacacattttaaagacatcttaattgaaaatccttaacgcttcctgaggttgggggagatactgggattcccgatttacaaaggaggaaatgggccaggagagagatgagatgaggtgaattactgtaggtggcacagctagtgaggggcagggctggagttagaactcccatttgtgggagctgctaacctggcgggagtgcctcaccctgtggttcgcgtggatcgctcctgaaatagaatccaattctacccaccttccacgcacttctgcccagtgattctcagacagggggccggccccagagcccaggagaggcggaagagagttaatctttctcctgatgaccagaggcttttgtcggtgggtgtaagatacttctcttaggaaggagcagtcggttcttaatggtatgggttggagtctctggtctttctaaaagactttccatccgggagtgggggctcatgcctataatcccagcactttgggaggctgaggcaggcagattacctgaggtcaggagttcgagaacagcctggtcaacatggcaaaactccgtctctactaaaaatacaaaaaaattagccaggtgtggtggcgagggcctgtaattccagctactcgggaggctgaggcaggagaatcgcttgaacctgggaggcggaggttgcagtggactaagatcacgccatagcactccagcctgggtgacagagtgagactccatctcaaaaaataaataaaagacttttcttgtctggtttttcttagtctgacctaggcagtaatttccaaagcagattttggtgggagggcgattcaagactagaaggggtcaagactggcctggctgccccagtttctggggcatgtgttgttttttgccctgactgaacctgggtgtgagtggtggggaacaggtgtgcttagctagatgatggtggctcagccagttaaagggcaaggaatttggggcacatgcaaaggggatgtcctcattcaaactgtagcagatagctgttagagcccttgctgccagtgtatctccttttccagctactcttttcccatgtttccttggtcgagtggaccagtgggaagagaggggggtccctggaagaacgtaagatttgggacttgtgtggccctccctccgttataccttcctcagaagctacagcaagagccagtgggcaagtgatcacccactcaggaccactgttctgctgacccagaatccttctgggctgattggcttcaattgctgcccctagtctttcctgtgcatccttcacggatgacctccaactgttttatctgactgggtctacaacagtacagaggccagtggggcgtcatcttgtacagcaagaaaataattcttgtttttgcttcctttctcaggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagacagtctcttgctctgtcgcccaggctggagtgcagtgacaatctcagctcactgcaagctttgtctcgtgggttcacgccattctcctgcctcagcctcccgagtagctgggaccacaggcgctggccaccccacccggctaattttttgtatttttagtagagatggggtttcgctgtgttagccaggatggtctcaatctcctgacctcgtgatctgcccgcctcggcctcccaaagtgctaggattacaggcgtgagccactgcgcccggcctaatttttatattgttctgtagaggtgaggttttgccatgttggccaggctggtctcaaactcctaggcccaagcagtctgcccacctagccctcccaagttttagggttacaggcatgagctactactgctcctggccagtgttctttcattcagcaagtagttactgaatatttggtgcatgctatatactgcaaatacagtagtgagctgtatctggatgcttctcttagaaagttgccctcctagagtgatttgcactgtcatagtgtaagctcaagaagccgtctgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcaggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttatttatttattgagatggagtttagcccttgttgcctgggctggagtgcagtggtgcgatctcagctcactgcaacctctgcctcctgggttcaagcaattctcctgcctcagccttcctagtaggattataggcgcctgctaattttttttatttttagtagagatctggtttcgaactcctgacctcaggcaatccacttgcctcagcctcccagattacaggtgtgagccaccgcgcctggctaggaatttatttttaaagatgtttattctaagttcaaatatgagtgacaaagatttggggaacatagtctcaagaggtcctgagaaaatgtgcccctgggaaaaggaatttatttaaaaggggatatggggccgggcacagtggctcatgcctgcaatcccagcactttcggaggccgaggtggacagatacctgaggtcaggagttcgagaccagcctagccaacgtggtgaaaccctgtcgctaataatacaaaaaatagccaggcatggtggtgaacgcctgtaatcccagctactctggaggctgaggcaggagaatcgcttgagcctgggaggcggagattgcagtgagccgagactgtgccactgtattccatcctgggcaacacagcgagactccatatccaaaaaaaaaaaaaaaaggtggggcatgtgtgaaggttgctgaggaggtgatgtcctatgagcaaataggagcttatactcaaggtggaggaaacagcctctgcaaaggttgtaaagtcagaaggagcttgtgttggatggagaaattgaaagacctgaggattgcaaagtggctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactctggccagtgactgctcacccggggcagcgttgagtccatcaacaccgttttggtctcttaacctgaggctagtggctgggcagtgagctaatcccaaagcttccgtctgtaccacagtcttggggtgctaccttgtccttatcacactctggggtaacttgaagcccttctcaaagatctcctgtgatgggactttccttaacttgactcacatttgactcagttcaaagtgcccagcgggccaaggcctctctcaatggggctgatatctattctggctgttgcactctgaagatcgaatacgcaaaggtacatctgggaggtgactgactgccccttgtcagcttccaggtgagctggggcatggctgacctcaagtcttgtcttgtcctgtccttgcagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagccccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgtacatgattgcttatttgaactgattctgctgttgccctgcttgtcagctacagtcagtccctcttgggctggcgggactgggagggaggggggactgggattaagaaagaagggatctaacagagacagtctggagctcctagaactttgggggctttgggggtcaaacttgcttgcttccctctggggttattttcctcttaatctactctcccttcattgggagtcactttagaaagctgcttttggcccgccataatatatcagcttctgtagcagctgcacattccccagagggcctgggagctgggctttctcccagggccagggtaggtgagagcacagaatctggccttgtccttcacagaacaaggccagccctttggtatgagcaggggaaggagagtgggcaccagctttgaggctcgggcttcatgcccgccgtaggtcagatcacaaaaggaggccccacagccctcgaggaagggagggcttgcagttggcaggagctgggggctcagatcagcctgtgcagtcaggagggagggagagaccccaatttctgagtgagactcctaactgttttctctctccacaggtgaccctggcagcaaccccaacaaacgccagaggcagccccctctcctgggagatcaccccgcagaatatggtgagggcagggggttcccctccgtggactcccgtggctcatgtgcccctgcccgccgcccgccgtgcaaattctcacccgtcctccctctctttccttcccaccccccaggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgagctgctgccgggccccctgggttcctcgctgagcctcgtatcttgccagtcagcacgggaaagaaccaggggggagcctggtgtggcgctgggcgggcagacgccaatgagtgactcagtgagctcaggcagcctgcttgcagacgggttttgtttggtcctcactgtatgtgggtgttgtgtttttgaattaccaatgtttaaaaaaaagattttatcacataaaagtactaataccagtacatgaacatagagatttataaaacataaaaatgaatccattatagtgaaacaccatcgtttaaggatttcctcctgaaaacttaagacctggcaacaccgggccttctgccttcccatgggacagttgactggggctagcggtggctgagtgtctacctgagaccaggcggcattttgcttaacattaaacccgtctgggtcttgggggcctttgtgcagctcatgacttggcccattacttagagtagttcgtaacacaggtgaagtgttgttagttaccaggcactgttaaagatgctttacatgtagtgacctgtgtaatttctcacattaatccttaatgagatggacaggggaagtggaggacggggcttaaataacgcgcccaggttcacatagcctttatgtgaagcaggactcagagccagactgcctggctccagagccggcactgctctgttgtaacccagctgaaggagtattttaccttgtgactgtagacacagccatccatagatcacacacgtctgtgtgtaacagacaaaatggtgaaaatggctgatttgatttctgattcctgtacagttttctgtcatgcttcactaaatgatttactggtgggttatgtcccacagttaaaaacatggcccaggctctgcttctcactatgggttgagcacttggtgtgggccaggcatgtttttctagtggtcccgattaactgtgaggacatgggaggccagagcaggggttattatcactaacttgggaggggcaggagaggggaccctggcagctggacagaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggcggcccttttgtttcagagttcatttactacctgttttcttttgcagatctgcgatgagctgggagtgaagcggccatcttctgtgaaagtattctcaggcaaaagtgagtcgagtgtgcccacctccttgccctaattgcatggtggttggtgggcagctgcctagttcctattgggtgagtctaaaacctttacttttccccttggtttgcaatcaggtgagcgcagctcctctggactgctggagtgggaatccaagagcgatgccctggagactctgggcttcctgaaccattaccagatgaaaaacccaagtgagtatctgtgtgtcctgcaggcatcaacctggtgacctaatgggttggctggcttcaggccagggatgtccttcctgcccttgagataggaccccgggatcttcgcactgttggtgacacaggcaggtgggacctgctcatcaggagagcagcctgtgctcctcttgggagagccagcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagc

SEQ ID NO: 36066 - DNA, 38828 bp, Homo sapiens
atccctgcagcgctacccgggtactctggatgcacatagggcggctctcgctcctaccttgtcatcctgctgtctaatccgggggcagcttccctcctccacaccagcagaggctattcttcagcaacaagaatagccgagcctattcgtccgcaacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgggtagctgggggcggacgcaggaaagaggaggggcggggccttggtcgggtggggtatggaatgggcagggtgggggggatgggcggggtatgggatgggcggggcccgggaaattccccggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggtgagccagggcagggggctgcagcggtgggcgagggggcggcggctccttcccggcgggcgcttccgcggcctgaaaacggtacccgccgccctgccccgcggcccggagcctgtcggggtgagggtggcgaggggtggggcggccctcccgcgagacggctgccctgggaggatccccaagcctcggcgggtcctgacctggtgggagagggtgggtagtgaacacagggtgggcccaagaagggtccagggccggcctcttggccgcaggtaacccctctacaagtcacccagagacttggaggtgacgtcctcccgcaggctgggaaggattccgcagccagttcctcgccataaggaggtggttacagacacgcctgtgggagacatgggaccactacccgagctgaatgaggtgcccagggtcggtgggaatccacatagactgctgtgtctaggagagtgtgtacactctatatagagagaatatttgatgaggccgagaaccccaaaggaattgtttttgccatcgaaatgcataagctacaggaagtaaacatcgctcaaagaaaatgaaacccaggttccgacctggcctccaccagcaggaaaactgttgtatggaaatgtacaccaaggaactgtttgtaaggatgaaatggaaaatgaaagcatagaaaagtaaggcaatgtgaggacctcagaagcctttggatctggttagcaaggtgcaggctgtgtgaacagaagaacccaccttgctcttttgacccagggagagaagagttagtggtgccaggctgcctcccaggacaggcccagttttggggcgggggctggagaagtcccagggcagaccccaaggccagggattgccctggagtggacaaggcaagtttaaatgtgacctgtagacagaggacgatcattgatttaagtcctggcataattcatctgtttttccactgggccaattttaggcgttctttatatattacgtacaacacaataaaagtaacagcttctttttttataaactaacctttaggttgcatattatgctaggaatataactaacctaacctccacccccccacccccccacccacccccggaaaaccaaactttattctcgagggcaactggacactgtattatgtcctgccgaacccccgcccttacttaggtagaggcgcataagtattctggccatgaaatacaccttctgttttatagagatttggcatatttgatatatgttctttggaatttatgaaatagaaaacccaaaggaaaaagaaaaaaattaaacttttttttaaaaaaatatttcatttagaaagaaaaaattaaaagtttttgttatttccactttgacatgtgtatgaggagcattagaatctgtgttatgaagtgatacccagatggctttgcagtgacagaaaacacttctaatttttcaaataagttagaaaggaggattttgagaatctggaagtgaatgccgtggaactgtggagaaactcctaacaatactggcatgctgagtttgtcacctacacagcagaaagcattttacaggtattagacttaaaaatacctcattatgctatattttcatttcatttcaaccaacatttactgcaagcctgctatgtgccagtctctagtaagaataacatggagagaaaatagacgggcagacgatagcagtaatttcagaatgggcggaggaggtggaaatgcagagtgttcttgggtgctcggagtagggaacagttcatatgacacaggacatcatatttaagctggacattgatctgtccagtggaagtttgccaggacacaaggggagccagacatttcgggcagagggcagaagggaggcaaggacgcagagacagaagaatgcagggaaccgtgagctctttaacgtgccttgggtacgagtgttttggtggcaggaggtgactctggtgggtcagttgggcctgggccctgaaaggccacgtttgtcttgttaagaaactgaaagtctgtcgtgtatgggaagggtggactcaggggaatgacctcatattgcaaaagaaaccatgagggcaagaggactgaaattgacagggctgaaagccagtcatttaggaggctgttaaaatgtattcaacagatatttaccgagtcctgccttctatgtggcaagtaatgttctcagtcctggggatacagcagtggacaaaataggcagaacccctgtcctttgtggaggtcaacatggctgtggtacagacaagataagggcctgaactaagcctgtggggatggagaggaggcagtggattttagaaacacttagaagggccaggcatggtggctcatgcctgtaatcccagcacttagggaggccgaggtgggtggatcacttgagatcaggagttcaagaccagcctggccaacgtggcaaaaccctgtctctactaaaaatacaaaaattagctgggaatggtggcatgcacctgtaatcccagctacttgggaggctgaggtgggagaattgcttgaacctgggaggcggaggttgcagtgagctgagattttgccacggcactctagcctgggcgacagagtgagactgagtcttaatttaaaaaaaaaaagaaaaaataaatatttaggaggtagaggtgatggcatttggtgacccattagacttggggaaaagggggctgggaagaatcaagccttactcccaggttcctgccttggggagctaggttaaagctgctgccattttctgtatattactaaaatacgaagtcacaatatcccttctagtgtgtaatgacgaggctgcttttaccccattagtaggatgcatactctaagttctttttccaaggtgggaagggtttagtcaatgcaatgttagaatcttaccccccttgtgaacccaaactcttcatagcatttgccagtagccaactcttgtctctggtcaaaaagcaagttttcactgtttaaaactcatttatcccatgtagggattgaacctacgaatacttcattagcaaatttgaagacttggccataccagggcaagggcctaaccttatactatgtgcagtgtccactggggggaagtcagtgtaaggcaggtaccatttgacacattatgactttctgaccactagagccatcccacagtggaacagacagtgcctgctaaggtcactgcactcgtgctctgtcattgaaatactcaagcctgctctataggatcatgtgccatcgaaaccagacaagacattcttgcattgaatatattggtctggatcatttctaaggccaactcagcaatcagatgtatgctcgtgtttacaaggtcaggtcattactagaattacttgatctctggaatttaaatgtatatacacacacatgcacacacacacacacacacacacacaatcaggaattgagatagcagatctgggaataaaatctaggggacttgcttttggccatccatctactaggcagtcctcagtcttcctcattggtggaatcttgacaaatcctgtgctcaattaattcatccttccatcattaaatatcacttttgcctagaaataacatacttcacatctaggtcagttgattatgggaaactctgttatttgatagaatcttagaataaatggcttagttccaatttctgtaaccttcgaagacatgtgcaaggatatgtaatgtatctctgtctttcctcagttgaatgtagctcaaggtgatgttaaaaacagagaatgaagctttctgtaactggcattccaccgacagatatttcatatgtgcactgcacagtgatagctcatagtgatgtcctaagataacctaagaattatgaagtgccctttgagtcatccaaaatcagttaaattagtttttttttctttttttttttttttttttttgtgagacagggtctcactctgtcacccaggctggagtgcagtagcatgatcttagctcactgcaacctctgcctcccaggttcaagcgattctcatgcctcagctcccgagtagctgggactacaggcatgcaccactacacccagctacttttttttttttttttttttactattacaaaatttatttaacaaaaagtctaatatgaaaatgtacatgacctaacttttacatcatagtaaaacaggccctatggagagaggacatgggtttctctgctgaacagccattttttatactcattccaaggcttctaacatgaggatactgtttcctcgtattaccaccattccagtattgttctgttgcccactagtcgccatctccacacattcatctatcacaagattcataaagggatcaagtccctgcaatattccttggacgtgtctgccaccatttaatttcaatgataacttcttgtccataaatcccttctagccatctggttagaacatgatgctattcgagatgttcaacaaaaggtggcattcgagatcttcaaggaacgaagaagggacagcatgggggtgaccaggggcccgaccgcaggaccgggaggcgagtcggccagaaagaggtgcagtggctgctggtggtaactacgccgacgtgcgagctctgctactaatttatgtatttttagtagagatgggatttcaccatgttggctgggctgatctcaaactcctggcctcaaatgatctgcccaccttggcttcccaaagtgctgggattacaggcataagccactgcacccggcatcaattaaattacttttagtaaaattttggtattaagtatttacatgcttatatttaccgtttatgctaacttcttatgtttgatgacatttgaattacaaaatattttttctaacaatacacaatatcacagaatttgctgtcattaggacagttatagctattcatgagagtgactggcctgcccgtgatacttggtgtatatgcattgaagggtggggtttagattgtggtctttctagaaactaaagaatatttttcacagagttcataaggattatcatttgctggatgagtcaataaataccactagaggtcatgtgacttcccaaggccacacatctggctaatggtacaaatgtttttttctgtggcctcccttagcacgaccccacttttttcctcgtatgcttataaaatccgggcaatgtgagaagtcagaaacactgatgtaacaactagaaccagttttaactttattatggtggtatctgtaggcttggtggaggcataaaaggtcatggaggggcccggcaccgtggctcaagcctgtaattccagcactttgggaggctgagatgggtggatcacctgaggtcacgagttcaagaccagactggccaacttggcaaaaccctgtctctactaaaaatacaaaaattagccgggtgtggtagcacatgcctgtgatcccagctacttgggaggttgaggcaggagaatcacttgaatctgaaaggcagaggttgcagtgaactgagattgtgccactgtactccagcctgggcgacaaagtgagactctgtctgaaaaaaaaaaaaaagttcattgaggaaaaaaatcttaacagttttcaaagaaacgtctctctcttttcttccctctcttctcccctccccttcctttcattttcagaaaaaaaggagaaatttgtgcatataataagatgaaaccaaacacacttctaaaaatctgcttagatcctttctttaaaaaaatctgttgaatattttcatggcctttgcaaaatatagtataatcactgaatacctaagaaaaattaactgttggcaagtaaatgatacagatgacaaggattttctcttttaggtctattacctagaattttagtattcctctgcaaattaggtaggaacactgttactcagtaaaaccctattttaatgagatgattctgggtacaaaaaaatgaattttacagaaaattagaaactgatggtctattcagattatttttgtgagaagaagagcagtctgttctagtcacctaatgctaagctatggaacacttctgcattatacctgttttctaagtgaatttgggtgtgtgacacatagatacaaaaagttcaaaaatgaatcctatggtttatcagtgttttctgcttcgtaagattgccatcaccctcattacatgactacatgagaatgcccctcttggtactagctcttgtaggaagaagtggcacaggctgtactgtcacagggtgtggtaggtagctctgtctctgattacctacaagttcctcacaccaaaaggaggttaccaggtattgcttccagaagatctacagaaagcccaaggtattgcctcctgtggccaaggacgcaacaccacagtggtgcattttgttttattttaattgatggctattaaatgcacacatagatatcatgacacagttacatgtcagaaacaggcagtgctcttatctctatcttccagggactgatatcatgtgtaatggattcttcacaactcagggttcacacaggctccatagtcatgagtggctgatggatctcattgagaccagtgcctttcccccgttagaaatgggatgctcgcttccaagttctctcctcaccccttttgtgcatgcgtggctttctgcctgatcacagttgtatagtgtacattggtgcttaatacctatttattggatagatggattttaaattattttctaaggtccaggagcagtggcttatgcctgtaatcccagcacttttggaggccgaggccagcagatcacctgaagtcaggagttcgagaccggcctggctaacatgatgaaaccccgtctctactaaaaatacaaaaattggccaggcatggtggctgacgcctatagtcccagctacttgggaggctgagtcaggagaatcacttgaacccaggaggtggaggttgcagtgagccgagatcgctccactgcactccagcctgggcaacagagagagactctcaaaaaaccaaaacagtctttttttttttttttttttgagactctgtcgcccatgctggagtgcagtggcacgatctcggctcactgcaagctctgcctcctgggttcacgccattctcctgccgcagcctccggagtagctgggactacaggcacctgccaccatgcttggctaattttttgtattttttttattagagacagggtttcaccgtgttagccaggatggtctcgatctcctgacctcgtaatctgcccgcctcagcctcccaaagtgctgggattagaggcgtgagccaccgcgcccggctcaaaaacaatcttctaacagtaaacatcctggaagtaaataatatgctttttcaggcatgtctctggactttggccattcttgacctttgtagaatgcgtgtgtgggccatgtgtacacagcgtcagcggggaggagttgcctttgctatgtattgctttataatctatccccatcagctcttgaagaaaatacatcattttcaccaagtgtgaaggtggaaatttgtgctgaaacatgtttgcctgggtggttggtaacacagaagcagagtggggatttactcattggtcttgcatttctatgtccacatggatgcctctacaaaacaaaatgatatgtgtaaaaaaatttcagaccatgcaatacctaaagatatcttagtcttttcagtatgcattgaaaaatagactattaaagcctaagtactcagtaatataactttgttgttttacaaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagtaagcattcaaagaatgttaattctccctttcttcttaaccaaaaacacaataaactaaatataggttttaaaacagcttttttgagatagaattcacttaccatgcaatttacttgaaataaggagatttgaatttgaagatttgcatgggaaatttttttcatgataccttgcccatgtctacatatatcctgatcatcatgatgtcataccctcgtctccctcccccatttcccaaatccttattgtaccctttttttttttttttggtttgagacggagtctcgctctgttgcccaggctggagtgcagtggcgcgatcttggctcactgcaagctctgcctcccgggttcacgccattctcctgcctcagcctcccgagtagctgggactacaagcgcccaacaccaagcccggctaattttttgtatttttagtagagacggggtttcactgtgttagccaggatggtctcaatctcctgacctcatgatctgtccgcctcggcctcccaaagtgctgggattacaggcgtgagccaccacgcccggccctcattgtacccttttatacacccatacacacacacgcacacacacacatgcacacatgcgcgtgcacacacacacacacttttctgaagctacatataccttttttgtttaaaaggaagaatcaaaaatgtccaaaatgtaactggagagaaagtgggcaacttttggagtaagtattagcaatcgccaatgggtttgtgggactcccggggaccccttgtggggcgggggacagctctattttcaacaggtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaaggtgagcagggctggcccctgtgtgccccattcatcctgggcctgcaagaaatgccatccctttgcactaaggcttggtggtgagctcccttctccccgtttccataggtggtagctggtggggaagcacaggatttagcatttggcaaggctaaatctgttctgatttttacttttggaaacaggtacaagtaaaaactgtgtgtatctcaaggaagtagcataatgatatttagcccattcaaaaggaaaaagaggctgggcgtggtggctcatgcctgtcattccatcactttgggaggccgaggcagaaggattgcttgagtacaggagttcaagaccagcctgggcaagatggcaagacctgatctctacaaaaaaattaaaaaaaaaaaaaaaaagctgggcgtggtggtgcacgcctctggtcctagctactggggatgctgaggttggaggattgcttgagcctgggaagttggagctgcagtgagccatgatcgtgccactgcactttagcctggatgacagagagagaccctgactcaaaaaaaaaaaaaaaaaaaggaaaaaggaagaaaggctgctatggttccagagttagtcctatatattaccttattaagagaaagcatcctggtatctcaagatggctttgggcaggaccagtatttgaatctaggagtagtaagaacttccttagctcctagtaaccatagatatttagatatttgtgctgtagtggcggtacccaaatccactttattttcttgggatttttaaggactagaaatgatgttcatcccgctagtcttttctgtaagcaaaaaccacttcgtctttttgctgctgacccttgggccaaggctaagcatggcatctttcaattcagagccatgtggtcaagtggactagagggagatttggttcatcagatcaagtccactttcctggtgtgtgactccatcactctgaacctcctgcagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggtgagcagaccgatccattgtgatgttgttttttttttttcccttgacatttgcagtggaatcttacgtgtctagactcctagatcaaaacctttcatggttcagtctggattggtgttttgcctggtcttggaagaagtgcttttgctgaaaagattggttgccctattaagggtcatggataatctcttttagaagaaagaaatttgtaaagctttgaccgtactgattgtaggcaaaagaacagtaaggttataaatcattgtattgtattcattatagatggtgcagatgggcctctgcctagaaccaacaattgtttttagtttgtctttgatataaaaaatatgtttaaaaaacccattactcagaatttttacttgttgaccttgtctgttctctcagtctaaaatggagattattcactttacattttcctttttaaaaatgctttggaaaatgtcatgttgtggtaggaggctatcgcattgccacagatgaaaagagaaagagacacatttttcttaacccaaagaacctggaaaaatgtgctcatacctgggagtggatgtcaaagatgatagtaatgacacaacccagaacaagtttgaaatccccactgggcgtggtttgttaaggagtcctctgctgtccatgccaagtgtggggagaatgggtgtgggtgggctttgatgggaggaaaagggcaggaggttgggtggtgggaacgttttttccttcctttctggaattttagacacagcttatgagtccactgttgccaaagtgtggttgattatttctatgatatcagattattccagcatggcaaggaaggctttctttcttgtcatgaagttactttaaattttgattatttgaatacaataaaataatgtaaaaatttccattttaaatgttatgtcaaaataaatcgtgggctaggcacggtggctcacacctgtaatcccagcgctttgggaggctagggtgggcagatcacctgaggtgaggagttcgagaccagcctggccaacatggcgaaaccccatctctactaaaaatacaaaaattagccaggcatggtagtgcgtgcctgtagtcccagctacttgggaggctaaggcaggagaattgcttaaacccgagaggtggaggatgcagtaagctgagatcgcgccattgcactccaatgggcgacagagtgagactctgtctgggaaaaaaaaattgtcaggtaaaagctgaaattttctacattaaagcacaaggcataaaggtgttgagaaacttccttgtcagtaggtgtgggggcaattgagtctcatggccaggtccttagtttgatttgtatttgttttttgactgtttttttttttttttttttttgagatggagtcttgctctgttgcccaggctggagtacagtggcataatctcggctcactgcaagctccgcctcccaggttcacgccattgtcctgcctcagcctcccgagtagctgggactacaggcgcccgccaccacgcccagctaatctttttgtatttttagtagagacggggtttcactgtgttagccaggatggtctccatctcctgaccttcatgatccgcccacctcggcctcccaaagtgctgggattacaggcgtgagccaccacgcctggcttggcttttttttttttttttttgagacagggtcttggcagtcttaaactcctgggctcaggcagtcttcctgcctcagcctcccaactaatggggactacaggtgtgtgccactacacctggctaattattaaattttttgtaaagatgggggtcttgctatgttgcccaggctggtctcaaaatcctggcctcaagggatcctcccacttcagcctcccagagctctgcgattaagggcatgagcccatggtgcccagccttagtttgatctgttcattcactttactccttgtcatctccaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgtgagtttttggttttatttttgttttgagcaaactataaagcctcccctggaaagatgaaacaaataccactttttcttgtcaacacaagccaaggattgaggaaattccagtgtagcaaagataaattggctctcattttctaagtatagcataatgcatgtaagggttatcatagctaaaatggaaaaatattaattaccttttatgatgaaagctgtagtctttttttttttcttcatcatgtcctggcaaattgaacatttttgtgaccagaaaaggaaaaaacccacacgaacatgaactttctgtcatttttcaaactaggtctcaaagctgtattccgcagttcacttaagggagcgcaaacatattttcacaacagaaccctctttttttgttttgagacagagtcttactctgtcttcccggctggaatgcagtgatgtgatctcggctcactgcaccctctgcctccggggttcaagagattctcgtgcctcaacctcccaagtcgctgggactacaagcgcatgccatcacacccggctaactttttgtatttttaataaaaaagacaggtttttgccatgttggccaggctagtctcaaactcctggcttcaagtgatccacccgcctcggcctcccaaagtgctgggatgacaggcgtgagccaccgcgcctggccaacagaaccttcttttcaaacaaagtggtatgaggaaccctgatacattaaaaagaagaagaggagaaaagaaagagcagaactgctctggttgtaggttgagggagtgtcctggcttttccttccctttcaaaagcagctactcaggagcctctgagaactgagtttgaagccattgctatcaaaatcaaatttctctgcaaccccagatgaagtgggctaagcgagggggccctaagctcttgagaagcatctgttacaactgtgcctgggcataggggcagccctattgaagagcagagcaggtcgatgcaccagctgggggcctgtccttcattgctactaacaaagattagacagggagaaagatagacaaggataaaatcctctgtagtatagatggtcactttcgatgagtcagagtacatatctgatacaggaaaagggactggccgggtgtaatggctcacgcctataatcccagcactttgggaggctgaggaggcaggatcccttgagcccaggagttcaagaccagcctgggcaacctggcgaaaccctgtgtgtacataaaaaaaaaatacaaaaagttagctaggcacattggcacacacctgtactcccagctactcaggaggctgaggcaggaggatcacttgaacctgggagtttgagatgctgcagtgtgccatgattgtgccgctgcactccagcctgggtgacagagcaagactctgtctttaaatttaaaaaaaaaagaaaagaaaaaaaattgtgtccttggaagagaaaaatgtacattgtagataagtcaggaggagtggggaacaacttgcaaaaaagctcacctactggttatatctgaaatatgaatgtctgactgtctttgctttctgatttatttgctgcaatagagttaggaaacagctctgaataaccctgccatccattccccctcatacatttcagtggccaaaatcaagataattaaaatgtcaattgaaaagcgtattttgccagagtaccccttctgcaagtgatcgaagattactgagacagaagtttaaccaaagaaacttacccttctgtcaataaccgataagctgcaggaaacccaacagcatatgagaagtttccagatgaagcttcttccttcagggtgcatggttagcatctcattctccctgtcagatgagtgacagttatttttagtgtaaacacgttttgcatgcgtttcttctgtgaactggaaagcactgcccaagatttaggaagaaacatcaaaaatatctagaacccccatggccccaagcagagaaaaaatatatgtatctatgttttttataatagatatatctgtatttatattatataatgaatatataatatattctataatatataatgtagaatatattctacaattatataattgcatatataattatataattatataattatataattatatatacatatatataattatataattatataattatataattatataattgtataatatattctacaattatataattgtattatatacacttacatatgtatctgtattttttataatagatatatctatatttatatatatttatatatagatatatctatatttatatatatttatatatagatatatctatatttatatatatttatatatatagatatatctatatttatatatttttatatatagatatatctatatgtatatatatttatatatatagatatatctattttatatatttttatatatattatatatatatataaatttataatatagatatatctatatatttatatatagatatatctatattttatatatatatttatagatatatctatatttatatatatatttatatatagatatatctatatatatctatatttatatctatatttatataatgaatacatataatatattctataatatataatatataatataacatagaatatagaatatattatacaattatataattgtataatatatatacacttatatatgtatctgttttataatagatatatctgtatttatattatagaatatatataatatagaatatatataatatattctatattatataatatagaatatatataatatattctatattatataatatagaatatatataatatattctataatatataatatagaatatattatacattatatattatacaattaatatataattacatatataacattatatatttatataatatatatttctatatctaaatatctaaatatattatatatatatttatacgtatatacctagaactatctttgtgcatttttgaagattttccctgggagcttattggaatataaatgtctttcaaatcctgtgggtcttagactatcttgttccctaagtgacctgtggtgcatacaaatttctaatgggaaccaacttggccaagatggtgctttgtgaatctcattcacagaaactgcctcttttttaactttacctcagtgagttctagcattttgcattttaaaggaaggatatgtggagttgtcaccagctctgtatgaccttaaccttgagaaagagggaactgccaaggaaagggaggagcagataagctttcatgtttacagagtcaggtagaatgtgtatggcgagatgaaactgaccttcacgccttagctgggatatttataatcccgacagggcgtgccaggtgaggggagggtacgtttccatttcctctgagccaccccgtttaaacagtgcacatctgaatgtttggaagcttccttgggttgcatgtcacaaaaattcatcttttgtctttttcttcttttgacaaagaatttgtcttgtagacatattgtgttaaatcccttgcatttctgttttcacaggaaggagaagcagaagggtcagtaaaagaaatcaagcatagtcctgggcccacgagaacagtctccactggcacgtatgtgaaggaagactcgggctgtcaggcagacaggctgggcaggctcgtcactgggtgcttgtcaccggaggtcaaatgttgtgacctgaggaagtaacttctttatgatttataccaggatctttccagaatatttggtttgaatgctatttaatgttgcagctcaaactggcaaagattaaaaactgtttggttcctgtttggctcacactgactgctctgttctagtggtgtctcacctccagcagatgaaaagtgaaagcaaactggttctcaatcaagtcaatgatttgttcctaatcaaagacatgtttgctcattggttccccggtgccatttgacccagaccagcctgcccagcttccataagtgaaatattttcattttcttttccctgctacttcccagttataagctggcatggccaatactggaacatcttttgtaacaatgactgatagcactctcagtcattgtgggtgttgcctgaaagtgcccagatttcttatctgtggagtctcaagtgtacctgtcctatgtagatgtgaggaaacagacatcttaaatagtggcagggccttggggagggaggcagacctagaactgagcgcctgaacctcttgactctcgcaaagcagtgctcaccaaggagactgctagctcgccttctgcaagctgcttactcctgtaatcatctattcaagagacgattgtctgaaaagaactctaaggatctcttttttttttttttttttgagacggaatcttgttctgttgcccaggctggagtgcagtggcgtgatctcggctcactgcaagctccgcctcccgggttcacgccattctcctgccttagcctcccgagtagctggaaccacaggcgcccaccaccatgcccggctaattttttgtatttttagtagagatggggtttcaccgtgttagccaggatggtctcgatctcctgacctcgtgatctgcccgccttggcctcccaaagcgctgggattacaggcatgagccaccgcgcccggccaggatctcttatctcacagacggataagagatccatcttttttttttttttgagatggagttttttttttttttttttttttttgagatggagtttcactctgccactgaggctggagtgaagtggcgcaatctcagctcactgcaacgtctgcctcccgggtacaagcagttctcctgcctcagccttccgagtagctgggaatacaggtggccgccaccacgcccagctaactttttgtgtttttaatagagacagggtttcactgtgttgaccaggctggtctcgaactcctgacctcaggtgatcctctggtctcagcctcccaaagcgctgggattacaggcgtgagccactgcgcccagctatctcatagatttgtaaaaccttctttgtataacttgatgaatgtgcatatagaatgacttacaaaacgtgaaaaaaattgtcttccgttatgtttctaagcccttgtataaggaagaaagtaagtattagataatattctttcgtcaaacacagtaattggcataaacgaaagtaattcccttttttggttaacaattcttcacgtttcccccaaattgcttttgtcatatttaaagacgttcctggaagtagtgggaaataaaaaagccctggttgaaatatcaaagccacttcctcatcattcatatccagatgcaaagaccgcttcctcttttaagccacatggctatttttaaaataacagctctgtaccatttgtgagtatcgtaattagtttgagattgatttccaggtttggagttgaagcttcagagtcctggaaaccgggatttaatcctggctgtttattagctatgcgaacctgagtcggtgactgaaagagtagctgccgttagcatcatcatagtcatccctcatgttttgtaacagtgatcatgattctgtttgtcactgatatgtctcttgatttagtcagattttgaaatcgagaaaaatacttgacatatcaacagagcctccatttctctgctctcattatttgaaaccacaagtgaaaaaggttttctccccttgacttaagctgtgatggtctctgttaacttggagaaaggccagtggtctgtacaatgtgcctttatcttttgtctgactgcagtcccctttgagactagatctctggaaagcttggcaccttcagccacggctgcctctgctgaactgttccgtgagttttgtggtgtggtgtgaggtacacagtgactgtttggaggacgtgggtgtgtgcattgtaagctggcctctccagagcctcactgagtctccacaccttccctaggaagcatggaggagcttggcactgggggtcccaggaccagctgtgcttgttcactagttgagaattagttggagaatgttctggaaagcagttcctttaagctggtcccagttatattgggttactctcttcttagtctttggaatttttctgatgaaaaccttttaacctttatactgaacagggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaaggtatgaaataggttaacttgaaatatgtgtttttttaaaacagctttcctgagatataattaagataccatacagttcacccatttaaagtatacatttcagtgttttttagaatattccaggattgtgcaaccactgttactacaatataattttagaacattttttcccccaaacagcactcactgtctgctcctccaagcaatgtgctttctgtctctatagatttggccattctagacatttcatataaatggaattatacagtctgtggttttttgtgactggcttctttcacgtagcataatgtttttgaggttcatctacaacgtagcatgtatcagtacttccttttccttgctgaataaccttccattgtctatatatacaacattttgtttattcattcatcagttgataaacattagagttgttgccactttttacctattaggaataatgctgctatgaacagtgtgtacaagtttttactgggatatgtgtttttaattctctggggtatatcgttatgggtggaattgctgggtcatacggtatcgctatttcatattctaaggaaccagcaaatcattttccaaagcagctgcgccattttgcattcccaccagcagtgcatgagcattccactttctccacgtccataccaacacttgtttcttactgttttcactttgacttcagccatcctagtggatgtgaattggtatctcatagttctgatttgtatttccctagtgacagcgatgttgagcatcttttcatgttgaccgtttgtttgatttggagaaaagtctattcagagcctttgcccatttttaaaaattgggttatttgtctttttatgttgaattataagagttcattttacattctggatacaagacccttattaaatatatgatctgcaactattttctttctttttttttttttttttttgagacggagtctcgttctgtcacccaggctggagtgcagtggcgcaatctcggctcactgcaagctccgcctcccgggttcacgccattctcctgcctcagtctcccgagtagccgggactacaggcgcccgccaccacgcccggctaattttttttttttgtatttttagtagagacggggtttcaccatgttagccaggatggtctcgatctcctgacctcgtgatctgcccgcctcagcctcccaaagcgctgggattacaggcgtgagccaccgcgcccggctgatctgcaactattttctcccattctgtggatcgtcttttcccttgatggtatcatttgcagcacatttgtttttattttgatgtaatacagtttatctcctttttcttttgtcacctgtgcttttgatgtcccatctgagaaaccgttgcctaacccaaggtcacaaagatttactcctatgtttttctcctaagaattttgtagttttggcctggcgcggtggccaaaattacagttggccaccgcactccagcctgggtgacagagtgagactctgtctcaaaaaaaaaaaaaaaagaattttgtagtttcatctctgacatttaagcctgtggtccattttgagtttgtttctgtgtatgttgtgatataggagttcaacttcattagactctcagttctgtttcattgatctatgtttgtccttacgccagtaccacaatgtcttgagtactatagctttgtagtaagttttgaaatcaggaagtgtattagcccgttttcatacttatatgaagaaccgcctgagactgggtaatttataaaagaaagaggtttaactgactcacagttcagcatggctagggaggccttgggaaacctaacaaatcctggcggaaagcgaaggggaagcaaggcaccttcttcacaaggtggcagaaaggagaaggaacgcaggaggcactaccacacacttagaaaaccatcagatctcatgagaactcactcactatcacgagaacagcatggaggaaactgcccccgtgattcaattacctccacctggtctctcccttgacacatggggattatggggattacaattcaagatgagatctgggtggggacaacaaagcctaaccatatgaggaaggagttaactgtgagccagctcctgctgtggctaagggaagggaatcagaaggtggagagacttgaaattgcactcgagagatagtgccttccaactttgttcttctttttaaagactgttggctcttctgggttctttgctgttgcgtaagaattttaggatcagcttgttaatttgtgaaaaaagccagctgggatcttactagggattgcattgtatccccaaatgatttggggagaattgctatctccaggattgtgtcatcgcagagatagtcttgctgcttcttttccagtctgaatgccttttatttctttttcttgcctgattatcctgtaaaaaaaaaaaaaaaaaaaaaaaaaaagtgttacatagaaatggagagagcaggcatccttgtcttgttcctaatcttagggggaaagctaaggccccacctttgtcatcacttcagaggttcctggtgtcactcatgcttgagtgtcctggagttcccacagtgtgaatctggttgcttcttggctgtccctactgttggctcaaaggtcggccttcttgggctggtaaggccccactcagacctgtactgccaaattttcctactattatttcctctccctttttctttgttcctgtaggcacatggctttttgaaggtccttttagtagagtttgggctgggaaaaaaattgcatgcatctgttcaacccattatctttaaccacagtctcttgtttcatttggattgggacggctttcctgtggttatgatttggtgttaagaatggtgttactttttttgttgtcgtttattcggtgacttttaaacttagctgtgtcctaaaaggaaaagtctttccttctctaatgaattcttatgaatgagataccatgttcatggaacacacatgcatccacatgtgtaaacacaaacaatttcaaaaacattgctgcataggacagttgcatggaaacaaatggtgttcaagatgagtttcacttgccttttacctctgtgtgtatttgtctgtgaatcaattctagccaattttaggatgaaaaataaaactaatgctaatatagtgaatgtgtagagattttgaaaacccctgatcctttatcccaattgtaaacaatgttctttttagtacttctgtaataattgctatttctcttaaagccaaagagaaagtaacttttctatcttctgtgattttccagagtttcagattttgaaaagaaaacaagtaatcgttctgagattgaaacccagacagaggggagcacagagaaagagaatgatgaagagaaaggcccggagactgtgagtcctaagattccacggccactaccacacccacacacacgagagtagtccagccactgaattcaaatcttgtgatgggttatttgctttagaaatatagaaatcatgttgatattgaatattatctatctattccttttatatgtccttgtcctgctctgtgtcaattgtagcgagatgtatttcttttttgttgttgttgttggagatggagtctcactctgtcgccaggctggagtgcagtggcacgatctcagctcactgcaacctccgcctcccaggttcaagcagttctcctgcctcagcctcccaagtagctgggattacaggtgcccgtcaccacgcctggctaatttttgtatttttaatacagacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaaggttcactgttgtcttgttcagtgttgtctggtaattgagagaggtgccttcgagtctgcagagagtcttcagctttcggaagttaatgaagccgtgaaggttgatagccataggggcccacgtgaaaggcatttacataaaatattcactttaggtaattaatttattcaacaaatatgtacattgaatgcctattgtatgtcaggagactgagaccttactgttgaaagaagagagaacatttagaaaacagatgaagagaccaccagtgaataatagttccctgttgactaaaacgaattcaacagccagtagcagggaaatatggtctttcaaggcatcagaaactcatttacaaaaattatagagctgccaggaaaaaggctgcacaacaaaaatagttgagtaaactagaaacatacactgggaagagagtatgggggcaagttgttagctggatagataggactgtgctttgacacctctgtggtctatgatctctgaacctggaatagggttcattttaatagcgataaagtcattatcccagtgcatccaaattgattagttcatgctttattaggaaacagaagttacccaaaacttagcaaacctaagtaccaagtatccaaaacattcttttcctacacaatgtttggggtattgtcaaagttggattgattcaccagccagtcttaattggctactaatggttcagcctgttttctcctaaagaggtttgtttaatgtcagatgataattgtacagatatgtttgggatttcccgtatgataggttggaagcgaagtggaagcactgaacctccaggtgacatctctgtttaaggagcttcaagaggctcatacaaaactcagcaaagctgagctaatgaagaagagacttcaagaaaagtaagaatgagagagcaattttatcctcctttgaaatatacatttttacaaagtatactactatataaaaacatagttttttaactatgttatgactaaaagaaaaatagacacctaattaaaatataaattcagaatatactaatgttccagttaatgtgtgagcatgaaatacttgtaagatggggggttggggactggagaactttaattctgccatttaggggcatttgttaaatgtacgagcctgggtaagatctctacagtaaagctgtgagctagttttcctgttactgacttaagctgatgacattgatgtgagtaagcataaagaaagatgaaaagagcataaagatcttgagtgacatttatttggaaaaaggtcaatttcaatttgttatttcaatcagttaattatttcaggctaacatgtagattgagcgtttggcatttgcttgtttctcttgatgtaagaagttacccaaaacttagcaaacctaagttgatgctgttctattggattcattggcaaacatgtttctagcacaatacggaggtgtgtgtgttttcttgaggttataattcccaacactctgtagaattatggtaacgtgatacaacatggcagctacaactaaggactttggacaaacagacctagatttaacatatgagtctgcaacttatttgtgttgggcaaggtatttatttcaattctctgagcctgtcttggcatttgtaaattgtgtgttgtaatttcttctatatacattgtgttaaatgatatgtctaatgggctgggcattaatgctttgtgcatagctgtcatttatttgtattatattgaaatcctctttccgatctttaagaagacttaggggaacttcctttttcccttattgaatctttgtcagaaactaaagtctttgcaattgacagaacctataactttttttttaatataaaagatatccacacatcactacatgagaagcgccttagctaattactactgtggtctgtgtttaaatactaaaaatgtatctgtatgactagtttaaacaattattcaaagaggacagtactgcatgtgagcttagatctgtacttttttatgtttaggcgtaagggttcagaaatatggccaggtctagtgaagaagcaaggaggattatgtatttcattttgcattcataaaccctacagccctaaaattcttatattgtacataaccttggggtttgtttaaaagccactgcgacgtaaaggagcattgtttatcctcatgaaatcttgacctttcttaggtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtgagtatgttgagtcagaagggcagcgacggggcagaggagggagaatcgcctttttatacagattggaattcggatttgagaataaattttaaaaaatttctttttcacttatctgaaggagtcctagcagacctctcagagagggggataaaatttaaaagttttgtcataataaaattatgctgattgtttgcactctgtcttgatttttcagaaaagattttttttgagagtaagaaatgctagtaggtcgtggggtgataaaggtaggcgagaagatttttctactggagtgttcagaaggttgggaggcaagactataagtttctatgatattttccccaggattccattttttaatatcttttttaataggtccaaattaactgtgctacagatgacacacaacaagcttcttcaagaacataataatgcattgaaaacaattgaggaactaacaagaaaagaggtattcactgaaaaaaattacttccatagcctagtaatgaacagaaactgttgaacgttttgtatataaaatagttacatgaatccttcactaaatctggtttcaaaggttgttttccaatgtatcattatttcttgcatctagggtttgtaacttctgatgttccacatatgtgtaatgtgctttattgcgtacaaagatgatgtgaatgtcctatggtcagggattaagcacttcgtatttctttttttttttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagcacttcgtatttctaaggataggtttgtaggagagctaagagcatgggcttctatgggtaggaagggccatctgctctggggaattgtgcaagaccagcgtgcctgctgtcagtgaatttgggaccctggaatcatcagcctgcagtttaaattcataataatggaccaggtgtggtagctcatgcatgtaatcccagcactttgggaggccaaggctggaggatcatttgaacccaggagtctgagaccagcctgggcaacagggaggccctatctctacaaaaaataaagagttaaccaagtgtgatgttcgtgcctgcggtcccagctccttgggaggctgaggcaggaggatcacttgagcctaggaggtcaaggctgcagtgagctgtgatcacgccactgtactccagcctgtgacagagtgagaacctgtctctaaaaaaagaaaacaataaataaattagtaataatgccagcatggtgtgatagtttagagaccacagaagcttgtgaattagaagggatctttgaatttttagccttgtaaatatactctttgtttttcatttattttcttttaaagaggaggttttgccatgttgcccagaatggttttgaactcctgagcttaggcaatccacgtgcctcagcctcccaaagtgctgggattacaggtgtgagccatcatgcccagcagtagtgttcctctcttggacctaataattttaaatttaaaacatgtttcttcttttccactgactgcaggaagtaacaagtggcaaaataacagtatcaacgagtcacagccttattaacattggagtttgttattgtatccctgatttcggtgttatcaccttttttttaggaattcattatttgcaagccacaacttaaatacaactttctgaataagttagcgttgctgattaatagactggttagagctgatacattttttagatctcgctatgttgcccaggcttgtctcccactcctgggctcaaacgatcctcccacctcagcctctcaattctaggcatgagccaccacacccggccagagctgataattaaaaaaataaacctttttctaatattttactaaaacaggcagaattatttcaaaaccatttctagaataaatgtttctttttcagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcaggtgaggcaccttccaaaaccccagctgagcgaggccagccctgactgtattctcgcattggaaagcaatggtgtttagaatgtttgtaattttctattttatatattttttcacccgtgagtgtattaaaactttaaaattgaaacatttggaaagtgctcagtggatcttatctgttctacatttaataggtaattggattctttccagtttgtggcattatgattaacgttgctaagacattcctgtgcatgttgctctgttcacatgtggatattttatatttctgttgggtacacacctaggagtggagtcgctggatcataggctctgcatgttactcacttttaacaggtaatgccaaacagttttccagagtggttggaccagttttcactcccatcaacagagagtttccatggctctacatcttaccaacacttctattatcagtcattttcctttaaccactctggagggtatatagtggtatctcatttaatttgcatttccctgatcactaatgggaaagagtactttttcaagtgtttttggcctttgaggtatcctcttttgtgaagtgccttatcaagcctgccttttttttttttttttttttttttttttttttggtttggtttgcctggcattttttttgagacagagtcttgctctgtcgcccaggctggagtacagtggtatgatctcggctcattgcaacctctgcctcctgggttcaggtgattctcctgcctcagcctcccatgtagctgggactacaggcatgtgccaacatgcctggctaatttttgtatttttagtagagatggggtttcatcatgttggccaggctggtctcaaactcctgacctcaggtgatccacccacttccacctcccagagtgctgggattacaggcatgagccactgcgcctggcctggctttttaaaaaaatgtaatgacttctatgtatactgcacatacaagtctttgtcagttatttttgccttttcactctcataaaggtgtcatttgaggaacaaaagttcttagttttaaggtagtccagtatatcagccttctcatttatgattagtactttttgtgtcctgtttaagaaacttttactaccccaaggccaggaagatattccctctgttgtcttctaaaaattttgttgtcttaccttttacattaagatgtacaaaccatttgaaattggcttttgtctatagaaaatgaggtaagggtaaatatttatttttttcctatatgaatatccagttaacttggcaccatttaagccatcttttcttaagtgctctgctgccctcttcatcataacttgtgtccatatatgcatgggtctgtttctggattttgttctattttattggtctactcatatatctttgctctggtaccatgctgtcttattataaagcatcaaactttttttttttttttgagacagagtctagctctgtcaccaggctggagtgcagtggcacgatcttggctcactgcaacctccacctcccgggttcaagccattctcctgcctcagcctcccaagtagctgggactacaggcgcacaccaccacgctcagctaatttttgtatttttagtagagatggagtttcaccacgttagccatggtggtctcgaacagttgacctcatgatctgcccagctgggattacgggcgtgagccaccgtgcctggccagcatccatttgaatggttggatcatgagttatgtccatttctcagttaaataaatattaccaagctgtcttctaaaactgcctaaccaaaattatactctcaccaaaagataagcactcctatgtcctcacattcttgcattattttaaaaaccttggccaatctgatgaacatattatttttaatataataatgtcagcagtttgttattccctacatacagactcattatcaccagctgcccagagtggctgacccctgtgaaatgcagccagttgactggtacttatagctttagttttatttctacaggaatagagcctcaacctgcattctcagctcttcagagcatttccttgcttgggtaactcatgtcattgggttcttccactctgctgcagtcatgtatttttgctcattctagacatagacatttgttttctcttgatggatactcttgctcattcattcaataacttcttttttgagcacttataatatgtcagagacggccgggcatggtggctcacacctgtaatcccagcactttgggaggccgaggcaggcagattacaaggtcaggagttcgagaccaacctggccaatatggtgaaaccccgtctctactaaaaatacaaaaattagccgagcgtgttggcgggcacctgtagtcccagctactcgggaggctgaggcaggagaattgcttgaacctgggaggcagaggttgcagtgagccgagatcatgccactgcactccagcctgggcgacagagcgagactctatctcaaaaaaaaaaaaaaaaaaaaaaaaaaaaatcagacactgttcttactgcctgggatataggaatagacaaaacaaagactctgttcttactggctcaaagctagtaagtgatagaagtgagactaaatcgaatttaagtcatactccaaaacacccatgatccactgccaacactgtgagatgctgaaccactcacattgataggatatcccttaaaatgatctctttattacatacttttaagtaactatagttttgatagaatatttagatttttaattttacttttaaaataatggataataatttatatctcagaaccagcaaatttgaaaagaaaaaactaattttaaacatagaaagtgaaaaattagtattaaattccaataccaatggaacagttcactcaattagctgacagcattaaatattaaaacactattaagtgttttgttatttataattttttaaaaattacttaatttttaaaatgttgtgttgttttgttttttgaggcagggtcacactcctgtcacccaggctggagtgcagtcgcatgatcgtggttcactgcaacctctatttcctgggctcaggtgatcctcgtgcctcagcctcccaagtagctggaactacaagtgcatgccatcatgcccagctgattttttgtatttttagtagcgatgaggttttgccatgttgcccaggctgtcagcaggaggcctcagttcctcaccatgtggtctcctccagagggatgcttgggtgccctcatgtcatggcagctggcttcccccaaagcaagtgatccaacagagagcaaggagtgacagcgtcttttgtgacctagtctcagaagccgtacaccatcacttctgcggcatcctggaggttacacaggttgggtttattcattgtgggagggaaacatacaaggtgatgaataccaagaggcaaggatcactggagccatcttaggaggctggtgaccacacatgggacatggattgaatatggaaaagttcatgggaaatggtcttctgtctggttcaaatgctgatttggccacttaacaaattttcccaagattaagagccgttaagtttgtaaaatgaggatagccattctttattctcaggatatttcataaggtaaaataagatagtaaatgtaaagcacccaacataggacctcacacatgtttggaatttaacaaatagcatctatttgtgatgattattcttttaaatttagcttaagaccagccttcataaatacacctggcagaatcaatttactatattaagtaatcatttactatattaagttgatcctgaattgtttattatctaaaagtccagataattttgctgaattaatggtacctacagtatttaaactacctatatcagtgcagttgcaggatttgtgttgtttaaagcacacacacaaacacagcttgtatctgctatcggaatgtacctggaaagtcatggtcattatactgttttctagcaggattgtgcatctgtgattcacaagggctattgaaggatacagcactacctcctcatcgcataaacactgtaagaatctgcattcatctaggtactaacttctgtatctttttttcctctaacagatggaagtttactgttctgattttcatgctgaaagagcagcgagagagaaaattcatgaggaaaaggagcaactggcattgcagctggcagttctgctgaaagagaatgatgctttcgaagacggaggcaggtaaggaaaagagagaggaggacccagagctcacatcagcatggccgtagaagaggtgcctgtccaaagacgttcctgatttgaactataagaatagctgtgttcgcgccactgcactcctgcctaggtgacagagcgagtcccctgtctgaaaaataaataataataataataattgcttcacttacacttcatgtgatcatgttcccaacacttagtttgtcttacaggaaagcttgacagagacttgtgggagcttgatcaagctccttgcttttagataagcaaggattttgatttgattttaaaatgttgtgttgttttgttttgttttttgaggcagggtctcactcctgtcacccaggctggagtgcagtggcatgatcatggttcactgcagcctcaacttcctgagctcaggtgatcctcgtgcctcagcctcccgagtagctggaactacaagtgcatgccaccatgcacttgtaacaataatgttacgtgtcccaatgacctatcttgccatcgtcacggatgaaatattcgtagcactttaaattcctgaatattctttaaaaaatactaacaaaaattacttctgacttttagaaatttattttgagaaagttttaaaacacagcaaaattcagagaataaaataacagactctactatgtactccttcctgcattgacaactgcttttatttgcttcaagtattttttttttattaaaggaaaaagggagttgtagttagaatcaaagtctcctttgttccccatccatcattatattcctttcttctttaccttgtgctgttaggaatttggtgggtagcttccccatctattttatacttttacatatcacatacacacttacctatatcatatctcaaaaccagataatattgatttctctgtgtttaagttacaaaatgatcactgtaggtattgttctgcagcttactttacataatattatgattttgagctctcttgatatgtgcggatgtaatttattatacttcattgctgtattttgatttataaatatgccacttctttctaatctgtttcctactgatgacagtttggttatttcctgattttttttaactgtaattatttactttcactagtctcctagtgccaatagtatttaaaactaaaattagtctggtttttatgaaccttggcagtgtagtttgagtcttttttcccctacttctgtggactgtctgctcagtgttgtcatgtttcggggttgtagaacatcacacagcgtgttgcttttcgtcctggcaggcagtccttgatggagatgcagagtcgtcatggggcgagaacaagtgactctgaccagcaggcttaccttgttcaaagaggtgagtcccgtgtgatcctggattttcaggaaatagctatcctatgaaaaagatgcttgaagaaaaattccacttcattctctacaatggattccaaatcaaggcaccaaaaatatagcacccgtcagtctcattaccacagcactcccatctccatccattacccaccgaatccagaccagacccttcaccctgccagaaggtgcctggcacggccacactttttcttttttttctttttttttgagacagaatttcgctgtgtcgtccaggctggagtgcagtggcgagatctcggctcactgcaacctccacttcctgtgttcaaacggttctccttccacagcctcccgagtggctggaattacaggcgtgcaccgccacacccagctaatttttgtatttttaatagagatggggtttcaccgtgttggccaggctggtctcgaactcctgacctcaactaacctgcctgtctcggtctcccaaagtaccgggattacaggcgcaagccactgtacccggcctacagccacacttttaaaccgtgtctccctctgttctcttacagacattagccagactgaatcatccccttgaacttgtcctaagcttgtatttgcttgtattatgcccttcacagagacgcccttttcttatgcatattcctgtcttcctccagtctctttccagtgacctcttaccccatctttaaaatctatttcaaactccatctccatgaactgtttccattttgaacttccaaagtactttattcctctatgttggtacctgtctgctattttataggtgtttgtgtgttctaggtagatacttaagtactttatttttatttctatttttattttgagacagggtcccactctcttgcccaggctggagtgcagtggcatgatcgtggatcactgcaacctccgcctcccgggttcaagcgattctcctggctcagcctcccaagtagctaggactacaggtgcacgccaccacgcctggctaatttattttagtagagacagggtttcaccatgttggccaggctggtctcaaattcctgaccccaggagatctgcccacgtcggcctcccaaagtgctgggattacaggcgtgagccaccacgcccggctaatttgtattttcagtagagacagcgtttcaccatgttggccaggctggtctcaaactcctgacctcaggtgacccacccacccaggagaggtctcctagaacagaatgtaccttctcagaagcagaggcaatggtctcatttattcagcagatacttttgagtcctccaggatgtgcaagaggtactgcttatgctgggagtcagagagcaaaggcagccccggatgctgacccctcttctctggcaatggggtgattagaaagctccctgctttggaaaccatgctttatgatcaatacatacctcttcagaaatgcttcttaaggctgctgaacacaatctcaaatattcatacatgttactacatccaagtaatgtacttagaagcaaataaaggttgcctccaaaaacaaacattttgagagccaaaccaaagtctaggctgagtccaaaaaaccaagacggtttgcattggtccagaaaggtcagaacagagagatgcccgggagccagaaataatttcttgcatccatcacagtttgtatggatccaggacctagctagggtcagggcttatttcgaacatgctctgattgaggcttgaacctcagtactactccaaaactgggggaaatgatagggtgcattcttccatcattcctccttgttaactttatgtagataactcctgttcattctcaaggcccctctcaagttaattggtcgcatctaggaggcctttctgcaccaagatctaaactaggggcccttccctttctcccatggacacccttgcacctaacactcacctggcctaacactcgtgcctaacacttttgccacgccactgctgccacatctctcacctggcttctccaccacgtctgtctcccggcacacagcagtgtctttatacatcccagaggattcaaaagtgtctgctgaacaaatgagatgattgcctctgcttctgggaaggtacactctgttctaggagacctctcctgggctctgtggatttctttctccacattcccttcctcttttgcttatatcctcattcatcccttttcttctcgcagatatcctagtatttactagaacatgcattgtcctgtacctagaactgaaaccatgtattttcgcataccttgaaactgggatacagtttaaatcctaaaagaatgcaccaatgcacctgtaatcccagtacatgggaggctgagatggaaggatcagttgagaccaggagttcagaaccagcctgggcaacatagtgagatcccatccctacaaaaattttaaaaactagccaggtgtggtggcacgtgcctgtagtcgcagctattcaggaggccgaggcaggagggtcactggatcccaggagttagaggctgcagtgagctatgattgtgccactgcactctagcctgggagaaagagcgagactccatctgtcaagaaaaaaaagtaaagaaaagaaaaaaatcctaaaacaggccaggcgcagtggctcatgccagtaatcctagcactttgggaggccaaggtgggcagatcatgaggtcaggagttcgagaccagtctggccaacatggcaaaaccacatctctactaaaaatacaaaaattagctgggcgtggtggcgcgcacctgtgatcccagctactcaggaggccaaagcaggaggatcacttgaacctgggaggcggaggttgcagtgagccaagatcgtgccactgccctccagcctgggtgacagcgagactccgtctcaaaaaaaaaaaaaaaaaaaaaaaatcctaaaataatagggaagcaggtatcacttggagagatttttctctatgtgcatcgtgatgacttcagttaaagaccaaacacctgtgctcatgtcccactacgtgttgaatacgaagttgaactgatgttaaaactcgccatctgttcttcaagtgaaacaaacacaactgcctgcaaaatggaactaatggaattatcatacttattcccaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcattt

SEQ ID NO: 36067 - DNA, 38828 bp, Homo sapiens; identical to SEQ ID NO: 36066

SEQ ID NO: 36068 - DNA, 13391 bp, Homo sapiens
cccgtcgcccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctatgagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctgggtaaggcgcaggggcagacagggacggacgggagcggacggggttggggtcgccccaacagtgggcacgggagctaagtaagggtttctctgctgcttcagtgaagcaggaggggctgcgctttctggagcaagagctggagactatcaccattccggacctgcggggcaaagaaggccacttctactacaacatctctgagtaagtggggggcggggcctcgcgatccggggcggggcctcggcggtggaggcggggcccgagaaatctcagggtctcgggagactggaggctgagtgggatggggcgtggccaaatcgatgaggcaagacttaagaaaccggatggggccgaaaagataaaggccaagccagtcatcataggcgggaccaggcagatgggcgtggccttgaaaatgtagagggggccaagaaggaagcaggaccagtggatgtgaggcgtggtcgaagaacaacagaaaggtggagtcaaggaacttcccaatagatgagagtggagtctcgggcacggggtggagttaatcggaggggtggagaaactgaaggctctaagtatggtttaggatgagggagggggaataaggaattgagatgtgagacggagcttaggtgatggaggcaaagtgaacggactctattaaaagaccgggtgtagcaaccccagggtgtgggaggggagggggtgcaagcaaacaagactttttttttttttttttctgagagggagtcttgttctgttgcccaggctagagtgcagtggcgcgatcttggctcactgcaacctccgcatcccgagttcaagcgattttcctgcctcagcctcccgagtagctaggactacaggcgcgtgccaccacggtctgctaagttttgtatttttggtagagacgggtttcactatgttggccagactggtctcgaactcctgacctcaagtgatccgccctcctcggcctcctaaagtgctgggattacaggcatgagccaccaccgcacctggcaaacaaacaaacaagacttttaagcgatggggtgaagctcatttttaacacctggatcaggaagacctcctctctcagccacccaagttcaactttgagccacccaagtctaagttgggcacttgagggacaatggaagaattcattccacccactcccgcttccccaggcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttgtaaggacccagcaccctcaggggagtggagagtgggtcaggagggctggaggtgctgtggggctgtgggcagcccccttagccttcctgagtttccgtttcttcatctgtgtaacagaaacaggcatatgcatttcatacgagttgataggaaggtttggtaggatgtgtggaaagaggtgaaaccttattaagaggtatggtgatgcatgggggcactgaagactcaattgagctcctacctggagtgaatattaacccccctggcagctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagtaagccccagccccaaccccagctcacccttttcgagccccacagctcatctgcctagcgcaatgcaaagtgcataggcctgggaatcagaccaactgggtccaaagctcagctctgtcacttcctggctgtgtgaacgtggccaagtcactgaagcttggtgcctcaatatcctcattttataagatcctattttataagatcgttgtcaggattatttgtgttggtatatgtaaaaaatatttagaacaaggctggctgtggtggctcatgcctgaaatcccagcaatttgggaggtctgggcgggcggatcacaaggttaacagatcgagatcatcctggccaacatggtgaaaccccatctctactaaaaatacaaaaattagctgggcgtggtggcacgtgcctgtagtcccagctacgtgggaggctgaggcaggagaatcgcttgaacccgggaggcggaggttgcagtgagctgagatcgtgccactgcactccagcctggtgacagagcaagattccatctcaaaaaaaaaaaaaaaaaaaaatttagaacagcacctggcatatgataaatgtatatttaagtgctggccacttagataagagtaactgtgaggactatctgatatgcacatttggccatgtactggattctcaataattggtatctctaaataataataacaaaaataataattttttttttgagagggagtctcactgtgtcacccagcctggagtgcagtggcgccatctcggtttactgcaacctccacctcctgggttcaaacgattctcctgcctcagcctcccaagtagctgggactacaggcatgcaccaccatgcccaactactttttttgtatttttagtagagacagggtttcgccatattggccacgctggtctcaaactcctgatctcaggtggtctgtccgcctcggcctaccaaagtgctgggattacaggcctgagcaactgtgcccggcctatttttttatttttgctgctgagaaggggatattgttcttgttctggaagaggatgggggagagaagatgatggattataacctggtgttggtacactgtcagtattatttattcatcaaacaaagtgtatgccagtccctgaggatgcaggaaggagctcagagcctatctggagcaaaaaacatttgatatcagggcctggagagaaggactaagaaaatgctttggggattcagaggaggggaatctgggaagactgcctggaagaggaagcatctgagctcagatgggaaaatacagagtaggaatgcagagggcggaagggagggcatcagtaagccgatggatgtggggatgctcagagtgggtttgaggcaatgtgggtggattcatttgactgatgggaccagagagtaggtcaggaggtcttgagaattagactggagagggaatttgggcctggttcttggaaaacctacgtggaggagctgttattcaggctgaagctgaggactcctactgccactatttccctagtcactgatttctcctggacctggactggggtggaggcaggttctgggctcatccggcctctcctctcctcacaggaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctggtgagttggtggcgggtgagtctgggtgtgcagctgtcatgcagcacctcagagcaggccccttccgagccctgctgttgaacagtcctgggttcaaatgtggcccctggagctgacttgttgtgcgattttgggtgaagtgctcatttctgtctgggcaaagtgcttgtttcctcacttggctggcagtgcctcctcctggggttgctgtgaggattatctgagagaatagttgtcaaggtcctcaatatgtgcatgctgatcactggcatcccatttgtcttcatcacctagcatctaataggtgctcaattaacatgaattccctttttctttttctttcttttttttttttttttgcacggagtcttacagtctcactctgttgccaggctggagtccagtggcgcgatctcagctcactgcaatctccacctcccgggttcaagcaattctcctgcctcagcatctcgagtagctgggactacaggcgtgcaccaccatgcccaactagttttttgtgttttagtagagacggggtttcaccatgttggccgggatggtctcgatctcctgacctcctgatctgcccaccttggcctcccaaagtgctgggattataggcatgagccactgtgcctggccatgaattccctttttctaagccatgacctctgtctactgtggggcaaaggtattttcccatcacacctaacacacaggcatgggaagcgaaggaggaggtaggagaaaccaagggaaaggaacctcatgccatcttttttttttttttttttttttgagatggagtctcgctctgtcacccaggctggagtgcagtggtgcaatcctggctccctgcaacctccacctcccaggatcaagcgattctcctgcctcagcctcctgagtagctgggattacaggcgcccaccaccatgcccaactaatttttgtatttttagtagagacggggtttcaccgtggtggaccaggctggtctcgaacacctgacctcaggtgatccgcccgccttgacctccctaagtgctgggattacaggtgtgagccaccatgcgcggcccccccatgccatcttgtttagttatttttttgaaacctctatagtggtagtaataataataactaacattaatgagcacctaactacacaccaggccctaagtgctttccacataaaactaatttgaccctcatgacaaccctgtgaaggatgtatcctcattttatgggtgggcctctgagcctggagaggttaagcaccttatcccacatcacacagccgtgagtgacttgagccccttcctgcagtgcgcagttctgtggacgagcttgttggcattgactattccctcatgaaggatcctgtggcttccaccagcaacctggacatggacttccgggtgagctgcttgggctggtgtatgacctctgacttcctaacaagacctctttctctgctaagttgcaagattttacttcttaaagcacagctctgatgaggccactcccattactgagaatgctatggctccctgttactacagaattaggttcagcctcctgggtctggcatttgagcccctgttaatcttacctggccccaccttttatatctcatcctgtttctttgcagctgctctttcccaaattggaccctggcttcccacctcagggcctttgctcatgcacggcctttccccaactcccccgaaggagctggacataaatttctatacaaataatctcatttcattctctcacaaccctgtgagtcaggtactaacatcatcctaattttaggaatgtggagacttactcatagaggtgacgtcacttgcccaaggccacatagccagtgtgtagccactacctttggtctcccagaggagtatagcagtttcagagtgcagactcgggagctagaatcagtcgggtgcagtggctcatgcctgtaatcccaatactttgggaggcccaggcgagaggatcgcttgagcccaggagtttgagaccagcttgggcatcatagtgagacctccttctctacaaagagaaaaagaatgcctgaagttcaaatcctagctctgccactgactagctgcacggccctaagcataagttttcagttggccagtttcctaacatgtaaatggaaataatctagtaagaaaacacacgttgttatgcagattaaagaagtcgatctatgtgaagagcttagagtacttggcaaagaagcatgagtatgcacaatatatgtaaacagtagctgttgttactgcctctagctttcaaggcccactcagatgtcacctcttccctgaaacctttcctgaccctccctcctccagtctgacgggctcgccccctggtagcaggtgtcctccttccaatgccttttaagagatgtgcttgtgaatcctccaagaacagcagctgggttcccaccatccccccacagtgcctagcacggggctgggagacacctgctgtcagtccaggtgccaggccagtctgccttgaccctgactgtgaatgccccaccccagggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtatgtcatggcctgtttgtgggatgggcaagagaaggtctgtgacagagctcactccctcactcctgattcccctgttcaggtgccccacgacctggacatgctgctgagggccacctactttgggagcattgtcctgctggtgagtgctggcgggggcagggatagggccacctgcacaccagtgagaccaaggaggggtgcaggtggggcccccagtggcagccacgcagacagggccctggcctcttgtctgtggccaatccccctcgccttgtcatggctgttcctgtctgtgaagcggtctgctccttcctgctccttcctgccccatctccttcgcagagctgctgtgaggattagtgagaacccaagctttgcaagtgtgagggctttaataataattcacatatacttttgtttatttgtgtattggggaggagagtaagagttacacattttatttatttttttttttgagacaagagtctcactttgtcacccaagttggaatgcagtggcacaatctaggctcactgcaacctctgcctcccagggctcaagccatcctcctgcttcagcctcttgagtagctggaattacaggcttgtgccaccacaccccgctaatttttatattttgttgagacagagtttcattatgttgctcaggctgtccttgaactcctgggctcaagtgatcacccatttttggcctcccaaagtgctaggattacaggtgtgagccaccgcacctagcagaattacaaattttaaaagaaataattcagtcattatcatcatccaatttatggcagggcagggtctctattgtcagactgcctgggcttcaagcctagttctgaaactgagtaactacataacctctacaagttacttaacctatctgtgcctcaatttccccatctcaaaaatggggatatggctgggcatgatggctcacgcctatactctgagaactttgagaggtcaaggtaggaaaattgcttgagcccaggagtttgagaccagcctgggcaacacagtgagacactgtctctattgaaaaataaatttttagtcagatctttttttttcggtggggggacaaagtctcactctgtcacccaggctggagtgcagtggcgcaatcttggctcactgcaattgaacctcccgggttcaagcaattctctgccatgacgactcagcctgaaaaataaatttgtaaaaaataacaacaacaaaattggcagtaataatatcggcctcacatggttattatgaggtttaaaggaaccaacacatatacagtgtttagaatcatgtttggtgaagattaggcagttgcatcttatagtattccttcactgcctatagaagaaggcatagcagtttagagaaagaagatatggccaggcacggtggctcacgcctgtaatcccaacactgtgggaggctgaagccggcagatcacttgagcccaggagtttgagaccagcatgggcaacatggccaaaccccgtctctacgaaaacacaaaagcaaaaaccaaaacaaaaaacaaatacaaaaataagccaggcgtgatggcatgaacctgtggtctcagctgttcaggaggctgatgtggcaggataatttgagctgaggaggttgaggctgcagtgagccgtgatcatgccactgcactccagcctgggcaacagagaccctgtctcaaaaaaaaaggagagagagagcaaaaagatatggcaaggggtttgggtgtggtggctcatgcctgtaatcccagcactttgggaggccgaggtgggcgaatcactagcctggccaatatggcgaaaccccgtttctattaaaaatacaaaacttagccgggcatggcggcaggtgcctgtaatctcagctacttgggaggctgaggcgggagaatcgcctgaacctgggagacagagttgcagtgagccgagattgtgccactgcactccagcctgggcaacaaagtgagactccatatcaaaaacagaagacatggcaagggctgagatactaatgcaaaaaggacatccacaaagagtctggattggagatagacctgaatattgagatgtatttaggaagcagaaagagaagaacacattcctgtttctttgtgtggcaaaggcatgaaggctagatgcagatgtgagagttttggaagccagagctccctctgtatttgcaatatgagagtccccagaggacagaagctgcacctgccttccttccccttcttccctgggggctccaaaggaaatggcagggacttgacccgcccctgctgctcatcccccagagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggtacgggtcccagagtgggggctgctggctgggggtcagggaaaaatgggctgtgggttactgaccttctgggtcagtaacatcctcctccccatgttcctgcaggacgcccgtctcagcgccaagatggctctccgggggaaggccctgcgcacgcagctggacctgcgcaggtaggcaggcgcacttccctgcacctcagtgattggaggacaatcacacctgtccacagggatgttgcgcttaaagtacagtgatacctgtaagccactgagagctggggtctgtctttgttaatgcatgccaaagtgctttggtaaagtctgactcctctgcattctcacatgtcccagaggcaggcagggcaggtattatgagagatgaacaaatgggtccagcaatgttaaataacatgcccacagtcacacagcaaagatcagaacatgggttttgacaaaaacctcagcacaacacagctttgtgaccttgaggccattttatcttttttaaaaatgttattattcttttttttttttttttgagaaggagtttcgctcttgttgcccaggctggagtgcaatagcgtggtcttgactcactgccacctctgcctcccgggtttaggcaattctgcctcagcttcctgagtagctgggattacaggtgtgcgccaccacgcccggctaatttttgcatttttagtagagacagggtttcaccatattggtcaggctggtctcaaactcctgacctcaggtgattcacctgccccggcctcccaaagtgctgggattataggtatgagccactgtgcttggccttattttattgtatttatttatttttgagacagagtctcactctgttgcccaagctggagtgcagtggtgcaatcatagctcactgcagccttgacctcctgggctcaagtgatcgtccagcctcagcctcccgagtaactgggactgcatgcatgcactaccatgcctgactattttattttttgtagagatggggtctcactttgttgtccaggctggtctccaattctcgggctcaagtgatcgtcccaccttagcctcccaaagtgctaggattacaggcgtgagccaccgcacccagcccattttgtctttctaggcctcattttctccatgtgtttaatacaggcaaaagtagcatctgccttctagggctgtgctatccaatatggtagatactagccacatgtgactatttacatttaaattaattataattaaatagtttttcagttgcactaagccacatttcattagccacatgtggctagtgactaccatagtagacggtgcagatacaaaacgtttcacagaaaatctgactggacagtgctgttctaaggttaaaggagataatgtaggttaggaccctaggttctagaggcagcttctgacactttccagctgtgtgacttcaggcaaattacttaaccttgcagggcctcattttcctcatctataaattagtgcaaatcctaatagtgcccactccttgggcttgttttgaggactaaaccagttggtactgtattttaaaacagtttactaatattaactttttaaacacgttggctgggtgcagtggctcacacctgtaatctcaacactttgggagaccaaggcgggtagatcgcttgaggccaggagttcgataccagcctgagctacaaagtgagatcctgtctctacaaaaaaatttaaaagttagttggtcatagtgatgcacgcctgtggtcccagctacttggaagcctgaggtgggaggctgacttgagccctggaggtcaaagccacagtgagtaaaattacaccactgccctccagcctgggcaacacagtgagacgctgtctcaaaaataaataaaaataaaaaaagaaaataaatatgcttagtgtctgacaggaactaagcaatgtgaagttttgttacataaaataaataacacctgcaaagctaccagcagaagtctggcacattagaagtgctcaataaaggccgggcgtggtggctcacgcctgtaatcccagcactttgggaggccgagacgggcggatcacaaggtcaggaaatccgagaccatcctggctaacacggtgaaaccccgtctctactaaaaacacaaaaaattagctgggcttggtggcgggcacctatagtcccagttactcgggaggctgagccaggagaatggcgtgaacccgggagacggagcagtgagccgagatcgcgccactgcactccagcgtgggcgacacagcgagactctgtctcaaaaaaaaaaaaaaaaaaaaaaaaaaaagaggtgctcaataaataaaaagtagcagtcttggagaaaaggagacccaagtggcagcaatgactgccccgaggatacctggaaagttgtagcacttggaaaggtgcctaggtgggcatctgagcctgcaactcagacacctctggcaggtaggcctgggtggcctgaggaaggggagcttccaggcttcctgcccacagggctcctttctttcccgcaggttccgaatctattccaaccattctgcactggagtcgctggctgtgagtggggaagggtgggtgggctgggctgggttcgtgagatcctgaccctcaccatccccccctcctcatataactgctcacctgcgggcagctaaaggcaaacccaaccctgactcactgccctgtttccgccctcgcccctcccagctgatcccattacaggcccctctgaagaccatgctgcagattggggtgatgcccatgctcaatggtaaggctggggtgtgaggatggaggaagaaaggaggggtgaactgggcgggcccagactgagcggggtgctcccacccacagagcggacctggcgtggggtgcagatcccactacctgagggcatcaactttgtgcatgaggtggtgacgaaccatgcggtgagtgggggcaggatggggaaggagggagggccttcccctctctctatagctccccagtgccctccattacctgaccccagctcccccattaccagtcgcccctcccattttaatcttagactcctaaaagccgttgcacacactgtgacttcttggagcactcttctcccatcccaatacctactaattgttcaggtcttagctcagaggtcacctcctccaagaagccctccttgacacccatagtctacactcctacagcctcattttaacaccttgacatggaattatccattagattgagttcctgaaagacaaacactctgtctcttgatctctaaactctggcctcaataactgaatgaataaatgaggctcccctctccccaacacagggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctc

SEQ ID NO: 36069 - DNA, 15303 bp, Homo sapiens
gcgcagtgcatcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggtgactcgtggtgactttgctgccgcttggcaagggtcagggattgggcccggtgggggtgggggccgggcatccggggcgcgccagctgcaggcaggggtgacccggggggcagccggctcgctccgcagccccgctgcctaaaggtgtttagttgacccctgacgggaggccgggtgacctcgtaataacgagcaagagcactgactcgagtccagcactgctgggctgccgcttaccgaaactttggacaagtctcctagcctggctcacactcacctgcaaaattgggatcctggtctctaccttgcggagtagcaatgaggattagatgagttaatgcggctagagcacctcgtacggtctcaaaatagcggtcaccgtattgtagtgaaagcagcatgcaaagaggcagccacactggcctacagccttctccagagcggttttctctctgcagttctgtccttactcttccctgcagcaccttctgcctgtgtccaggactcctggaagtaattctaggaaacaagccaagtgacctttgaccaataaggatttgaattgcgcgggtccacttatatgcggattttttttcaaccaaacgcgaccagtatttacgggatgtgccgccccgcgtataaggagggcaggctcttcctataagcggattctgcaaggctgactgcgggacgtgagtgtgcggggatttgggtatagtcgggggtcctggaaccaatctgcgcaaataccaaggaacgactgtacctgtagtatatagcttgagctgatgaaatctgcgtgaggctgaaacgccgggaggcagtgatttcggtgttgttgttgttgtttttgagacagagtctcgctctgtcacccaggctgtaatgcagtggcgtgatctcagctcactgcaacctccggctaacggcaacctccgcctctcaggttcaagcaattctcctccctcagcccccccgagtatttgggactacaggcgcccgccaccatgcccggctaagttttgtatttttagtggagacggggtttcatcatattggccaggttggtcttgaactcccgacctcgcaatccacccgcctcggcctcccaaagtgctgggattacaggcgtgaaccaccgcgccctgccttttttttgttgttttctaagttctccagatgactctgaagtgcagttgggaataaaaataaccgtcttaaggtaggatagactcccaaggtcaagttatgaaaccccttttcaaagtcatagacttcaggtaatagtggtttcaaccttgactgcatgttagtgtgaaaaataagtgtgtctggccaggcgtggtggctcacgcctgtaatcccagcactttgggaggccgaggcgggcgaatcgcttgagcccaggagtttgagaccctcctaggcaacatggtggaaccccgtctctacaaaaaatacagaaattaggccgggcgcggtggcttatgcctgtaatcccagcactttgggatgccgaggcgggcggatcacgaggtcaggcgatcgagaccattctggctaacacagtgaaaccccgtctctactaaacatacaaaaaattatccgggcgtggtggcacgcgcctgtagtcccagctactcaggaggctgaggtgggaggatcgattgaacccaggaggcagaggttttagggagctgagatgatgccactgcactccagtctgggaggcagaccgtcttaaataagccagccagcccgtgccagatcgacagaatctagaagtgagtactaggcgactatttttagaagtcatcaagtgtttcttttgtgaagccagtgttgctgttcactgacagtgtaatggattcattcattgggcactgccctgttggctgtatcaaaaggtgaaaagtgtcaccttgaaattaagggttaaaggccaggcgcgatggctcacgcctgtaatcccagcagtttgggaggccgagacgggcggatcacgaggtcaggagatggagaccatcctggctaacacggtgaaaccccgtctctactaaaaatacaaaataattagccgggcgtggtggcgggcgcctgtagtcccagctactcgggaggctgaggcaggagaatggcatgaacccgggaggcagagctttcagtgagccgagatcgtgccactgcactccagcctgggcgacagagccagactccatctcaataaataaataaataaataaataaataaataaataaataaataaataagggttaaaaaggcagtagttagaattgatgagtgtctggttcctaagattgatttcaacattgggctaaaatgtgaagtgactgtctttgttcttacagcattgattctcagttgattggacatacagatcacttaggctggaatacagattctgattcagttctgggaaggggccagagagtttccacctccagtgggcttccagaagatcctgctgcgggtgttccttggaccatgctttgaatggcaaggagctcagaaatgttccactatggcggcttggcttgcatatatagcagaggaaccattttatttatatttacaaagtggttttgactaagttcattcaaagatattgagggccagctgtgtgccaggactcatgctagctgttgagagatacagagatggatacaaaaggaagacattagcttacatcttcattgaacgctttgcagcccttatgtccaacttgctggctccttctctgctgctgtcttcttccctaggctgttgtgacactgttctcccttggttggtttgtcctcctaccttgttgggacactttgcctttcaggctggagtgcagtggcatgatcgtggctcactgcagccttgacctcctggactcaaatggtcctcctgcctcagcttcctgagtagctgggactacaggcatgagccaccacccctaattttttgatgtctgtcttctttttagagacggaatctccttatgttgcctaggctagttgtgaactcttgggctcaagcaatcctcctgcctcagcctcccaagtgctgggattacaggcatgagccatcacacctggtgtgcctaacccttaaatgttggtgggctcccgagttctcttaccacacatgctccctggactcttcactcctggtttctgttattgctgtatatcccagacctccgcctccagtccttgttcatctcatttggaccattgctcatgctacctattccctgctgtgaaatttcctctcctcaaatccatccactatgccaacttcagagcaactagtcactcatttacaccctttttcccaaaaggagctaaggcagttttcctgggtataaaaataccagatgatataaaatagaaggtaaggaaaaaacaaaaaaacaaaaaccaagggcaatggcctaaaatgcagcctggaagtcttatacttgatccaggtaggccccgaatctacactgtctagcagatggagcacaaagataatttccagcagttctatggggcatggtacgcagatgaagacagcacttgtacaaaaaaaagctagctattccaggactgggaccaggaccagacaaagtcccagtcccttcccatggcccttaaggctctgcagacctgggccctccctcttagcctccaagcctgtcatctgtgtaccatctcccaacatgagctgatgtcttctcacatagacacaggcactgcactttcatgactttttttttttttttttttccagacaaggtctctgtcacttaggctggagtgcagtggcatgatcatatatcagtgcagcttcaaactcctgggctcaagcaatccttctgcctcagtcccttgactagctgggataactggcctgcgctaccacgcctgacctcatttcgttttcttgacctgttcttccctctccttgaattatcagtctcagctcttttcctcaccaaatccaagtctggcatcctcctttccggccactcaaggactgagtgacaacttttgttattgcatcagcctacagatacttctgtcatggtgcttgccatatttttatttcaactaaaatgatctgtggattggtcttttccattagagtgtaagcttcttttgggggaaggttgtgtcttattcatctttgcatttccagcccattgcacagttcttggcacacaggtaaagttcccaggcttctgagacagtcgtgtaaataaaggcaaggcattgtgaaacaggtgtgtgtagtgcaaaagcaaaaagagatacttgaccaatctctcagtgaacgtgatcttgaaggcctgtgcagaggccaggaagagcctggcacttacctccttgtggttgactcttagggtgtctggaagggaacattgttggggggaagagagtgagcatatcatgaagggagctgtatgctgcagcgaggaattgtgggtattctctgcaaaggtcatagggagtgaacatgaaacagggcttattgaaggaataagccccaggtggcggagaaggaacagaggtctgtaagcaggagttttggagacaggtcaggagttcatttccaaactgttgagtttgagaggtctgggctgcctgtgtagagtggaccagtcggcagtttgtagagacggcctttaaagccctctccttagcctcctctgagtttgcctcaggcagaagtgagccccagtggagtaccgggattctgatggaacctcatctgtttgaattactagcccagagggtcatcactctttacctgcaaacagtaccttctctgatgtctgggagaggtggtttatttcccatatacttgttaagtgtagatcttggggaagaacaactaacaccagaaacatcacatgttggctgttggggaggtgcttgtccattttgtatcccttttattttttcccaatcaacagagatccagttagaaggagcagcaagaccttccaggaggccatgctggaaggacatggggtgaggaggatacctaaccttcccttgcctcagtttctcatctgtaaaaaggagggtgatagtatcatggatctcaccagaatactggagagctgaagaaagatgatgtgtgtaaagtgcaatatcatagcctgagctgataagaaattaatggaggccgggacgtggtggcttatgcatgtaatcccagcactttgagaggctgaggtgagtggatcacttgagaccaggagttcaggaccagcctggccaacatggtaaaacctcatctccactaaaaatacagaaattagccaggcatggtggtgcacgcctgtaatcccagctacttgggaggcagaggcataagaatcacttgaacctgggaggcagaagttgtggtgagccaaggtcacaacactgcactccagcctgggcaacacagtgagactctgtctgaaaaaaaaaaaaaaaagagaccagaggcaggagcatgagagggtagtaggatcaagtattttggggctacgctacagccaaggtatcaaactagctgctgctggtcattgttctcaggatcctactaaataaccctaaatagcacttactgtgttaagtgccagccaatgtccaagcctttacttcatctcactgatgcttcacaacagtcctgtgagtgtggtactgttgtttatccccattttacagatgaggaaactgagatgtagaaggttaagtaacccacccaaggccaaacaactagtgagagccagcaccatggtgcaggcataggtggtctagtttcagcgtctgagctcttgcccactaacttactgcctcacgctgatcctgatgcagcacccactctagattggcatgtggcctccagtcagagactcgtttaatttaatcacatggtgcccacctggcccttgtaggtacttgctggagctgctgaggacaatgctgacaacctagttggcctcatgggtagttgtgtacgaacatagaatataccctcaccaggggtcttgctttgttgcccaggttggtctggaactcctgggctcaagcgatccttccactttggcctcccaaagtgttgggattacaggcgtgagccaccacacctggcatcgtaccatttctttttttttttttttttttttttctttttggagacagagtctcaccctgccgcccaggctggagtgtagagccatgatctcagttcactgcaacctctgcctcctaggttcaagtgatcctcccacttcagcctcctgattagctgggattataggcacacgccacgatgcccggctaatttttggactttcagtagagatggaggtttcactgtgttgggcaggctggtcttaaactcctgacctcaagagatccgcccaccttggcctcccaaagtgctgggattacaggcgtgagccaccacacctggcctcgtaccatttcttgataagcacacagcctctgttagatccctccaactgaaatttcttttctgccattgccatattacctcatttcttctccccctttctctttattcctttcttctccattttatttgtgacttggaaacctatttgagtcattgttaagtaggccggtcatgtgcctgtataaaaggtctccttaacccatgtataatacgaaaggagactagacatttagacaaagaaacatgctctaaaactcttgaaagtactcagaaaggctcgttagaatatctatcatactctccaactcatctctttagtttgctgattaaacctgattttttttttttttttcttgagacggaatctcactctgtcacccatgctggagtgtaaatggcatgatcttggctcactgcaacctccgactcccaagttcaagcgattcttctgcttcagcctcctgagtagatgggattacaggcacatgttaccacgcccagctaacttatatttttggtagagacggggtttctccatgttggtcaggctagtgtcgaactcctgacctcgtgatccgcctgcttcggcttcccaaagtgtggcaattacaggtgtgagccactgcgcccagcctaaacctgattttaataactgacttctttttcttttcttttttgagacagagtctcgctctgtggcccaaggtggagtgcagtggcacagtctcggctcactgcaacctctgtctgggttcaagcaattctcatgcctcagctacctgaatagctgggattacaggcacacaccaccacgcccagctaatttttgtatttttagtagagacgaggcttcaccatgttggccaggctggtctcgaactcctggcctcaagtgattggctcacctcggcctcccaaagtgctgggattacaggtgtgagacacacatcggcccaatacctgttctttatgcaagatgaatgtttcttctacagaggttatactggtttggttctctgggcagtatttattatgatttttcatggacctttgtgagtttcagggacctgagccctaacaagcagccccactttctatagggaaatgcctgaagaacgccaagcctcggacttaaaatcaacttcaggaggtaaacaaaccaatttagattagggatttctttctttttcttttttttgagacggagtcttgctttgtcgcccaggctggaatgcaatggcgcaggctcggctcactgcaacctctcctcccacattcaagcgattctccttcctcagtctcctgagtagctgggattacaggcgcccaccaccacgcctggctaatttttgtatttttagtagagacggggtttcaccatgttggccaggctggtctcgaactcctgacctcaggtgatctgctcaccgtggcctcccaaagtgttgtgattataggcgtgagccaccacgactagccagattagggatttcagtagtgagcaaaactgccagataccctgttttgttttctctgattctgcgtcgtaccttccacagcattaaaccccctgacctgtaattgcagctcattccacatttgttgaatgaaatctggtcaataccctaatacctaaacattgagccgactaataccagagatacgtgaggtattgctctaacatggcacaggccagaagggctcatggtttggctggtggccatgaggcaagcctcgctggaagggaaacagattggaatgtagtgactgtaagctccctcatcccctctttgggtgggaggccagcttcctttgtcctggctgagatcagggagataactgctggaaccaaactagacctttctggtgtatggtcctcaatttgaattgcctttgggtttaccatgacagctctttccttttgggttattttgacttgggtcagcctattaaaggtggcagcaccctgtagaggcctcgggatgctgaagatgccatgagaagacacaggcattctgcagacgctagacaattttagtggcagttagtgtcgcagagcagtatgaatgtccagagcctgagggttgaagccaggaggcagaggggccggtcctgactcccaggaaggaggcctgagatgctgctgaactgttggggcttctgcgattacccagtcctgcaacttagtgtgtcctggtggccacaatgagaatcagatgctgtgggttctctaaagccccgaaagttctgtgaaagttacctataggcttgtgcattgatttagaggtattttccattcaatgacagtgtttccttcctgccgtcgctctaggttcctggtagagttacacagttgtgccgccagtatagcgacatgcctcctttgacgttagagggcatccaggaccgtgttctttacgtattgaaactctatgacaagattgacccagagaaggtaactgatggtggtttgaatttttttctttaaatatagagtatttaattacatgctagaaaatgcaaagggaaagatactcagtaaaaatctccctggctcccagacacccaggcccattctgggagatagccagcgctaccagtttcatgtatgtttccaaaggtactcaatgcatatgttaaagaagtatacacacgtgtgtatattatatgtatgtatctctcaccctttttaaaaaacacaactggccgggcactgtggctcatgcctgtaatcccagcactttgggaggccgaggcgggcggatcacctgaggtcgggaattcaagaccagcctgactaacatgtagaaacttcatctctactaaaaatacaaaattagccgggcatggtggcacatacctgtaatcccagctactcgggaggctgaggcagcagaatcacttgaacccgggaggtggaggttgcagtgagccgagatagcgtgattgcagtccagcctaggcaacaagagtgaaactccatctcaaaaataataataaataataaaaacacaagtggggccgggcgtggtagctcacgcctgtaatcccagcactttgggaggccgaggcgagtggatcatgaggtcaggaaatgaagagcagcctggccaagatggtgaaaccccatctctactaaaaatacacaaattagacaggcgtggtggcagacacctgtaatcccagccactcgggaggatgaggcagagaattgcttgaacccgggagggagagggtgcagtgagccgagatcatgccactgcacactgcagcctggatgacagggtgaaactccatctaacaacgaaaaaaaattgaatctgttgtgtaggtaaggcagttttttttttgatttgggtttttgaagaatcattcctggtgatcctgaggtctaaattagagtgatagggtgatagtaaacactttggccaggcgcagtggctcacgcctgtaatcccagcactttgggaggccaaggtgggtggatcacgaggtcaggggttcgagaccagcctgactaacatggtgaaaccccgtctctactaaaaatacaaaaattagctgggcgtggtggtgcacgcctataatcccagctactcgggagtctgaggggtgagaattgcttgaacccgggaggccgagtttgcagtgagccgagatcgtgccattgcactccagcctgggtgacagagcaagactttctcaaaaaaccaaaaaacagacaacattagagtgaaatccttcattagctatgtatatattgttcacttcaaaacagagtaagataaagcaaaccatgtacatactagcataggttacatataaaatgtcagttatagcctctgtatgttaaaaaaaattcgatgtagtcacaaggacagaaaaccaaacactgtgtgttctcgctcataggtgggaactgaacaatgaggtcacttggacagagggtggggagcatcatttaccagggcctgtcaaggggtagggggtttggggagggacagcattaggagaaatacctaatgtaaatgatgagttgatgggtgcagcaaaccaacatggcacatgtatacctatgtaacaaacctgcacgttgtgcacatgtaccctaaaacttaaagtataataaattcaatatagtgattaagtggcattgtaccaccctgttatcttgggaagcagatgctttcatggactaaattttgtgtttggtgctcctttcttgcagctttcagtaaattctcattttatgaaagacctgggcttagacagtttggaccaagtggagattatcatggccatggaagacgaatttggtaaggctcagtcttctatctacacactgcgatttttgattaaggtggattaaactgaaagaagtggtgggcgtctgaattggaattagaattaaatattaatagaaacagtagcatccactgcccttcacacacaccttcctgcccacttaccatcaggtgaagtaagctttagggatggtacatttattcagagagcaccttgcacaagcccagcagagtgcccagtgtggtgccaagagccgaatgaccagagatggttccaggggactgattcttcagacagggttctaagacaaagggcaaaagcctccccggaacacatgctgatgacatgtcagcccctcctgagctcgggtaacgcgaaccaggtagaagtaatgtgtgccaggacaagagacgcacccagagcctctggccttggtctcctatcctggctcacaagcacactccaagtttgggactgtgtgttgggcaggtgagacctttataaggttccatggctgtttctgcgtgagttggctgaataggaaatcaaaggacttctgtgctgttctgcagagcagggcctagttaaaattcctcacagatgatgctgactaggatggaatccctttgcctagtgcttaagagtaccaggtctggaattgagcttagtcaggtatgagcctggacaagtaactgtatctctcaaagcctgtttcctcagctgtaaagtgggggtgataatagtaggaaccccaggattggaattgctgtgagaattagagatgatgtgtaaaatgctcagcacagtgtttgggccaaagtaagctaactaccaaaacccagccatttataaaaacccaaccatcataaaaaaaaaaatgcatgggtgacgtgtgttacagcacacgaaccttgagaacgtgccgagtgaaagaagccagacacagaagatgacacgttatataccatttacatgaaatgtcaagaagaggcaaatccagagatagaaagtacacgggtggttgccagagctagggaggatggggagtgactgctgacgggcactgggtttctttttttttttttttttttaattgatcattcttgggtgtttctcgcagagggggatttggcagggtcataggacaatagtggagggaaggtcagcaggtaaacaagtgaacaaaggtctctggttttcctaggcagaggaccctggggccttccgcagtgtttgtgtccctgggtacttgagattagggagtggtgatgactcttaacaagcatgctgccttcaagtatctgtttaacaaagcacatcttgcaccacccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgaaacaaccgccatcgtcatcatggcccgttctcaatgagctgttgggtacacctccctgacggggcggctgccgggcggagacgctcctcacttcccagacggggcggctgccgggcagaggggctcctcacttctcagacggggcggctgccgggcggaggggctcctcacttctcagacggggcggctgccgggcggaggggctcctcacttctcagagggggcagccgggcagagacgctcctcacctcccagatggggtcgcggccgggcagaggcgctcctcacatcccagacggggcagtggggcagaggcgctccccacatctcagacgatgggtggccgggcagagacgctcctcacttcctagacgggatggtggccgggaagaggcgctcctcacttcccagactgggcagccgggcagaggcgctccccacatctcagacgatgggtggccgggcagagacgctcctcacttcctagacaggatggcggccgggaaggggcgctcctcacttcccagactgggcagccgggcagaggggctcctcacatcccagacgatgggcggccaggcagaggctgcaatctcggcactttgggaggccaaggcaggcagctgggaggtggaggttgtagctagccgagatcacgccactgcactccagcctgggcaacattgtgcactgagtgaacgagactccatctgcaatcccggcacctcgggaggccgaggctggcagatcactcgcggttaggagctggagaccagcccagccaacacagcgaaaccctgtctccaccaaaaaaatacgaaaaccagtcaggcgtggcggcgcgtgcctgcaatcgcaggcactgggcaggccgaggcaggagaatcaggcagggaggttgcagtgagcagagatggcggcagtacagtccagcttcggctcggcatcagagggagaccatggaaagagagggagagggagagggagagggagaccgtgggaagagggagagggagagggagaccttggggagagggagagggagagggagaccgtgggaagagggagagggagagggagaccgtggggagagggagagggagctgggtttcttttacacaatggtgatggttgcacaatgtgaatatactaaaaactaccaaattatatggtatatacaaggaggaattttctattatgtgaattctatctcaacaaacaaacaaacaaacaaacaaacatacctccaaagcatcgtacccaacctgtatgcatactgtctagaagctaactggcccacaacctatatgggattcaaggttgctgaaagttttgatatacttgtagctgttgtagaagggtcaggtgtgttcagttctaaaggattttttttttttaactctctcacattgttgtatatttttcttttagggtttgaaattcctgatatagatgctgaaaagttaatgtgtccacaagaaattgtagattacattgcagataagaaggatgtatatgaataaagtatcaggtaaatagacttaaaaaatgatgttcacccatagatttgtctgtggttcttcaataaaggaaacttaagaagaaacagaaaatggaaatgcttgaccaagatttttcactacttataaaatgcaagccctttcctgttgtctgccactcaaaggggcccagccctggtggtgatctttgagaggttgagaactgtcattcctggatagaactcccttgattgtcagctgtcctcacaaaagcagaacattgtacaaagtactgaacagggtaacctggaaacagacctctgtctccctcaattactcagccaaggtaagcccagcctgctgggtaagacactgaagtgacctggctcttaagtaggcaagagaggcctcatgtataagaggatggactttggagtcagagacacccaagtttattctcagctttgccacacactataagcctggtggtctcaggcaggctgcttagctctgtaagcctcagtttcctcatatgtaatatggtggtaatgataggacctacctggggcttttgtgaaagcaaaattgaagagagtatatatatcacttgatataatgatgtaaagaagcctctcagtaaatagtagcttttgttacttgggacctagaataatcaaataagactttttgaattaaaacattgtattagtgtttttagtctttagcttttagtgaccctgcatttttttttttttttttttaaagatggaaccttgctctgttgcccaggctggagtgtagtggcacaatctcggctcactgcaacctccgcctcctgggttcaagcaattctccggcctcagcctcctgagtaactgggattacaggcgtgcacctccacgcccagctaatttttatatttttagtagagatggggtttcaccatgttggccaggctggtctcgaactcctgacctcaggtgatccgcccagcttggcctcccaaagtgctgagattacgggcatgagccactgcactcagccagaggctgcatttttagcacctgaaagatgtcacttatcattagtaagaatacatcaaaaataacattgaacttattttgtcttttccagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaacc

SEQ ID NO: 36070 - DNA, 4435 bp, Homo sapiens
ggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgccgcattctcccaatctctttcctgagaagtggcggagttgggggcacttcgaggtcgccttggggcgaggtggtcgtgagggggtcccagatatgccagcagcggggggaggtcacctttgagaaagtgcgtggaggtgggtttcttcagaagcgcggagtctttctgggtgcgagcctgggggtagcgggtggtggctttgaggatggtctccaggggggccctctgtgtgtggggtctccgtctgggtaggggccaggaatatcagcggagggactcagggtcgtccctatgtgtgacagtggcgctgtgtgttggggagcttcgggaaagcactttttttgagtgatagggggcctggtctcccctggagggtgggcgggttatctgagggagtcctcggagggtcgcccccttgcgcgtcagagttgctgcgtggggtctcagagatagcgcctgggctggggaaatcattgtggggtctccgtggtaaggttagcggggtggggacggcctgcgtcttcggcaggtcgtcgcagtctggcaccatcgttgaatggggacgagtttgggaagggtattttaggggggaataacttttgagttcccagcgtgcgggggaagggcgggacgggagggtgtcccaaggcctgagaagatcagtgtggggcaggggtcaggaataacctgggagggggccttgtatgggggaaataattgggaagaggagagatgggatgaagggggcctcagcgggtcgtctcctgtgtatgcagggtcgttctgcagcgtctctgggagatggcgtccctgggagccctcaggtcgcccctacccgctgcggggtgctttcctggcgtcacgccttcctggcccctggagggaaggaagtgaaactctcctcttcccccacccggctggaatgcgagtcaggaagcctggggctccagcctgctccggctgcccgggtcggggatggggaggggcgtggccggagcgcaaagccccgcccctccgcgccccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagt

SEQ ID NO: 36071 - DNA, 32985 bp, Homo sapiens
agagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccactttaggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatcttgctatttgttttctatttgtcccgtctgttcttcgttccccctttcgtctttttctgccttctcttggattattttttatgattccatcatgtctcctttgttgtcttattaagtataactcttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggtggcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcgttgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaaggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcag

SEQ ID NO: 36072 - DNA, 20007 bp, Homo sapiens
accgcgtgttcgcgcctggtagagatttctcgaagacaccagtgggcccgttccgagccctctggaccgcccgtgtggaaccaaacctgcgcgcgtggccgggccgtgggacaacgaggccgcggagacgtgagtctttcaggtccgggagcagggcggctgggaggggagctcctcaggccagacaggcgtggcggggtaggggtggttctgcggagaaccggatcctgcggaccgggcaggggggctacagaaagaggatgctggggggagcccgccgcaggcgcccactcaccctagagagccggacttcttaaggtgctcagatgggcttcggggtgcaacggaggattttttgaggaaaagatccgtacttttcatcccatattcgaagaagggactgacgtgtttagaaataaaaagcttttagaagagagctttgtgccctcttttccgttttctgtactcgcctttttctctaaggcccttcccttctgctttcctttttcctccagcacacaccaacttgcaggaaaggagatccttcaacgggtccacgaccgcgctcagcatcctccctggagaaaggctcggagctgtcccctgtgctagtcccctcccaccccgctcctcgcctctctcctgggaatgatttctaaatgtttatcttttacctagtaaaagaattcccgaaacttcaagccccaaagattcctctttcaggagcctcgttctacgccgtacctccatttcccactgttccctgtatgatacctcgcacttgtgcaacacatgagtttaacgagtacttgtaatatacattccttcatgtgttttcctccttcgccttgcaaaataggttttaccggtattttagataaggtaatgaatgcgagagccctgtccaaagaacagctgaccgtggtagagctggatagccccatgctcttgcttagttgtaaacttgacgtctgcgtcttttgctggagatgtgagtttgaccaccatcacctccaccgttggtgctggacatcctgctggatctgaattaactgaattctggctctgcttaactgaattctgcttttcaagctccaactcaattgcttcctcctctttggggcacaggcctttggttccaaacactactgtggatgattaacagcctgtgattaaatgttgactggtttgtagtaacacaaggatgctacagtgagtttttcatgaagttcagtttactttaagaattctatgtatggacataatgtgtctgattcattgtcaagtcggaaaaaagattcaatgtgtatttaaagtatacacttatttgaggctgggcgtagtggtcacgcctgtaatcccagcactttgggaattggaggtggaggatctcttgaggccaggagttcaagaccaacccggacaacatagtgagacctcgtctctagaaaaaaaaaaaaaaaactttaaaaaaaaaattaagtatacatgtatttgagtatgcatagaaaatatcctgagggatacactggcaaaattgagcacctttgaggattgtgattggggaaaggggtcttaaatgggcttgtatgtaaggagagtgtattagtttaaaattttttaaatatgtgaattctgagattattatttctattttttggtgtttgaaggttattttatgaaatgatggtgatgatcaaggtagctagatttcatttcgttcttttttttttttgagacagggtttcacaatgttgcccaggctggtcacaaactcctggcctcaggtgatctgcctgcctcagcctcccaaagtgctgggattataggcatgagccaccacacccagcctagatttaattatgaatcattggcctcaatgattcaaataatcgttcaaataaattctcaacttcagtaagcagttgatggctgtggccacatggatctcccttgtctctgaattactattgcttttacagtgctaatggcagtctcttagcactcagctcttctccagttgtttcatgtgttttaggaatgcaagggtagagcctaggactctagttctttccatcttcacagtacctagcgtcacactggtcacaccacatgatgctctggcaactttgattatttgattacacattaattttcagtatgaggtttcttaattcaatttgttttagaagtgagtcaagaatttttttttcctgtcttttctaggaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggaggtaagatgagtgctgttcattattttaatatacctgtgtgtctgtcctgtctctgctactctatctctagttatgaggagtttaaagtaaaagtaaaatgttgaagttattgaaaagggaatttccaccttctcagcaaggcacttgccacaaagcatgcctgctatgttgtaaacattcccaattcagaacttagggaacagttcttttggtgagcgtagtgctgcctcctacaattttttctaatacagaatataaaatatgtagagaaagatatcaaggctatctttagagaaagtctataaaggtgaacattattaataaaaaatagaaaatgaggggttgaaagcaggagttagaatccatattgtagggaaaggtgtgactgaaggggctgaagactactgagaataccactgctgcctccttgacagaaggtccaccatgacttgaggaatgattgaaattggagcagtttccatgaatgtcatgctggacaagggaaaagttgggacagtgaggttctgagttcatgtggtttttctagagtagacttccagactgtacgtaattcaccttggctgagagatgtcaagaacagggaattatgtcaaaaaaaaaaggaacaaggaattagttgatacagtttaataagcaaaactttagtacttcattcaaaccagcatgtgactgtactaattctggactaatcctagtagtggccatagccatagcagccctggtgataaagtttgctctgagttgtaccaactgagaattgtggtgggagttgaaaatgtctttacagaagatgagaaactggtactaaagccagtttggggtttttttgttgtttttttttttttttcttttttggctgggggagagattgcacagaggagtatcttcaaactaagtttgtcatctaattaaatagttgaaaacatctgcctgccggtacaggtttgttttattaaccagccttgccctccacaagaataatctgcataatttaatatcctctcattgcagagcattactttgccaggtatgtagacagaactgagtttttgcaagtagagtcattactagaagagaggcatgtcttggacttgtttaggccaagtaggatagcgttagtactgaagcaacatatttctcaatctctgatgagccccattttgaaattaaagctcatttccttaatacgtttatacagtgagttaacaggcttgtgaatctccatttatcctcatgcttgttccacctgaggctttctccctaggtgactcgtgatgtactgcttctctgatgaggtagaagaggtgggataccactgtggtgacatagtatcgccaggtagctggaggcaagttccaaagtgctcaaaacagaagttgattttaattttcattaactcgagaaaacgaagtagcattagtaaaaaagggtattgtgtcatcagactactctaatggggatggcttttggtgattttcactgctttgtttctttcagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaataggtaaaattgccttttttatgtaaaaacaatttcagtagattcatttatattgtgcttttccttagatttgcatcagcctatttgttttccagtacaattctgaatatgtcatcttagttgttctttgccttgaatgtgaagaaagcaaggaagggtgttagccctgccctttaaaaaaaaatcccagaaaataaaatttcaattatgacttctctgggttcatcctacaagaaggtgtcaggatcacctgaaatttgggatttttatatcatgtcacactgcttgggaagaggtcttgggttcatttatgctgcttagaaacctaatactgatgcattcttattgataagtgaagctaggataggctctgctatagcgtagggtctcattgctcaaaagtaatgaggaaggaatcactgctttgttttctgaggacattattgaattcctggtttcttcctcttcttttctttcttttccttttttcttaaaaaaaaaaaattcttttatcatttagctcttatgggagtctgaaagctcagttcctaagtgagctacagttcatccttggtaaccatttttttttcctctttcaccccgacctgaagaatttcccattagagctatgctccttacctggagagttcttaagtaccagtcaggttgttcatttgagccaacaacagatttcttggttattgtgctattgccacagtaggtcctatttgcattgaatttgtgtgtttttagcttctctccttttacgtgttgctttatgctactctccaaaagtctttcttgtagagtttattagttgtataatttttctttgctctgttttgttttgtttgacagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacatgtaagtatagtaatttgtcctgttagtgtttgattattcaacattgaaaaaaaaatgttttggtttatgctagaattttttgtataaaatgttagaaatttggtttagaaaagcttattttaaaatatatttggtaagtgaaagctgtatttttctgctcgatcttaatacatttgtgaattttgctttccttttacaaaacacagactaatttaactttttgaaacccacttaataaaaagagacaaattctgcctggctattagtactgtgatagactgcagcaatgtgagttatctgctttatctgttagtgtaattgccaagaaataaaatatgtgaccctttatgtacccaagaaacttggaggttttcttcagagttgaatgtttatgtatgtatttaaagatttacacttcatgacacataaaacaagtttggtaaagtgaatttacttttccatcagatatttggaatagatgctcagttaaaaaatatgcgtgtttcattctttaaattcccattaaaggttttcaagtatgtgggaaaaggaaatcacaccatacctagagcactacaaatctcatgttccattcagtagttaaagaaaactatgttgctctgacaagctctcggaccaccagatggcagacattcgggaatacctactgatagaaagtggcgtgtgtatggggtgtactctgtgatcccccagtatcttagtgtgttccacacccgattccctaatgtgcaatagcagtagttactactccactcagttacaggctgctagggcagtgcacctggatctcgggtacatgccaggacccaacacacacacacactaggcttcttacaatgctagtgtgatgacattggtatgggcttttcagttgggaaaataagcagtagaaactgtgcacattaagtctagtattcctgttatttgtggccatggtaattcgtcaagcattgaaaatgctcactatttatatattatgggggtcactgggaatgtatctgaagtacatgacatgcattaagttctagatagctagctgctcattggtcattttatttttaatgtcctaaacttcacctcatctctgaagtatctgaataattgcataactgaatgatttcaattttgaccttacctagccaactttctgactcggtgtgtgaaactgatgaatttataaataacaaattattttgccttcagtctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaaggtaagaaaaagtataccgagtacttactatgcttcagatatttatttatagtagtactctaactagattgttagaatagcatgcccaggttgtatgagctttatttgagagggagttcagtacccttgaagtactttttggtcccagagatatttatgaggagcatttctatatcttaatagctctgaagttttctgtctttgctattcttttgaaactcatgacaggataagaaaagcaaggatgaacatctgtataagtgaccagacaaggtaccagcagggccttgaagaccagaagcatcgtgtatacatggatacactatcaatatttattagtagttacgattaactaatgtcattaatttccagtcacccagtagctaaatgttctgttttcttttaaagggtatgtgacttttacagacttgccctttgcaaattggatcagaaatggtatgaagtcaaacaataggctctttctttctggccaaaaaaaacccttttgagtcgcctatggtaatttgccactttttatttgatgtgatcaggcaagtcattcagaagactgtcaggagactcttaaaaatgatgtgggtcaggtggggtggttcatgcctgtaatcccagcactttgggaggccaaggcaggcagatcacttaaggccaggagttcgagaccagcctggccaacatggtgaaaccccatctgtactacaaatacaaaaattaatcaggtgagatggcgcatgcctgtaatctcagctacttgggaggctgaggcacaagaattgtttgaacttgggaggcggatgctgcagtgagctgagattataccactgcactccagcctgggcaatagtgagactctgtctcaaaaaataaaaaaaaaaaaagaaaagaaaagtgatgtgttcatatctcaacattttagtctaacctaatacatctgtacactcatattctggtcacttgatattgaccaggattttcttcaagttggagttccgtattctgtatcgtttctttttttctttatcagccatgctgcttcatctatgatttccaattttggtttctctaaaattgaacaagagattacacacttaaagctattctgaatgtagaatctaggttttggaaatttaaaaaaaaaatttattcagtggtagccttacgtaatttgatatctttttttagcaccttgcctttgaatcttccaagtattcagcttttgtgttcacggaattaagtatcccctaccaggcacggtggctcacgcctatgatcctagcactttgggaggctgaagcagcaggattgcttgaggccaggagtttgagagcagcctgggcaacatagcaagacactgtctctaccccccaaaaaagaagtaactccttaccatcatttcatagtttgagcaatgtgtaattaaattgtgcaattacagtaataagtataactggcgtgaagaggtttcaaaactaacacagttgatttttgctgagcatagagctcactgtgggaaacaaatgcatgtgtaaacaggagagtgtttacatactaggagtatttgctcttagggattttacgttcactgaaatctcaaattaaaaattttgagccttctctttagtggacctaaatatagagggaagaagtaaaataagaatagcttatttattcttaatcaaggaagtcatcttctgtgttcccattgacgcaattgcttcccttggactgtttcttaatgttattgaatagtttctaatctcatttaattatctcaaaaagaaaaaaaaaagctactcattatatggtgagtactgggagctcttcaggcattttttacttagaattttccttaagagagccatcttgcacctctgggagatcccatgtatcatagttttaggttatctgccatatatggactagtttattcctacttctttaagtcttctgcagtttttcttacatttaaaaaaaagatcagttttcattctgggagacttggggattgggttgttttcttctttttttaactgtacatctgggtcaaaatgtcataatttatttaacattctcatttcaatttcatttccaaattttacctaaatacagcttttctttttttttctttttttaagaaaacagtatctttttttaagagacagcatcttcctctgttgcccaggttagagtgcagtggcatgatcatagctcattgcgcttcaaattcctggatttaagcaatcctcccacctcagcctcccaagtaactgagactacaggctcatgccaccatgcccagctaaggatagcttttctttaacttagccctctttaacctaggactccaagaaataggccctctgttatctgacacagaataattttttcttttttaactctaggttataactctagattgttagtgagttgtaaaatcaatctgtatgtcataaccaatatttttaaatgcaacaataatattatatattactattttacattacatatattaatgtgggtcatagtcagagtagtttgatgcactctgctttaaaatagtatctactagaatgtaagctcttaaaagccaggatctctctgtcttgtttacagctctgtctccaatgtgtagaatagtgtctggtacataatcgatggtagtaaatattgaatgtttaaggagcatgaaacagcaaataagcataatttctagatgaagacttcccataggagttttgcaaatgttacatgttctcttccctttttggaatatgctgagtttatcttttgttaaaggcatccagatattaaagttacttacttaataatttttaatctaattctctcaaaaagaaaactactactcattatattgtgagtatggggagttcttcaagctcgtaacagggcattttacttaggatttttcttaagagatccatcctgcatccctgggagattctgtatatcatatttttaggttataggccttctgctgcttaaggttcaccttctgctagtgaaggttattgttcatgccgaaaactagagaatcatctctgatatccccctcatccccacatccaaccaagttttaataaatatgtccatggtctctccattcctctccatctttcttgctgtcattctagtccaggccatggttacttcccacctgagtgacagttactgcctcctaataggagcctgtccacgttattttgttttcctccttttcccaatctagatttcacagagcgggcagtgatttgtttaaatgaaaatatgatgaggttgcacaccactacttaaaatccttcctccagtggctccattagtttttggacaaagcccactattctcaacagagttctattgtctgatctcctttagttgcctcagcctcatctctggccaccctctctgacctagtaggccccggccaccttgtacttctttgagttccagaacagtgctggccccttcctggtgctactccctgcctggaatgctgcctccccaaccttccccaccaaattcctacctatctttaggtcttggtataagttatattttttcagtggccatctggaaattattgaggtcatgttattatacattcttaatagcactctgttcttttctattgtaaaatgtgtcaaaaattatagtcaaagaagtatataatcattacctgtgtaaaaccctctccctgtggatagtaagctccatgagaacagagactgtggggcttattttatgttctgctcccagcatttagcatagggaacactgtgggcccttaatacttatggaatgaaagaattggttaaactactttctagaacaattgcccaatgagaaataaagcaccagcataaatgatttaagataccctgagttcatttatttttacaaatatttaagtactttctctgattgaggcattatattcaggataagtgtaaagatttgtgtgtgtgtttgcctttttttttttttttgagatggagtctcactctgtcgccccggctggagtgcagtggcgcgatctctgctcactgcaagctccgcctcccagattcacgccattctcctgcctcagcctcctgggtagctgggactacaggcacccgccaacacgcccggctaattttttgtatttttagtagagacggggtttcaccatgttagccaggatggtctcgatctcctgaccttgtgatccgcccacctcggcctcccaaagtgctgggattacaggcgttcgccaccatgcccggccgtgtttgcctttaaaagctcttaaaatctaagaatgtatagacacttgatatggtattagagcttgaatgaaatcttaggtatggtggtgatcatcatattcaaaggtactgcaaataagaaatctgttatttatgtgataacttttattttaaatgttctgtataagtagatgatacacagacaccattgttcaaacagtgacctttacacaacataaaggctgcttggacttagggacaatatctctggtatggtatttgggatggttaaaaagcccagtgatgaattcagggttaatagaggcttgttttaaaagagaaatcatgttaatggtgttttattaaagaaaagtgttttaataactaaaaaactatagttttaggttataaaaagtatgggaagtttggggtttcagtgtgcagaagaggcatggaagaagccaggcaggtggttaccagatcactagatgcctgaaggaaatgcccctagctggatttttttgttgttttttgagacagtgtctccctttgtcacccaggctggagtgcagtggcacgatcttggctcactgcaacctccacctcccgagttcaagcaattcttgtgcctcagcttcccaagtagctgggaatacaggcgcatgccaccacacccggctaatttttgtatttttagtagagatggagtttcaccgtattggccaggctggtctcgaactcctgacctcatgatctgcctgccttggcctcccaaagtgctgcgattacaggcgtgagccgccgcgcctggccgggagtatgcatttctgacaagttcccaggagatagtgtgctgctagtgtgggaacatacttaagagtagatgactgtgggggcattctgtgtgttttgcttacctggttattgattgaaagctgtacatataaacaaattactgttttaaagtattgttttccctcactattttagaatcagaagaaacctgaaaatgatgatgatgtggagattaagaagcagttgtccaagtatgaatctcaactttcaacaaatgaggagaaagtagatacagatgatcgtaagttcttatgcataaattttagggctggagggagttcattgctgtatgatttgcaggcaacttgactatctggaagaaatgggaccatgtcccttggttttggtttttgcagtatctcatactttgtaaaatattgccagtgagtacattgtttttgtatatttacatttattttttctgtaactttttattttgaagtaaattcatattcatagaaaagtttaagaatcgtacaaagaattcctgtatcccattcactcatattccccagttattttaccacactgtctttctctagctctgtctacacacacacctttttctttaattttttagtgactaaagggccagctacacacactttttttctaaaccatttgagagtaagttatagacatgatgtttctttactcctaaatacttatgtttcctaggaaaatggacattctctcatataaccagagtttaattattaaatcaggaaatttatactgatacagtgccattctctgtagacgttattcttccaaatgccttaatagtgctttttatgccaacactcccccaacccccaccaaaatattgttccagagtacaattcaggatcaaatattgcatttagttgcctctacttttgggtttgtttagtatttttgcatgattaggttgatcagttttggcaggaataccgcaaaatggtacttgtccttttctgtcacatggtgtgccacctgatatgattctttgtcacttattggtggtggtaattttgatcacttgcctaaggttgtatctaccatgtttctcctgtttttcctgaaacttggctgtttgcttggcatatcttgtcggacagactgagttaagattcatgttttcaacccagctccttgccatgatcttcaaggtcccgctgagcccaccactctcccgcattgttcactgtgctccagccccactggccctcttttcacgctgggagcacataaggcttgtctccgggccatgcactcactattccttgtacttggaataccgttctctgagaccattacatgcattcctcctcttgttgtgcaggtctcaaatcaggtatctcctttagaggccttccctcagcacccaacgacagcaggcatgagccactgtgcctagaccacactgttttgatatatggttgttgttgttgttgttgttgttgttgttgttttaattttttttttttttttgagacggagtctcactctgtcacccaggctggagtgcagtggtgcgatcccagctcactgcaagctccgcctcccgggttcacgccattctcctgcctcagcctcccgagtaactgggactacaggcacccgccaccatgcctggctattttttttgtatttttagtagagacggggtttcaccatgttagccaggatggtctcgatcccctgacgttgtgatccgcccacctctgcctcccaaagtgctgggattacaggcgtgagccaccacgcccggccccctcttcagttttttaaatggactccagtgaaatgtgtaatgatggggaggaaatacctgccctagaaatggactgcagtgtcagggatggttccaagaaaattgataactatgtacaggagaaaaaaaataaccttattgtggcaatttattttcctttgcacagatagataataaatgcttcttggtgatgatgaaataattcggattctctgttttttccttgaattttgccttccaaaaaagaggaagtcagatggcaggattatgcatgtttttttatttctaattttcattacttctctaagatatttttctaaaataaatattttaaataacataacatgttttctaaaacaagcaggttcttctcttaggatgaggaaaaaagtcatttttaaaaaggtagggaggcagaagaaattgagggagcatctgagaggtagttattgaaggttaacatttaaaatccattcttaatatttgagaccattccatttctggaattcattaaaatcttttgatgtttttcatcagtaatactttaatatttagttctgcagatatgaaggagttatcatgctttaagatcttctgttgactttttcaatgaggtttgaaatgtctccaagtccattaacaaagccttctaactgtccccatgccctttatgtttattcctaggaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtatatatctacatatttgttccttgttgattgattctgaaaatgtcacattaaacacctagtcaaattttaacaaagaatagattagtttagatgaggatattagtgacttccaagattataaaaatgttactttttcttttactactttgacaatgaagtgctcaataaatgttaggtatgattaaatgctaggaattgtacctagcccattacctaaattgtaactgtcaaaagctgttcttaaattgcaaggtcttaagatcagtctttaatttgtatggtgcatgtatgagatttttttttctccctatacattgaagttcccttatcgataatataatatttataaaagtaaaattatattttccatcatcttttatgctaaaggaatcttcatacatctaagtccagttaccagtctctatcctatgaagaattatagaacttttgctaataaattgttataccacaattgggagataacagaatacttacaaattttaataatttagtgctggaaggaaccatgcaattaggcagctgaggcctgtcaaggtgacgccacttgtccaaggaggctgtgctgtgttatagctaggcctggccttggctccctgggagtcgagtgctcttcctcttgtactatattatgcagagctgaaacagacaaaggaggaatgtccgattgcacagtcggctgggtgcggtagctcatgtctgtattcccagcactttgggtggccaaggcaggaggatcgcttaagcccaggagttcaagaccagcctagacagcatagtgagaccttatctctacaaataaaaaaaaaaaaaattagccaggtatggtggtacacacctgtagtcccagctgcctggtaggctgaggtagatggaacgcttgagcccgggagtttgaggttctagtgagctatgatctcaccactatactccaacctggccaacagaatgaaaccctgtctctgaaaaaaaaaaatatatatgcacagtcatggtttataattgattgattgtataatatgtcagatttttaaaaggggacggctatttgtcttagagttttctcactgaaacagtgaaagaataaatgtaaacatctagttacatagtaaattcctctgaggcaagtgaaacatgtttatacccttgacaggagagttttttcctaaaccttttaaacagtttattttatattcttgaatatgccttttatatggtagcagttactcctcagatttgtataactttatccgctcattctaaggcctagaaaaccttcccttctctttcatgcccgatgtgctcctttgggaaatttagacctcatggaatgtactctaagatttcttacaaagaagatacagagttggtttgggaaacttctattcattcacagccaaaataccattttcttgttacctcattttgcatactgataagattaaaaaacacaaattaatgtagccaaactttttctgattgatttttacacaggtgctgcttttactgaaggcttatcaagtggtttaagtacttctgttgctgtgttctgtcatgagttgcctcatgaattaggtaagagaaccacataaattgtatttgccaagtgggtgaaatgttctagtgtcactggcttttgctaatggtagttcagcaagcttcttcatcaatttcatgccttctcataagtctgctaaccagcatactgatgacatcagggatcatcttcatacacacaaggtgaataagactacaggatacaaaggaatcatcttccattaacaaaagttgagaaagagaatctcattggaattgaagggaagtggatgagttgtgttttcaatattgttcttctttgtcactaggcattaaaaccttcccaagttctggatcccagttcacgtccttgtttttcttgttttggagatatattcacacacataccgctgatgccattttcacttttgttccttgttatatgttcagccattccttatcatcttcagcatctatgttccacattcaagtcccatgaagcccctctcttatttccatcttcatgtgtctcttttctccttttataattgtagcattgaactcttcagctgttttttatgcattaccattatcatttgctgatcatctcatgtgtgttctccacccattcctcccttctttgtggccaaattccaagctccttgaaaacactgcaagaccacaatattaaatttttagtgtttatcattttgacaaagtgtaagccttaaaaaatttttttggttaaggtatctggccaggtgcagtggctcacgcctttaatcccagcacttcgggaggccggggcaaggggatcacctgaggtcagaagttcaaaaccaccctggtcaacatggtgaaaccccgtctctactaaaagtaaaaaaattatccaggtgtggtggcatgcacttgtagtcctagctacccaggaggctgaggcacaggaatggcttgaacccaggaagcagaggttgcaatgagccaagatcggtgccactgcactccagcctgggtgacagagcaagatactgtctcaaaaaaaagaaaaaaaaaaaaagtttgtacatcaagttgaatgatgaagaataaaaaggaaaaacaatagtttctacagctgttagggtgatttactaacactgctttaaccctaggtcattcttaattttgttttcttttccccctctcaaaaacactggaaaattttcttaaatctgggaagtatcttggtatgtgtcttaaaaatgatttctcaatgactttttcctccttttttgttttctgttaaaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattcggtaaagcctcattttttttctctctttttgggggagcaggaagtggaatcttgctatgtcgtccaggctggtctcaaattcctgagcccaaatgatccttccatctcagcctcctgagtagctaggactataggctcaataaaatatctttttttttggctgggcacggtggctcatgcctgttagtccaacattttgggagaccaaaccaggcagatcacgtgaggtcaggagttcgagaccaggctggccaacatggtgaaaccctgtctcaactaaaaactacaaaaaaattaaccagggttggtggcatgcgcctgtagtcccagctacttgggaggctgaggcaggagaatcacttgaacccaggagatggaggttgcagtgagctgagattgtactactgcactccagcctggacaacagagcaagactctgtctcaaaaaaaaaatcatttttttaaaaaagattttaaatgcagtcattatgagaagtgattctatattcagaaatttgtggcatataagaatataggttctttagagttttttttttttttttggattgttgatcacacctttatcttgcttaatatgtgtccagattcacaaaaatatctacatccttctgatgtatcattttagggtatgatctcagtaatcaggcagtgaattttctatagatttgtaggaagtctaggacaagatgcatattgttggcatgctgtatacttcagaatgcttagtttattaatcaacaaaggagtcatatctttttgtcactaatgtcctcaaaacaatcccaaccaatcttaccgctaaaattgtattttattattttatttttattttttactttgtaagcaatcaaagacaatatgtatcttatatagtataaggttttctatctctgaactaaagacaaactacatgttatatccagttcagatatgcagccagtaactgaagtaggaaaatcaatatcgcttttcattttccagtggaaactggaaccaatacaaactttttcttgcccagaacatcatgagtaatcattgttaaactgctaggaaatgctgtgtgacattgttagctagagtcagtatgtatgtaatcatgttttaaggaattaactcacagtatatctagctacaaataaagctagtatactgtcctataaatttttctaaaaactaatctgtagttctaaaaacttaaatgtcactcttattttcccttacttttttttaaaggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 36073 - DNA, 8508 bp, Homo sapiens
agtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttgtgagtagctcctccagggcgcaggcgacttggggccggaggcagcgggcgttcgccccggggcctgaccctataaaacaggtgtccttaggggccgggccgggccgggccgggcagggtgggggccgccaaggcgccgtcccagctccaggccttccttttgtagagtactaaggctgcaggtttcaggccccgcaggacaggagtgcgaggcgggtgtcaccgttgatcagcgcctccatcacaatccccagccgccaaccctcagctgtcagcaaagcctggaggggttgagcgcccgaggcccctccacccctccctggcccccgcctcccggactcctgaccaaatgaccccccccggcaggtgtttcgcccgtgccgggttcatgctcacaagcagacaggtatggggtgatagctaagagcctggagaacaagtttttattaaagtggagtcatgacattgaacgttcatgtcacaaacgtgccgagtgtgttttcttctgtttggacttactagatcagtcagtcattcttaatcgttgaagatgggtgatgggaagttcgttttgctactcttttttctcttgtgcatgtttgaaaacgtccatactaaaaacatttttttaatgcattatttgaaatagcacctaatccaggcatgtttttcagctcctccgcctctgatgcagaatttgatgctgtggttggatatttagaggacattatcatgggtaagcttttaagatactgtttttaaggacttgcttgtttctttaaggacattgaaatcaatttggagagttaattttaaaaagagaaaacatcaagctgcctgcaatttttaatgtagcacaatgtaatacttaagtaaaggcttactgcagtttgtcttagaaacaaacagcccagtactcctgaaaacatctaataagcatagattcagaggctggaagggactgactcaggctaatagggcaccagcagtgtggcgttcttcgcaaaactataggaaataatgatctactctatttcttatgtagggtaagagcaatttcaattttagatagttttgagttttaacattttcatgccataaaacacataaaaccaggccaggtgcggtggctaacgcctgtaatcccagcactttgggaggccgaggtgggcggatcacgaggtcaggagatcaagaccatcctggctaacacggtgaaaccctgtctctactaaaaatacaaaaaaaattagccgggcgtggtagcgggcgcctgtagtcccagctactcaggaggctgaggcaggaaaatggcgtgaacctgggaggtggagcttgcagtgatccgagatcgtgccacttcactccagcctgggcgacagagcgagactccgtctggaaaaaataaaaatgaaaataaacacataaaaccataaccataagcacacatggccataaagaaaacaaggtattaagcttcagctggttctgtattttcctaggttttgagttcctacttgtggatgtatttgggcatccatgaaacctgctaagtaacagagaagcagtaacagtccccagaggtttaagacaagtatgtaggaggggaaaacttacatttgagaaaattctgttgactttaagttttatgagaattgagaaaagaacactgttatttggtgttattggctgtatggcttaatccatttagaatgaaaattactgaccaagtttttataccttcaggtataaaggttcatgcccttaactcctgaatatagatgtttcatcattaagctcgtttcccatgtggacttggggatttctggggaatactgaagaatccattcagttctcttgcctattataccctatatgctatgggaaaatgagccttctgtgagcctacggtatttatcccaaagtctgggtcctttctgaaactttccttttatttttagaaataatctattcagttgttaaaattccttattccgggatgggtacggtggctcacacctataaccccaacactttgggaggccagcgcaggtggattgcttgagtctaggagttcgagaccagcctaggcaccatagggagaaccctgtctcaattaaaaaaaaaaaattccctattccctatcatttattaagtgttcactatgaactaatctatttacatgaattctcatctaaattccacttccaatcctatatgataactaccataaaccattcttattttccagataaatgtgtttatatgggggttagagaaattaagtaacttacccaaggtcacacaattagtaagtagctgagatgcgattcgaacccagacgggctagcctctttcagaccccataattttaatcactacactgtttccacaactgctgtggaagttatatcaaaataagagagaaccaattcattccttttcagaaaagtaatgtcagggagttcccaagccaccctgtgtggatatggttaaaatggactgaaggatggtggtgatcattgcacaacaatgtaaacatacttaaagccactgagctgtgtgcttaaacattaaaatgataaaaaaaaattgtatatctcaccacaatttaaaaagaaaacagggctgggtgcggtggctcacacctgtaatcccagcactttgggaggcggaggcaggcagatcacctgaggtcgggagttcgagatcagcctagccaacatgatgaaaccctgtctctactaaaaatacaaaattaggctggcgaggtggcacacacctgtaatcccagctactcaggaggctaaggcagtagaatcttttgaaccctggaggtggaggttgcagtgaaccgagatcgcaccattgcactccagcctgggcaacaagagaaactccagctcaaaaaaaaaaaaaaaaaaaaaaaaagaaagaaagaaaaagaaaacaggaggattgggctatttccacatcagggtcccatttaatacccccttaaaacatcagctttccttccagagactgatcattgagaaagcagtactgctgacatagatcctgcctacttataaatcataatggttggtaatctccattaaaaagaataaattttccccactgtggttcagatgacgagttccagttattacagagaaatttcatggacaagtactacctggagtttgaagacacagaagagaataaactcatctacacacctatttttaatgaatacgtaagtagatttctatgtctcctaccaggaggtcagagtttttaaaaatttaaatttagattcaaaagacattgaaatttgctgccttttaaaatatgccaccagtacacttccaggaatcctcattagcatctggtttaagttcattttcctctgcacagcctttggggctattttccaaaaggctttcaggcaaatatttgattaactcatcagcttcttatttaaaagaagtttgacctgggcttggtagcacacctgtagtgccagctatttgggaggttgaggtggaagaatcacttgagcttaggagtttgagaccagcctgggcaacacagcaagatctctgtctctaaaaaaaaaatgataataataaagataataaataaaagacgtttggcttatcataatcctgcttttaatcacagtacatgagttcttcataccttgcatttgcatgcttttgacaaacctttctgctttcacatactctttctttcttctatataatccagtcatatatgcatgactattaagtaaaagtgaaaactgagaccaagatcactaactatttggtggaaaaaccaagactggaacccaggaacctcagctcgtcacccttgggtctctacactttaccctgaggcctcttaacagccccctgggattctgtcatctaagaatccattttggcctccaggactttattttcttaacacagaagcatggcataaacaaacctgcccagaaggaacctgtgactgcctccatgtccgtatgttctgttacacagatgccctctacccaggaggcaaagcccccacttactgcatcctgcactgggttgtgggtgtgggtaccgtgctactcactgtctccacctgtgtcagagcatccaccctgttacagcaccattatcagctaaggcttctcttccacaccaggctgagtacttctccaggacaggagctgtgttttggtcctctttggtatccttggcactcagtgtagattgtggcacacagacctcaggaaatgtttagaaagggctgggcaggctttctgaaaagaagtcttgttttcccaaagtatggtctcaccaaaatcctttccactgttgcagatttctttggtagaaaaatacattgaagaacagctgctgcagcggattcctgagttcaacatggcagccttcaccacaacattacagtgagttgagcttgactgatttttgtgttttgttttgttttctcactttcttccttccctaggctgaccaaaagacgctccttgtttgttttcctgtgcatgccgttggtggttaggtcctatggaggaagccctcaaaccttttaatgaaatcttgaaaagatcaggcattggctcacgcttgtgttctcagtgctttgggaggccaagggaggaggatcacttgagcccaggagttcaagaccagcctgggtgacatagtgaggccccgaccctacaaaaaataaattagtcaggtgtggtgttgcatacctgtgggcctagctactcaggaggctgaggctggagaatcccttgagcccagcagttcaaggctacagtgagctataattgcacccctgcactcctgcctgggtgacagagcaagacccagtctctaaaaaaacaaaacaaaaataatgcggggggtggggctggggtggtggaaagaaaaacgaaagcaatcttgaggactgtctcatcattcattcacgaaacagccatctgttccgtttgcaggcaccataaggatgaagtggctggtgacatattcgacatgctgctcaccttcacagattttctggcttttaaagaaatgtttttggactacagagcagtaagttactactcctatttatttagccactttgagccacttagaaaattccaggtagaaataccgaacatgaacctcccacgcttcccccatcattctcccttcaaactggccgatgaggcatcagaagagtgagctgctattctgttgtggctgggaccttctcatgttttcatgaaacaagcccaggtaccaacttagagttcctaatcagaaggacaaaaccgaaaaagcaggtctcaggtctcattctgccttgcctttcttttatttatttttttttttgagacagagttttgctcttgtcacccaggctggagtgcagtggcaccatcttggctcactggaacctctgccttccaggttcaagcaatactcctgcctcagcctcccgagtagctgatactacaggcacctgccaccacgcccagctaattcttgtatttttagtagagacagggtttcaccatgttggccaggctggtctcaaactcctgaagcatggtccgcctcggcctcccaaagtgttgggattacaggcgtgagccaccgcacctggccctgccttgcttttcatataatgcaagctctttataagaaaaataggagactgggcatggtaactcacacctataatcccagcactttgggaggccgaggcaggcagatggcttgagctcaggagtttgagaccagccaaggcaacatggcaaaaccctgtctctatgaaaaatacaaaaattagcttggtgtgctggtgtgcatctgtagtcccagtcagctactttgggggctgggtgggaggaccgcttgagcccagaaggttgagattgctgtgagctgtgattgtactgctacagtccagcctgggtgacagagtcagaccctgtgtcaaaaaaaaaaaaagaaaagaaaaagaaatggtgttgggtgtggttgtgcatgcctgtagtcccagctacttcgaaggctgaggcaggagaatcacttgagcctaggagtttggggctgtattacacagcagtggtgcctgtgaatagccactgcactccagcctgggcaacatagcaagacccctatctcaaaaaaaaaaaaaaagaaagaaagaaaaatgttttccagtgaagggaggtacattttaagagtgcattttaagaatgaccagggccaggctggacacagtggctcatacttacaattccagcgctttgggaggccaaggcaggagaatcacttgagcccaggagttcaagaccagcctaagtgacatatcaagaccctgtctctacaaaaataaaaataaaaaagttagtcagctgtagtggtgcacacctgtagtcctagctactcaggaggctgaggcaggaggaccacttgagcccaggaattccaggcagcagttagctgtgatcaagccactatactccagcctgggtgacagagcaagaccctacctctttaaaaataatattaaaaaaaattaagactagggcaggccagtattgagcagaaatgcagaataaccaataacctgtgttcccttcctatgtactctggaggtccacgttcccaccttcagctctgccttccccatgtcagaggcaagattccaagccagggctctttctagtccttcctttggttgttttctcatataggaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctc

SEQ ID NO: 36074 - DNA, 10429 bp, Homo sapiens
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaacgtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagaatgagactccgtctcaaaaaaaaaaaaaaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggtcttgaactcctgacctcaggtgatccacccgcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtctcgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctcccgggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcaccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggctttattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactgagattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaaatagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtagtcccagctactcgggaggctgaggcaggagaatggcgtgaacctgggaggtggagcttgcagtgagccgagatcgcgccactgcactccagcctgggcgacagagcgagactccgtctcaaaaaaaaaaaaaaaaagtaggctttcatgatgtgtgagctgaaggcgcagtaggcagaagtagaggcctcagtccctgcaggagacctctcggtctctatctcctgatagtcagacccagccacactggaaagaggggagacattacagcctgcaagaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacggggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcaggaaataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcgcaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccaccgcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccaggcatggtggcacgtgcctgtagtctcagctactcaggaggctgaggtgggaggatcactttgagccttgcaggtcaaagctgcagtaagccatgatcttgccactgcattccagcctggatgacagagcgagaccctgtctctaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagccaaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatggtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacccagcgcaggatcactgtgaacataaatcagttaatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 36075 - DNA, 11696 bp, Homo sapiens
agcggcctggctaactcctgccaggcagtgcccttcccggagcgtgccctcgccgctggtgagtgaggacgggacgcggagggggcagcgggaagtgggggcccgcatggctgcgactcttggcagcgccgcgggacagagggaaactgaggccggagccgcagactggacacccgagggggcgacccggggcagcacttggggctcggctaccgggtcagggggcggcgggcagcagagtctgggcctccgcggccggggttccagcgcgggccgcctccggctgggggttcgggagggaaaacttggacaaccctgccacgcccagcccttggccgcgtggcttctcctgcaggaagcgcggtcccaggagtggccgacgctccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccaggtaggagaagcgggggcttcctgctgtgaacgcgctgctggccagggcagctgccagaggccatggcctggcgtgggcctggagcccctctggccagcctgccaggggccagggctacgggataccagcagcgtgccctgggctggatggcaggagagacaggacttgaggctgtcccagaatgggctcaggcagggcgaggatatcaggggaggtggtgtacaggaagcagccgcccagcttgcctggcacacagcaagccctgcccatgaaggcctactgccagaacagtgggcgaggcccggcgtctctgtggagtcggtggggcccgggacagggcagcctgaggcaggtttccactggcggtgaaaggggccgtgtggcaaggacaggagagccagcctcagcccagcaggggaaggcggcccctgagtctccacctggctgctggcagccccacagggaggttcggcgaaactgaggcttgccaaagaagcctttgtccagagtcacgcagctggcgcggtggagccagggccagaacccgtgcaggctgatcccagcctgccttctccactgtgccccgaggaccactttctttcctgggagtgtgtgtgtgcacatgtgctgtgtcctgtcgtctgtacacacttgtgcctggcgtgaggcaggatgtctggctggatctaccagaaagtattcacagcgggttctccagctggggtgaggggcttgggctcgcagggagggagcctacttttcactttagcttgctttcttcctttcttccgtccttccttcctccctccctcccctccccttcccaccccttctttctctttcttctttctctttctttctttctttccttccttccttctttcctttctctttctctttttttctttcttccccttccttccttcctttcttgtttttgtttgtttgtttgagacagggtctcactctggtatgcaggctggagtgcagtgatgcaatcatagctcactgcagtctcctgcagaactcctgggctcaagcgatcctcccacctcagcctcccaaagtgctgggattacaggcatgagccactgttcctggcttatttgtgttttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcttatttgtgttttctttacttttgatggtgcaaacaatgcttggatgtgctctctgtttaaaacggtagtcttttttatttttttttttaaccactagaccactagggaagtcattcttaatttcttatttttatttatatatatattttttgagacggtgtctcgctccattgcccaggctggagtgcagtggctccagctgggctcactgcaacctccgcctccagagttgaagtgattctcctgcctcagcctggctaatttttatatttttagtagagatgggtttcaccatgtcggccaggctgtttctttattttttactaaaaaaaagtttaacccccgaacctcgaaggaaagggaagtagtctttcttaacagaaccaattccccctggataccccaccctcaccctaccctctcccaggccactcgatggccaggttcgctgtggatttttccagacctgtgggctgtttcactggttacttttgtaatgaaaaatgcacacaaaggttacgatgaggacgattagccatgaatcatttttaaaaagcctgaaaacaagtccctgggacagtgctggcttcgttggagagacaaggctcaggggagtgggtgcagctgggggtcggggtggggatcagagaagggacacattccttattgtgtttctgggtcgccttctttttttttgtttgctttatttatttatttatttattttgagacagagtcttgctctgttgcccaggctggagtgcagtggcgtaatcttggctcactgcaacctcctcctctcgggttcaagcaattctcttgccttagccttctgagtagctgggattacagacgtgcgccaccacaccaggctagttttttatttttagtagagacggggtctcaccatgttggccaggctggtctcgaactcctgacctgaggtgatctgcctgcctcagcctcccaaagtgctgagattacaggtgtgagccaccgttcctggccttctgggtcacctatagggaggtctccaagaacagaaagacaccctgaaacccactggctcgaccaccacctcatagatggggacacagaggctcaggagatgagataccttggggcagcgatgggtctggggtcttcgggccaggagtgaagcctcacaagacctggagaccctgggtcccaccctcagtggggaagggctcagattctgcagggcccgatgctctgtgggggctgggatgttgccgcggcaggtggagagagtgatgctactggccctgagagaaccttctggcaccgttcagaggtggggtggagtggcctgcgggtccaatcctggcgccgcaggctctatgagccctgtttcagatgaggaaggaggctgagacgggcggtgacacaactcctggcaagtggtcacgcggcccagagcagcccggcagacacccagctcaaagggaggggtggggtgggttttggagtcactcggacctagaaagttctgtgacttctcatgtctcagtttcctcatctggaaaatgggaccagtcacgagtccaccatggaggccgagtgggccgtgtggctcagggagaagcagctggtcccctgtggctgctgtggggactgaacaaggcggtgaccgtcgggatgagcacggactccaccacgcaggcccctgcctaccagaggcctgtgcacaaccagagctgagcaaggcttggaaccttctcctgcctctacgtcctgcgccctctaccctgccccgatcttgcccctgttttgggggcgctgctccgtgcagggcattttcacctgtggagtgtccaggggctctcgtggctgataaggtctcgtcacaggtccaagccttgaggccctgtcttcccctggaggaaatggggctagtggccccacactgatacccacaacccctctcttctctggagttttcagggaaacgttgttgtcccaccccttcctcccttgagctaccccagccccccaagaagcagacacagcgggtttacccacctgacgttggaggaagccaggcccagagacgagccttggatggaggcagagccgaggtctggatcccgattcgctttctgaaggagacaaataaagggtgtataggtggcttcacccctctgcctgagcctgagtcctgtccctgccatgtgtgccccctggcctggcccaccccagctttccctggactcatcccagagcagatatctggatcctgcctagcctggctcagcatgactcatcatggtgggtaccgcccctgcccacctgttccccatttgggcaattcaggagctgggcagttccccagaggccctaggaaactccccgcccccgaccaggctttctccttgtggggcatctgaccgcctgttttctggtggggcagaccctctgagccccttggccctgtgggtcataaccacagccaggcctgagaagggggcagcctggggtgggagtgtgagcacgggactcagaactggcttcagaccctgctctcttgctgtggccttgggaaagccaccatgcctctgtgacttttattcgttccatacaacgggggacctggatggtggtctctaaggccctgtcagtgggaacactgggtgagtcccattgtgatttcctggggaccgagtgtgtgcctggccctggctgggtgctggagccaggtgacagaatcgtggggagttctgccacgtgctacaaggtgaggacctctagaacatggcgctcagtgaaggaagccagacacgagggccacacactgcgtgattccattgataccaaatgtccaggatgggcaagtccccagagagaagtcagattgctggcggccaggggtgggagggagggggaggggaaccactgctgatggatacggggtttcttttaggggttgaaaatgctttggaacttgatacagagggtggttgcacaacattgggaatatacaaatgctgctgaatggtgcactttaaaacggttaattttaggctgggcacggtggctcacgcctgcactgggggtttccatttgtggcatgaacatcactgaaagcgcaccagcttccatgtcgtatcaaggggttcgggatgtccacgtgtcttatgctggtggtattaaccttgctcgcctggacagggacacctgtgagtgagagcaggccattagtgtggggcaggtgggcctcaactgagggtgtcctgggaaaaggcacgtacaggcaccctggtccggctcgtttccagtggaggctgaacgaggctccttatggttcccccacaatgtcactcagctgtggactcacgcaggctccagcagagcagcggttatgtcttggttgcccagatgagcagtaggctgagctggcctgggcttacctgagaggatgtagtgggaggctgagctgggaggtggtcccagggctgtggtccagagctccatatccacttggcggtggtgcagggccagtgctcagcagtacctcctgccccagggagggtggcctttcatatgtgtagtgacatcagacccccatccccaccccatgagcacgtgtaccctggaagctggagggcggggcaggagggcggggcggggcaggagggaggggcggggcaggagggagcgggagggagaacacaggaacgtttcttgccgggacataggtcacatgcccacccccccagaatgtccatccttactgctcatttttgcagcgaccttgggggatggggtaactgtccccattcaacaggcgagaaaactgaggtccagggaggggagggaatcatagtaagtggcagcaccggaatctgctggatgcctgacactctgttcctttaaaacgtgccgggcgcggtggctcacgcctgtaatcccagcactttgggaggctgaggcaggcagatcaactcaggtcaggagtttgagaccagcccggccaacatggtgaaaccctgtctctactaacaatacaaaaattagcccggcatggtggcacatgctggtaatcccagctacttgggaggcaggaggctgagacgggagaatcccctgaacctgggaggcagaggttacagtgagctgagatcgcgccattgtattccaccctgggcaacagagcaagactctgtctcaaaaaaagcgcatatctatgttatccattttttgccaaaattggggtcattctgtagtcaatgttatattctgctttcttcgtgttatgttgagaacaactttctcgttactagaaagccttcagaagcttggtttgtggggggccagtctttaatagtccctggctgctgggcactgaggttgcttctgtgctcacccagctccatggatcccaggccagcagccgccccttctccctggggccagatttgccctttgccctttgcccctgccaaagcccaagttcagcacagtctctgctgacacccctctacccccgcttggctgcctccatgtcccctggactgcttgtctctcgtgttcccctgggacgaaagtgctcagtattcttcctgtggcatctcctccctggtccctggtcagagggtccctttctgaggtccaggctccctcagcaccagtctgtgcccactcagggcctccccagccctgtgcccccctgggtcctagccctcgccccagcaggccttgctgcaagttggcagaactgaatcgggttgtgtggcttcttgtctcagacaagagcagacgactcctgattctccacctagaatcagagtgagtgggagcttagccctttgtttttggatgaggtcagggtgggagccatattgccaccagggcagagcctgggccagagtgcagtgtggccccaggcaggctgctctctgtctccggtgcatggggaaggggcggtggttttactggggcccgtgtggggtgctgaaacagctgtgtagagaccttccttgctgctgtgcactgagctgtgctcaaggtaggtgagcattgatatcccactctaccgagggggaaactgaggccctgagttgatgtgatttgcctgaggtcacagtgaggcagtgaggaaggggattagacccaaactctgtctgataccagtcaccaaatgaatgagtgagtgagtgagtgagtgaaaggtgaatgtgaagtgctggaacgtaaagcactggcctggcagagctcccaggacggggacttgacccagggaggcaggctgggaaggcttcttggtggaggggacccaaactggccttggaagagaggaggggtcagtgccagagacccaaggtcgaggtgagggtgggcaaaggtgaggcgaggcagctggggcaggagcaaggctggaaatgcgttcactcagccactcccaccccgcacatctctgcgcctcctgatcagctgactggttgatctgtgggtgacaggcctttcggggatgctggaggagacacgggcctgaccccatggcctcaggaatgccctcacccagccctgtcttctctttcagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtaggtgggcgtgcactggcctggggataagcctggccctttgcaaggggaggcctggcccaggacagagggtcttctccaggcgggccatggaccatggcatggtttccccagccccatttggcaagccagggtggggaagctgtgggcctgtcgattgcacaactgaactttctcctcctgggcccctggggggatgggtcagatgctcaccccaccctggcatccccgccatgttcacagctccaggcagaggccggcttagtgtgtgaaggttggtcttgggcagaggcatggacgctaagattaacaacggcagcaacagccccaagagcagctcctttgttgaacgcctgcccagtgccaggctcgtctcattcatactcaacgacccccataataagaggcctcccaaggacacagggcttgcaagtgtggaccccccacagccccttcaggctcagtctggcctgagtcccctgggaatagaccaggggaattccacccggaaaggacgtgctgggaggggcagggcgcctcttggtggctgtagcggggaccacacccaggaggcagggaattgactgccttctgaaatgttccctgcatcctggttctgtgccagcgcagtgcagggtggggacgcaggtgccaggcactctagggggcggatagcagaggccaggccaggtgcccggctctgatgggaataaggccctggaacttgggtgtcacgtgggcctcacccctcctggcccaggccctgcccagccagggtcctgcacttccctggctccagtgtccccaccctgcttggccttcctacaccacccagtcccagcctctcttcgggggaaattttggggctccctgtggctctggataaggcgaacccctcattagtaggtgacagccggggctctggccctggctgaccagactttatccactgatggcctgccaagagatctcagtcacttcaccgcctcagtctcctcactgtaaagggggtgctgatactgcctgccttatggcatcatcatgagactgaaatgagtgaatgcttgggaagtggtagggcctggctcctgtgagtgctggagggcatcggctgctgttactggtggtgttatcgttgccctgtgttaacagctcccatgatcaggcctccccctggacctcaccctgcagtcacagactgactcagggtctcacatctgcctcaaagcctttgcatgtcctgtttcctcccctggaaaactcctattcatcatttaaggcccaggccaaatgtcccatcctctatgcagtgccctggctaggttaagagcctcctctctacctattcacaccatgtgcttccctttcatagcagtgacagtgataataatggcaggtatttactgagtgtcctaaatgctgggtatcgcatgaagcactgccaatgtgctaactagaatctctacagcaaccctatgaaaaatgaaggcccagacaggtcaagcaacttccctgagatcacacagcagtcagtgtcaggtcacgtatgaaccatcactgtgccactcggaggtgggcaacgctcctggccttgttcctaatggtgctctgaactgcggcctctgtttcaggtacggctcctacctggtctggaaagagctgggaggcttcacagagaaggctgtggttcccctgggcctctacactgggcagctggccctgaactgggcatggccccccatcttctttggtgcccgacaaatgggctgggtaagtgtggccacagcatgtgtccctgatccctggatccgacccttggaggacgtggggcatcacatatgacactgggtcagtgtctataggcggggccaggggagacaaaaggccatgtctctctagctgtaagcagcccacaccctggagcctcccctctactgactcctccggtgagggaagctattaaagcagaaggggttgcaggggtgggtttgggggccactgtgtaggaaaacccacacgaagcctggtactgtgtgggcagggtcactggcccctctacataacagcttcttcttttttttttttgagacagagtctcactctctcacccaggctggagtgcagtggtgagatctcggcccactgcaacctccacctcctgggttcaagtgattcccttgcctcagcctcccgagtagctgggactacaggtgtgcaccaccactcctggctaatttttgtatttgtatttgtatttttttagtagagatggggtttcactatgttggccaggctggtcttgaactcctgacctcaggtgatctacccgccttggcctctcaaagtgctgggattacaggtgtaagccaccgcgcccggctgactgcttcttttttaaagttttaaacttttttaagagatgaagactcgctgtgttgcccagggcagactcgacttcctgggctcaaacgattgattctcccgcctttacctcttgagtagctgggactccaggtcacgtcactgtgcccggcagccttttttttttgagacagagtcttactctgttgcccaggctggagtgcagtggcatgatctcggctcactgcagactccacctcccaggttcaagtgattctcctgtctcagcctcccgagtagctgggattacaggcatgcagcaccatgtccagctaattttctgtatttttttttttttgagacggagtctcgctctgttgcccaggctggagtgcagtggcgtgatctcagctcactgcaacctccgtctcccaggttcaagcaattctcctgcctcagcctcctgagtagctgggactacaggcacgtgctaccacgcctggctaatttttttatttttagtagagacggggttttaccatattggtcaggttggtcttgaactcctgacctcaggtgatccacccgtctcagcctcccaaagtgctgggattacaggcgtgagccactgcacctgacaaatagcaagtttttgtttgggccttgtagtaatgctgggaggtcagcatcgctctcagtggaggctctaagctcagagaggggaagggacgtgcaagacctcctaagccaccaccgcacccttgaacaaaccgagttcacttcaggcatgtcatgtgcaccccacacaaggcatgggtcaggtggcatgactgttcccattttacagatgaggaaactgaggctgcgatgggggaggggcttggccaggtcactcaagggtggagtgggggtgagtgaggctcctgactcccaaatccagtgggagttgggcagtgggacaggcacttgggtgaacgcggtgcctcaggcctccccatcctccgtcccccaatctctgcaggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 36076 - DNA, 41872 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctggtaagggcgcggcgcccgcgggccccgggcggggtggggcgcgggctggggagtggggtacgccgcacgcccgcagcctcttgctccctccgtgccgggctgtggccgggcggcggcaggacatgtcgcgccccgaggccggcggagggcgacgccccggcagcggccccgctccgctccgggaggactccctgggggagtctcggcttcctgggctgcctggggctgaggaagtgggggcggcctccgcctctcccttgtagccgcggttccttccctatcccgcagatggctctgcttccacttcctgccgcgggcctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcaggtgagtcttcgggagagaagtgcttgtgcctggcggactgaatgaattggccgtggaagagacttggctgattgctcatctgggttacctgtgactcatcttcagcccttgtagaacagtgcactttctgctctgtcctggtttcctaacctcatttcttctgaagttttggggatggatggtgggcatggagtatcagaggggatagtgaatcttttagaggtgtcaatgactgatgttccaagcagagccataagattgttggatgtcaaagctcagaaccggtcaaggctcagaatgctccttaaacctggagcaatagaagcacagtatcgaagttcccagaaatgggccgaccatgaaaggtagcactgcatattgggaaaaacaggaggggtgagtttgaagacctgggtttgatgcaggttctgagagtttaccggtgttgtgatgtggagcacgatctttccccctctgagctccagagtcagcaactgtagaagggtgatgatagttatcctaattgttaggattaaacgaaataggagcgggggagaagaaggccagggagacatatcctttgtgcgtggctttagttgtcagccggtctgctttattctgaccacatctggggctttccttccttgcccattcacattgcttcccattggaaacagcactcttatcggagatctcagccagatttccctctgcccgaggaatagaacattttcccaggattgtgtgtggaaaatagtgtaagttattagatatcttttgggaacttgggacctagaccataaggataaacaggatttagagtcttccacggcatatgaagagattttggtagaagatgagggtagaaaagttctaaattcttgccttgactgaagatggcttgagattccatgaaaaattttaagcctgagaattgagataatcctttttttgtttgtttttgggggcagagtcttgcgctatttcccaggctggagtggagtggtgtgatcaccgctcactgcagcccccacctcccaggctcaggtgagtctcccacctcagcctcccgagtagcttggtacagtcttgcaccaccatgccaagctaatttttgtattttttgtagagatggggtttcaccatgttgcccaggctggtctcgaactgctgggctcaagccatcctaccaccttggcctctcaaagtgctggggatcacaggtgtgagccaccccgtctggcagggataattctttcttccaaatcacgtaatcctactatgcctctttgcatttagttgctaaattcttacccccctcatgtaacttatggaagttagaaacatcattagagacctttcttgaaagctaaatttggagacaatgtaagactagagtgcgaagagatctaggtgaactctgtagttttccagtgtaacttgtctccagatggtatacaggagtcccacttttccttggctccagttactgctaaacagcccctgctctagacatgcaagacgcttggtttttttttcgttttgtttttttaaatgaatgtatgttctgaatgttatcgcaaagagagccgagcacagaggaaaaggaactcttccttcatcacatggcggagtagttaaggaggagaaaaactaacagttactgagcatcagctgtctgcttggcacagaccactgatccaagccataccagttaaatatgtggccttggagatttgaccatgggctgtctcctttagctcctcagttcttttggtacctaggaatataaatattggtgtatgtgtacatatattcttagatattccaaaaagcagaggggccagtaggcaagagggttgatgagtcttggataggtgacagtggaaagaaagatgaagaggatgtggaagtgagtgtcaaagagggacggtatatgtgcttactagaagcaattgcaaaattctagccaggtctcaatttcaagtttgtcactttaaaaaaagtagctgcttataattttccttagtgttctcctggctgtttttgtttttggtgatggtggctagttgttttttagttgaaatctaaatgcagaaaagaaaaatgccattaattgataattaccaatatattgttttcattgttgcttttgtcagtgctttgtgggcattttttatatatagcattgttccaagctatacggcatgagatgaaggaaatatagtagtttggtcctgcgtgcctggctgcctgtaaagtttgcctaccttttgaatgagttttctgttgctgcataacaaatttccccaaacttagcagcttaaaacaacagacatttatgatctcacacagtttctgaagttgaaatctggggacagcttggctgggtgcttctggctcatggtctctcctgaggttgcagtcatctgaagctcgactgggaccagaggatctgtttccaaaatggcacgttcacatggctgttggctggaggcctcagttctacaccatgtgggcctatgcacagggcttttcacaacatagcttttctccccagagcaagtgatctgacgggggtggggagagagggagagaatgaatatgataatgatcaagatggaagcagcagtatattcgtggctgatatggtttggctgtgtccctacccaaatctcaccttgaattgtaatccccataatccccatacgttgtgggagggactcggtgggaggtaattgaatcatgagggcagtttctcccatactgttctcctgatagtgagttctcacgtgatctgatggttttacaagcgtctggcatttcccctgctggcactcattctctctcctgctgccctgtgaagtggttccttctgccatgattgtaagtttcctgaggcctccccagccctgcggaactgtgagtcaattaaacccctttcctttataaattacccagtctcggatatttcttcatagcagcatgagaacagactaatccagtgtctaatcttggagatggcataccatcccttctaccagcattcagaccagacctggcacaatgtgggaaaggactacaagaggggaggtcagggcacatcagtattcttggaggctagccaccacaacttttttaaggtttagtccagacatcattgagaaaatctttctttcagatgtttactgaagtatactgtaggagatggaaagacagctgaggtctttagtattgtagaagctttaatactatatgtgaaacttttatgttctttcttccggttctttgttagatgctggaattagccaagtatgcagtagctttggaaatagaaattcagatcttgctggtccctaaaccaaaaggaacatctgaatttttttctttaaccccaaaacaagttggtaaaaaaatattgccaaagtaatctcctttgatgaatggcttaaaattagtcattcattatctgtgtgttcttaaaaataaaactcattggcaaagtagctgaaaaattttggggaacctaaaccctcttactcctccccattattttaaaactttggatactgcttgtttgcctagcagttcttcagttcacttttgagaccctcatacattttaattattgacctggatagaagggcgctattcttttagctccagatgaaatcttcctgaagtgcctataggtggagagaagagtttctggatcctgagcctgagcctggctaaatgacctctaagtcccttccatctctgaaaattctatgatccttattttttttttataacgaatatcctttgagttgtgcatatttataacaaaatatttcattgatcatgttaaattgcaacctcagaagacaagcttttctgagaatagcttttgttcttcccaatccagttgaaggttgttagagtcactgttaggcagagttgaaaagtcagcactatttgcacttcctctgcttcctatttttggccccttgcccatcctctgccctaatttatgagctagtatctttcttttctttcattctactttccttgtaatccccctccttcctcccacaggaaggattggtggccagtcctttactgctgatagctgatgctattgttaggaatgaattttagccaatgtgttacctctagtaatacttgcatggcaaaccttttaaaaatctcaaattatatgtgttcatgtagtaaacactgccattttttaacatcctaagtagccctaaaatttagtcactttcctcatgtgcattgttgtctccttagtccccaccgtgttgccggcctggcctggtgcatacccacatctgctcttgacccctctgtttttctactctgtagccagaattaccttttcaacattcaagcctaattatgttacccattgacttgaaacacttcagtggctttccagtgctttcagtcaaaggtcccaaatccctcaacttggcctacactggggtcttgaatgatcccgcccttccttacctcctcagtgtcatcttgtactgggctctgcctctttctctctgctgcagatagctgtgaaggtctttctcgagtttcttgagtggactttgcttcctcttgcttcaggccttcctgaatgcagtgtgtgtgtgtgcaggcacgcgtgattgggggtgggggagtgtggaggagtcctaggtaggaaagcgcttggcacattcacagggctggaagaaggcaaggaaaaggccacggaggccacggccagtggagggtttagctgccgctcatggtgagcctttaaggagcgttaagcacagtttcatgtgcagtgttagaagccccattggaagggctgtgtggagaacagattgaagaggggctggagtggtaatgaggggtcacttaggaagctggggctgttgaatgaatggtggcagagaagatggaagaagtgcatggctttgaaatgtatgttggagatggaatagctagaaatggtcatgaattgagctggggagaggcaatgggagtcaaaaatgacttccaggtccctggctttggtaacgatacggatactagcgtgtccggaattggtgggttcttgggctcactgacttcaagaatgaagccgcggaccctcgcggtgagtgttacagctcttaaggtggcacgtctggagtctgtcccttctgatgttcagatgtgttcggagtttcttccttctggtgggttcgtggtctcgctggctcaggagtgaagctgcagaccttcgcggtgagtgttacagctcttaaggtagcgcgtctggagttgttcgttcctcccggtgggctcgtggtcttgctgggctcgggagtgaagctgcagatcttcgcggtgagtgttacagctcataaaagcagcgtggacccaaagagtgagcagtagcaagatttattgcaaagagtgaaagaacaaagcttccacagcgtagaaagggaccccagcgagttgccaatgctggctcgggcagcctgcttttattctcttatctggccccacccacatcctgctgattggtagagccgaatggcctgttttgtcagggcgctgattggtgcgtttacaatccctgagctagatacaaaggttctccacgtccccatcagattagttagatacagagtttccacacacaggttctccagggccccaccagagcagctagatacagagtgtcaattggtgcattcacaaaccttgagctaaacacagggtgctgattggtgtatttacaatccctgagctagacgtaaagactctccacgtcctcaccagagcagctagatacagagtgtcgattggtgcactcacaaaccttgagctaaacacagggtgctgattggtgtatttacaatccacgagctagatataaagactctccacgtccccaccagactcaggagcccagctggcttcacctagtggatcccgcaccggggctgcaggtggagctgcctgccagtcctgcgccatgcacttgcattcctcagcccttgggtggtcgatgggactgggcgccgtggagcagggggtggcgctcgtcggggaggctcgggccgcacaggagcccatggagtgggtgggaggctcaggcatggtgggctgcaggtcccaagccctgccccgtgggaaggcagccaaggcccggcgagaaatcgagcgcagtgccggtgggccagcactgctgggggactcagtacaccctccgcagccactggcctggctgctaagtccctcattgcccggggccagcagggctggctggctgctccgagtgcggggcccaccaagcccacgcccacccggaactccagctggcccgcaagtgccgcacacagccccggttcctgctcgtgcctctccctccacacctccctgcaagccgagggagtgggctccggccttggccagcccagaaaggggttcccgcagtgcagtggggggactgaagggctcctcaaatgccaccaaagtgggagcccaggcaggggaggtgcctagagcaagcgagggctctgaggatttccagcatgctgtcacctctcactagtagtgacttcagtagctaataaatgggggatagtgaaggagcagattttaagagggaagaatcaagaattctattttgggaataagttgagaatcttgtggcagcccagtgggcaggggcagcagcaaggctgtgagcctggggccaggagagcggtcagggctgcatcctcaggttcgtaagttgtctgtacagccactgggctgtatgtggtgcagatgaggagggagcaagactgagctccgagaagtgctgacatctagatggggaggaggaatgcctggcaagtggcgccgagaaagggcccagagagccacccgggaagcactcagcctgtgggagaatgtgggctgtggaagccaggagggatggcctcaggagggggacgctggaaggggccctatacaggcctgctgcgggccttccctttccaggcagcgttttgtcactcttgctacttgctcattttaaagaggaggagggcatgggaaggaagaaagaagagtttttattggagctagctacgtggagtttgtgggtgatcttgatctcacaaatttctgtgagcttatattgggaggaagttggattggaatggtttccgtaaatagtgagggaaggaaacaaaggcttttgctacacagtgtggggtctgtgggtcaggaacatgattagagactaggttagtggtgccaaatcttgggctccactccagacctactgaatcagaatatgcgttttcacaagattcccaggtaaactatgcattaaagtttgagaagcattagcacagataattcctatagaggaattgtgtcattagctagaaggatatatgggggtcaaaggcacacacgcatgtgtgaatctttagggtgaagattcaatagaacgtgtctacatgctgttggggatgatcctgtagcaaagtaaagactgattgatgctgcaggaagaagggtagtggtaggaattaagttcttgggcatggtggtggtggagggcttggcctttgctaagagcaggaatgtgtactccatgaggctggagacaaggagaagaagggcgtggaaggtttgtagatttgttgaaggagctctgagggagttagggtttgatggcttggtgttctctgggacaaatgaggttaggttatctgtcaagagtaagcagagggagggcacaggggagagtcacagcgagattactaggaagtgtgggggaatgcccattcgtggtttgtgatcataagtgcattgagagtggagtgctgggaggctgctttcttgagtttctttccctcgacagcagcatttgcatgctgggtgcaggtgctgaaaacagtgagtgagatggaggggaagggagcagggagatgaggtatctgcaagagggcttttctcatgtcaggctttgggatctaagctggtgaagggaggcagtgcagcccagagggtcttgttatgcagagagagagtgctggaggccaatgcttgcaggtgtcaagagggcagagaattgtgtgtgggggtggtatttgaacaagtgagcaagaaggatggaggctgaggctagagggttagaggagataactgtttctggtgacggtgaagttcaggtaatgaccatgataatgttagatagaaggaaagaaagggttttcggagaagagaggatcaaggacttgagaggggccgagcttggctgggacatccacatgcacagatgtcattggggaggacgacaggagttgggtagaatggaagtctgcagaccagaagcagatgtcctcaataaatgagggaagtgaccaggaagtctgtagctgatagtaacaaggtgaaggacaggctattatggctggaaaggccaggcctcaaaggtatgggggcttttgtaagacggatggggctaacagaggtactgaagtgcaggtgacattggggagggaggaaggacacatatctggtctgtctggccctgaagcacatggcatgggaggagaaatagcatctgcttgatgtggtgtccccagggcacacccaggtctcagagctagaaggtagaggaacattcttagaagaggtggaggctctcgaagggtttgctggtgtgcctgaggttgcagggaccaggtgggttagccatttcaggagatggatgcagttctgttgggttgagagccctagtcataggaaagagtggggacacctgcacttctggtggtgactgttcaggacagatgttcagcagtgtgctccccttaagaggagggtggtcctgttctagcaccgtagttcccaaacgtggctggggaggtggcagcttccttgtgtgatcctctcagccttcacatactgacacagcagggaagagaaggcaagactgtttctgttagagccgtttcgggagttgctggggagatttaggacagggacatcctgaaatgcccattggttatgcctctaaggcaaattacgctgtgttttgggtgatgaagaaagaagggtgtgaagggcttctgttgatgaaaatctgcctgtgcttgtttccaggtggagtatgcctttggtacgcgttttccacgtgtccctctccactgccctgagacgtaggcagggcagatattgtcagtgagtgggagtgacttgcctaatcctctagtgagtcagtggctgaaggaggactcaaagccaggccccttcattcctcaggacaagggggactgcgtctgagcaaaaagtatcttgccttatctctttcttatggactggcagcttttcctactttaccatatatttggctctgaggccagtttctttctcaagactttctagagtattagagtgatatttatttatttattttgaggtaagttctcactgtcgcccaggctggagtgcagcggtgagatcacagctcactggagccttgacctccctgggctcagtggtcctcccacctcagcctcctgagtagctgggactacagacacatgccactacacccagctaatttttgtagagatgggttttgccacgttgcccaggctggtcttaaactcctgggctcaagcgatctgcttctttggcctcccaaaatgttgggattacaggcataagccactgtgcccaggctagaatgatatttaaaaagcagctaagtgcttactgagaacttcttttaataggtattccttcgtttaatcttcataacagtcctaaggatatagccctcctgtatttcattttatttttgagacgaagtctcgctctgtcacccaggctggagtgcagtggcgtgatcttggctcactgcagcctctgcctcccaggctcaagcaatcctcccacctcagcctccaaacccagctaattttttgtatttttggtagagatggggtttcaccatgttgcccaggatggtctcgaactcctgagctcaagcattccgcccgcctcagcctcctaaagtgctgggattataggcatgagccactgcgcctggcctgtcctatattttattttattatttatttattttttgatacagagtcttgctctgtcgcccaggctggagtgcaatggtgcgatctcggctcactgcaacctctgcctccagggttctagcgattctccctgcctaagcctccctgggagctgggattacagatgcacgccaccacgcccggctaatttttgtatttttagtagagatggggttttaccatgttggccaggttgggctcgaactcctgacctcaggtgatccacctgcctcagcctcccaaagtgctgagattacaagtgtgagccactgcgctagcctatttatttatttatttatttgagatagagtctcactctgttgctcaggctggagtgtagtggtgtgatctcggctcactgcaagctctgccttctgggttcaagcaattctccctgcctcagcctcttgaatagcttggattacaggcacccaccatcacacccagctaatttttgtgtttttagtagagacggggtttcaccatgttggccaggctggtctggaactcctgacctcaagtgatccatccacctccgcccctcaaagtgctgggattacaggcgtgagccaccacacctggccttgtcctgtattttgtagatcagactgaggacaagaaatgttaactaaagctgttagcttcttaatggcagaattcaagtcaagggtttgttttcctgtcccacaactgtagttggtatataactactttttaaaaattctggtaaaatgtacataagataaaattcaacattttacctattttcaggggtacagttcagtgacattaagcatgtttactttgttgtgcagccatcaccaccatccatctccagaacttcctcatcccaaactgaacctctgcacccattaaacactgactccccactcccctcttcccccaccccctggcagccgccattctatcctgctttctgtctcccattgtgattgttttgggtacctcatatcagtggaatcatagtatttgtgcttttgtgtcttgcttatttcacttagtataacgtctttaagggtgatccatgttatagcatgtgtcagcttccttcctttgtaaggctgaatattctacatttacaccacatctgatttatctgtttatctattgatggacatttgggttgtttccgcctcttggttattgtgaataatgctgatgtgaacatgggtgtataaatatctgttcaagtccttgctttcagttcttttgtatatacagccacgcatcacttaatgacacctatgttctgagaaatgcttttaagcaatgtcagtgttttgcaaacgtcggggtatacttacacaagcctagatggtgtagcttactactcacctagcccgtacggtacagccttttgctcatgggctgcaaatctgcacgtcatgttactgtaccgaataccgtgggcagttgtaacacaatggggaagtatttgtgtaaacatatcgaaacgtaggaaaggcccagtaacagtacagtactataatcttatgggaccaccgttgtattatgtggtctgtcattgactgaaacttctttatttggtgcatgactgtataacaactatttttgttgtatattttctctcaggtctttgttttagagcttgtgctctgtgttgcctgcctatgcatttttctccctctttagtgagctttctgacccatagatctgtgtccttgaaataagtttcaacatttcacatcatacttgaagctcttccccaccccactctaatccactcatagagcacagaccatgtagtggctcagagtatggactgctagggctccagtcccagccctgccatccgctagttaagtgaccctggacaaatcatacaaactctgtttgagtgtatgcaatatactagagatgctatagaagtagaagtagaagtagtagtagaatctgtttaagtctctaaataggttttatttgaataaataattcaggatagggacatgtatgctaattccaaatttgccttcagctgttaggagtccagtagctctaatgtctccacggctgcctcttcaggtagcaggaacttcagagtgaatctgtataaatgtgtaaccatctgtaaggctagcagaatcccagattccatgggtgggtggaggaggactttatttcagaaatatattaaaataagcttccaatttcctcccaccatttattgttgctttatagttcaggaaagttatcagataaatgaattaatgtttcagagcttactcgtctgcacagtggctcatgcctgtaatcccaacactttgggaggctgaggcaggagagtcacttgaggctaggagtttgagaccagcctggacaacatagtctctacaaaatttttattttattttttgagatggagtcttgctctgtcgcctgggctggagtgcagtggcgcgatctcggctcactgcaacctccacctcccgggttcaagcgattatcctgcctcagcctcccaagtagctgggactacaggtgtgtgccactacgcccagctaatttttatatttttagtagagacgcagtttcactatgttggttggccaggatggtctcaatctcttgacctcgtgatctgcccaccttggcctcccaaagtgctgggattacaggcgtgagccactgtgccctgccaaaattttttttaaattaggtgggcgtggtggtgtgtgcctgtagtcccagttacttgggaagctgaggtgggagggttgctcgagtcccaaaggttgaggctgtagtgagtcatgatcacgccactgtactccagtctgggcgacagaatgagaccttgtcttaaaaaagaaaataaataaataaaaagcttaccagttaccatttatccttttgaggcctcacaacccaggtggagaacaccagctctggtgttttatctaccaaatattgagcgtccaccaagtaccaggcacactgggcacacaaagatgaatgggcttgaagtttggtgggacaaacagacctcatcttgggggaaatcacgactttccctaagtgaaatggtagacaatattgacaggcatgggggccccctgagactgggaggatgggctggccgggggatatctaggaaggtgaggaggaaatattgcagctgagtcttaaattataggtgatcctcctccatcaggaggaagggcagtcctggcagtaggaatagcatgtgcacagaggtacagaccagaagcagcctcctgcttacaggaagggactccaaagccttctagtttttgttttagttaacttcatttgtttttgttaatttagtttttctttttttggagggggcgcgtgggaagggacaggtaaagaggtatccattagggaatagaaatatctaaaacaaatttccttaggcatacaggagggctaattagagttgttttgcatatctaatgtcagaaaaaagtcaaaaattgaaagataatttagatcacttaattcaactttctggtttttatagacatggaaagttgagtcataacgcgtatgagcatatgaacattttccattccctggtgctaattagaatagcagctacacaagggaaggggaacttgaccaaggaggtcgcttgactcaggccagggtctgggtatgagatcgggagggctgggcctatcatgtccgaagcagggtcagggagccaggcaaatgagtgaggcaggtggaagtaagactgcagcaggcttacgctggctttcacatagtgtatgtcccttccagaagcggcagctgctccacagcaccagctgagtgggacttaggaatgtcagacttcttgatttttttaagcgatgccaaaaatttggacttttatgtgaaatcgttctttaaaaaatgtaagtaactaaatgaatatatatatatatttttttccagatggagtctcgctgagtttgccaggttggagtgcagtggcgtgatctggggtcactgcaacttctgcctcctgggttcaagcgattctcctgcctcagcctcccaagtagctgggattacaggcacgagccaccatgcccagctaatttttgtatttttagtagagacggggtttcaccatgtgggccgggatggtcttgagctcctgacctcgtgatctgcccgccttagcctcccaaagtgctgggattacaggcatgagccactgcacctggcctaaatgaatttttaaaagcactatatgagcaaacaaagcatgtctgcaggccaccaaattttacaaattggcatctctgcttttgccacatggtgaaagctggtccacagcaaggaagagagacagagccagcatgtggcgagaatcacagggatggtctggcagctttcagggccctgtgtccagttgctcctgagtcccagccctatcctcggcctccttcctgtagcatagtttttcgtttcgagtcagtgacatacattagtagtctgctagtaaatccccctttgtggtataaattaatttaccttacgtttgtttttagtggaaattttcaaacatatacgaaggtatagagaatagtacataatgcgctaccttgtcaccatcagtcaatgaatggctaatccgaccagatgccatggcttacacctgtaatcccagctactctggagttgggggcagagggcccaggacgggagtgtgtgtggggggtgttgcttgagcccaagatgttgagactgtagtgagccatgatcgtaccactgcactgcagcctaggtgacagagcaagaacctatcctaaaataaataattaagatccactcagtgttcagatttcctcaatttactttgttcaaattaggcaaaataaggagtatgtgtttaaaaaactttttttaaagcggaagaagaggccgaggcaagtttcagagcaggagtgaaagtttatcagaatgctttagaacaggaaggaaaggaaagaaaagaaggaaagtccaacttcattgttgccagtattaactctgtatcctacaataattctttgtttatatataaacaaacaatttttttaaacaaatgacattgtattatatgttttctgcacgtttctgatagaatttggatcattgccattttgtacctcctcctaaatggatacatctggacattgttcctggtcagtacatatagcacttctccattcttttcaatagctggataatctaaaatttggttgtaatttggtttgttccttccgtgggttcatcgtcttgctgacttacagaatgaacctgcagacctttgtggtgagtgttacagctcttaaacgtggtgtgtctggagtttgttcccaagatgtatccggagtttgttccttccggtgggttcatggtctcactgacttcaagaatgaagccgcaaaccttcgcagtgagtgttatagctctcaaaggtggcacaggctgaaagagtgaacagcagtaagatttattgtgaagagtgaaagaacaaagcttccacagcgtggaaggtgacctgagcaggttgctgctgctggctggggtggccagtttttattcccttatttggccacacccatgtcctgctgattggtccattttacagagtgctgattggtccattttagagagcactgattggtgcattttacagtgtgctgattggcacattttacaaacctctagccagccacagagcgctgattggtgcgttttacaatcctagctacagaggactgattggtgcattttacaatcctcttgtaagacagaaaagttctccaagtctccactcgacccaggaagtccagctggcttcacctctcactatcataatttatgcaagaattccccattgatggaaattttaaagattattatagcattctttttagtgacaaaaaattattcttgtaattatatccttatacttttgtagaataaattcctggaagaggtttacattcatataattcttttagtagttgcttattttttcccaaaaggctgtggcagttaataatatcagtagtattcatttccccaaactcttgatgaacccaatctaatgttttatttacatttccttgactactagagaaattgggtttagcttcatatgtttgttatctgtgcccacttttctgtgaagtacttcttcattttttgcccgtttaaaaaaactaggttgtttgacttactgctttgcaggggctttttatatattagggatattactttgttttgtgttgcaaatattttctccttatctgtttgtctttcagttcttcttataattctcctttgcttttcaaattattttcccgttttttagctgttgaattaaacatttcttaccatattttgattccctgcatttttccattactgcttcctgttgggaacgcttgtttgaaaaaaataacaggaagttgaattttaactatactgttgagtttgagcttttgtaaagtcaaaagacaaaattatcacaaatgtagtttaaagatcttaactggctttatttgcagttctggtatcgggcagcatgtgattccataagattgtgttcgagtgagctgaggagaggaggctggctttgtggaaagaaaagggctgaaaaatgcagaaacatagaacccaaaataggtcgtttcaaagttactttctttgtaaggccggaacagggagacacaacaatggaaaataactggttaaaatcggttagtttttgttgtaaggattaaaacaaaggaaaggtcatttctgtgattgtaggaaaatgtgaattttctgactcaggtgtgccctccaccttgaccagtctccccttggtgttctcccgaagcagagcccttccttctcccttgtttatttaatattcattatagttatggatttctggattcctaatttttcaggggtctgttttcaatactgttcttgtttttgtccctacattgtcccagctttaggattgccagactcaaatattatgattatggcctactaggtgaccttcagttcatactgtctggaggagtgctgaatgcagttattggcaggtgtgtaatgtttgactgtttgctgtgtgcttctgttgccgtaatactcaggacacagaattttaggagggggactgagagattaggtttcccctaggttttcagattctcatttgtgattttcatgacaaccctatgatactgcaaggtggcatttggacacgacttaccaacgcatttcctctttgctcaagcttaataaaagactgactatattggcctatgggactaacgctagtagaaaccacctcttcctcctaacatgtatggttttatgtactatgatttgctttcaaaatacattttacttctcaagtgaatatatgttctggtatttggttttatgctaagtggtagagagccctatctaatattagtgtttcatataacattacatagaaaaaccatttcccagtgctcttgccccactttcccgacaagtcatctaagtggacatccttagtttggagtgtcttgttattctgtatccttgttgattcagtgccttacaagctaagatgggctggaggacccgcctagcaatgactccctgttttctctagaatcaaagtttcttaagatggcactttaggcccatttatagacagagctatctttggagactcattacccaggcacttccccatcccataccttatgcttcaatattatgtgactcctgaacccactgtgatgtttcatgcctttgttgctttgcacatgctgtgtgttaagctggaatatgttctcactcccatctgctgaatggactattattaacctttggagcctccctgattcccttttcctggagttcattatgctttccattatatcttgtaccatctttatctttgcatgtgagaaattacattaaaatgctttatttatagaagtctttcattgggaagactgaattttctaaggggagaaacccaaaacttggcacaaagtagagcccaaatgttttttgaacaaacttcagtcaaacaacagagcttttgggtgagtagatagaaacatgttgaagggtgccatcttaactcaggctgccataacaaaataccatagactgggtggcttaaacaacaggaatttattttcccacagttctgaggctggaagtctgagacagggcaccagcatggttgggttctggtgagggctcccttcctgccttataagaagaggaagagatacctgagctgccttctcagtgtgtcctcacatggtggaaagagcccaggtctctcttccttctcttataagtgcacccattgaataggatcagggccctacccttatgatcttatggtttgcaagtggtccccgccccacagatgtagttctgaaattgttagtgaattcagtgggggaagtctaattgctttggggaaaatgaatgtctgtgcttcatgttagggacaaagtatacggatacctgcaatttacactgaaatatatcggaaaatgaggtgcactgatgggtagagagagggacgacagatgaatggatttgtgataaagcaaatggagcaaaatgttgattgtaaagtccaggcagtgagtgtatggattcacaggatggttgtttcaacttttcttagtgtttgaaactttttgggataaaatgttggggaagatacctgtatttttttaagaacacatttattggctaggcatttccattataggtattaaatcattaacgtgagcttcctaaacttaactgatttttttttccttcctgctctttctcctcctgtctttatctagtcagttccttcagctcttagttcatgcgatgtccctccaggaaatttcccctgaccttccagcctgatacagatatgtctttctgtgttcccagggcaccacttgcatacttctgccatagaatttattatcttgtactgtaatcatttacttactaatctgtctgaaccactagtctttgagttttttgagggcaaagactgtgttctggaatgtttttggtacaagaaaaaacaaacacaacagtggactctttgtggcttaaacagttagaagtttcttatctctaataccctgtgtcatcgcccgttgggtcttcctgcccactgcacagacaaaaccaattcactgagaccatggtattgcagtaaagagagttcagtggactcgaggctggccacatgggagaactggaattatcagtcaaatcagtctccctaaaggctcagagtttagagtttttcaaggatgttttggtaggcagggggttagggaatgggtgctgctggttggttggggatgcaactataggggtgtagaaaatggtgcttgtgcccttgagttcacctctggatggtggcgaggaaccacaggactggttgagtcataagtccatgtggggtcagtctgaaaaacatctcaaaagaccaatcttaggttctgcaatactgatgttatctataggagcaactggggtagtccacatcttgtgacctctgaccacatgactcctgagcagtaagggattataggaaggaggcctatattttagcagaactcaggcccctcccataattctaatctcctggccttttactagttttataaaggccgtttcagtccctgaacaaggaaaggatcaattttagggagggactattattatccttgttaaactagaaattcctctcagggttggtgtggcctatgcccaggaataagagaagacgccgacctgtaagaccagaggcaagatggagtcagcacgttcagcttctttcactgtcagaatctttgcaaaggcagtttcacccaaagtctggaggttgctgtttctaggattggttcagtgaggggcatgtggtcagcacctctaccttccctgttctttcccttaattatgccaagttgactgaagcagtgatacaggctggaaatatccaccatggttatttcagtttttgaactttaagcacagatattttgggaagtatcggggtgtgttgaatagttttcaattcatttattatttcttctagagaaattgacttgtttttgaaaacagcagttcagaattagataactacacgtgtttgcaaggatcccccccaacctggaaaaatatccttttcagacagccataataattcatagaaccaggattgattcagagaaattgtgtgacaggttgatggtctggaggttccaacctcattcacaaacctcagctctgtaggaaacagtgtggaccagaaatgaggccagaagtagtttcaccttcctaaactcaagccttttggggaggtctgcctcttattccatttattctattttagccacatttcagatgtgcttacttatctagttacttgcttagctcacttatttaaaaaaaaaaagtacgtaatttgcaaagggggagtggaaagaacgcctggtgtaggcaggcggtcaagagtaggggggagaagagcaaatgtgatctggactcctggcagccaaggcctttcacaaactgatgagtgccctgaggtcgtcaagagaaagcttggttatgttcagtctgtgctgtttcagaagacagagaaatctaatacatgaaaagtaacttgcaacactacataaataatggcctcaaacaggttttaaatataggaaggtatagataaaattctggtatacacagttaatagtgagtatctctgggtggtaggatcataggtgctttttatgtgtattctgtaaatttgctatgagcatcgttacttttaaaatacttaaaaagtattttaagcattcagaatggttctttttcaactccatcaggtctttcaatgatgtcatttttttcacattttgcctttgtctttgttaaaattgatcaactaatactttttataatatttgcctgaagagtcctgcttgttactgccattgactctcatgaattgcgatttgcttgtgttttgtgagctggaattttaggctttagctgtgagactcccgaacactcattgccccttgttcccccagagaggtttcgtttagcattgcctgggcctccagcactatgagcagcctgggaccacttttcatgttactttattggctttagaggagtgttgtgggtataggttttcaggggagaattccctacagccagagcccagacaagcttccttgtcattttcctctgttggcgcacagatggtgtgctccttcaagggtcttgacttctcagttcccaattgaaaaggtgtctcaattctaactgctaccttgtgtgtatgtctggtctcccagccatgtgaatgtgtgtgtgtgcatgcgcacacatgcacatgtacgttaaatcctaaattaccaagaacagcaaccatccagaactgcaggaactgccgctcttactgctctgattctctcctgtttggggatccttactttcttttgagctcagctgtgcatttaagagcaattctaagccttggctgctcatgaggatcacctgggaatcttttagaatttcccatgcccaggttgcatctcagaccaattatttcagaatctagggtgggacccaggtgtaaggatgtttctgaagctccctgcatgattctgttgtatagctaagaatgggaaccactgatttaagatgatgttgttttatttcgcccagtgatgtgtgtgtgtgttgtgtgtgtttatttttctagtggggatgttttcaggctatctcgtcagcagtaagggaaataggagtccaccatgttgtagttagaatgaacactctcgtaaagtggcctcgttgtctggagtgacatccagagttcttggtctcatggccaaggaaatcaaggatgcagacacaccaagggtgaggtttagagcagaaattgaataggagaaagaaagagaacggttctctgccacagagagtagtcctggaaaaagggttgccatcctgcagtgaaatgcaggggtttttacagatgtgctagtggggaggcagtatctgatctacatagggtgtggaaaaccagttaggaccaagtgtgccatctgcataaggcatgactctctggcagcacccaccacagtcttttattatgcaggcgagtcctcagcctgagctactctatgttgcttatttctttcctattgcacatgtgctaaaaatgggggaggtggaaccaccatggtggacctgcctggccccaggtagcccttctattggtgcagccgctggcatgcagctgtgcaagcctccggcttccttatctatgtttgtaacctgatcttccaggctgctcttttttagaaaataattgatttcttgggctgtgttttgttagaagggaagttctggccaggtgcagtggctcacacctgtagtcccagcattttgggaggctgagcagggggtggatcacttgagatcaggagtttgagaccagcctggccaacatggtgaaaccccatctctactaaaaatacaaaaattaactaggcagggtggtgcgtgcctgtattcccagctactcaggaggctgaggcaggagaatcacttgaatccaggaggcagaggttgcagtgagccgagatcgttccattgcactccagcctgggtgacacagtgagactctgtctcaaaaaaaagaaaaaaaaaaaaggaggaagttctgccgaggactctttgccctcactatctgcctaaatggtctctttctacctcctgtatcactcttacaattagatgggatggaaaacaacattggttcattcctactgggtgctgggtctgtgccttggtgttttccatgtatatcctatttagtcctcagaacattcctgcaaggtaggtggtggttggttttatgcacataagaaaactggcttggagacattgaactagttctagggtcacgcagctcacaaatggcagaaccacactcatgcctgccagatgcccaagccctgccctttattcttgtgttttggtatatgtgaaatagatttttccatacaaattggttaaaataaagattggcacttgggttacggtagattccaggtccctgttaaatatacttacttgggatgctttgttgtcccataatactggagttgctctactcattttatcttccttctgattagggcaaattgattttgagatttctccttttaactctcatgtcatgaaggggtatttgttcttgaactcacttctttaatcaaccagagggatgtgtggggctgtgtaagagtgtgagagcatatgtgtgtgtgagaaagtgtatgagagcataagagtgcatgggagcatgtgcgagagcgtgtgtgttctgtgaacgtgttacagcatgtgagattgtgtgtggtgtgagcatgtgaacatgtgtgtgagagcatgtgtgtggtggcgtgaacatgtatgtgtgagagcatgtgaacacgcatgtgcatgttagagcctctgagcctgtgatatgagcatgtgttagagcatgtatgtggtgtgagcatgaacatgtatgtgtggtatgagcatgtgaacgttagagcgtatgtgagtgtgtagttgtgtgtgtgtgtgaaagcgtgagtgcacctatgagaggacaagtgtgtgatagtgtatggagtgtgtgttgtgagagcatgtgagcttgtgagtgtacatgagcacaaatttgaaagtgttgtgagagcgttgtgaacgtgttatgagtgaaagtgtgtatgtgggtgtgtgtgatagtgcgtgtgtgatagtgtgtgagcttgtgtgtgaatgtgagcatgtatgacagcgtgtgctagcatgtgtgagcctgtgatagtgtgtgagagcgtgtgagagcaagtgtgtgaatatgtgtgtttgaatgtgagaacatgagcatgtgtgaatgtgagaacatgagtgtgaaaatgagtgtgagcgtgtgtgtgaatgtgagttaatgtgagcgtgtgtgagcgagtgtgaatgtgtgaatgtgagtgaatgtgtgtgaataagagcatgtgtgaatgtgtgtgcgagtgtgtgagcatgtgtgaatgtgaatgtgagagcgtgagtgtgtgtgaatgtgagcgtgtgtgagtgtgagcatgtgtgtgaatgtgggcatgtgtgagtgtgttagtgaccgtttgtgagtgtgaatgtgagagcgtgtgtgagcgtgttgtgagtgtgtgcgtgttgtggggtagagggtaagagggcaaagcgaggagtaaagctaaagagctggggattgaggtcccaagctgttctccgcggcagccgagaaccgagcagagaggtaggaaactggagctacgagcggtttggtctctgcctcagtgaggccctgctgagggtctgatgatttttggtgactgggtgtcctctccaccctgcccagtgaggcgggcgtggggtgtgcgctcctgtttctcccctctagccttggcttcgccccagctgtgctggggtaagtgacttccagagttgttggagggctcgcatgtctgccctgagcctgaaaggattactttcctgttggaatgtctgggttagttaggctttaatggaggatgtgaatgacatttggttttagctaggttgaaagcaaatcgcctctaagtctttgtctttgtcatcagcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgaggtaagccctgctaggcacagaccaccttcctttggcattggccgtagcagtgtccctgctcccgctgtttctgtgccggtcctcccgtacacaggggttcacggagcaagtctgtgttgaggtggcttctgaatagcttcctaggaaggtctaatcagcataagatctggattgctgattctaggtaaataatttcaactccggcggggatgtgagagatctctgcttgcatcgtttccattgttatacttcgagctttctttctgacaaaagcccaggggaggagagaggagcctttgtacagattttccaaacaacacaagcatttagccttgtgattgtcagtcaatcgcgaagtgaaagagagtgaaaggggagctgagctgtcatacaacttaatcctttcgcaagtgatagacatcagatccagttctcccgtgcggcaaggtaaagcttgcactatccttgcccaaaatttacgtcacctacttaatgtggataacatcactggtgttgagttcagtgtgacaacacagccttgatccccggagctacaaaagtccctgcttgagctgtttgctaggatacttagcctactgtgggctctacatctgcagattcaagcaatgtagaatgaaacgttgcggaatgaaaatattcgggaaaaaaacccaatgaaaaataacaatgcaatgataaaaacaatacaaattaaaacatgcaatgtaacaactgtttgcgtagcctttacattgtattatgtattataagtaatctagagatgatttaaagtgtacgggaggatgttacatgtaaatgctgtgccattttaagtaaaggacttgagcatctgcagattttggtatttggtgggggtcatggaaccatttctctagggataccgagggatgactgtagtacaggcagggagagtgttccgagcagagcttaaacctcagggcctctcacttgcattgcggccacatggctttatgagatttgcgaaagaaagctatcacaaccacgtcagttaagatcactacctcttttcactagactttcccattgtcctgcttcctcttatgctgggtgcagctggagtggccatgggcattttcggcctctagctgagggagtttgtgttgggctgggttaggtgggaatagtggtatgtgttggtgtggtttggagtcacgcggcatgtggcgattatcgctggctgcaggagtactccaaccgcccactgtgctgacgtgcgaacatcgtgatgtgaggtgcagggccaggggtggatcctgatgcgaacctgtcctgtggcacctgacacaagtgtgtgagagctagaagctagaaactgggccagaaaagtctttcagatcttacagcttgtacagtgaagctcaatagaggtttcctaaatttggcagtaatcccaaaactttcattactagaaatgccatgtagtcacatgcacatgtatgtttattgcagcactatttacaatagcaaagacatggaaccaacccaaatgcccatcaaagatagactggataaagaaaatgtggcacatatacaccatggaatactatgcagccataaaaaagaatgagttcatgtcctttgcagggacatcgatgaagctggaaaccatcactctcagcaaacacaggaacagaaaaccagacaccacatattctcactcataagtgggagttgaacaatgagaacgcatggacacagggaggggaacatcacatgctggggccttttggggggcggggggcaaggggagggagagcattaggacaaatacctaatgcatgtggggcttaaaacctagatgatgggtcgataggtgcagcaaaccaccatggcacatgtatacctacataacctgcatgttctgcacatgtatcccagaacttaaagtaaaaagaaaaaaaaaaaaactcatgtagttgtgaagctgaaagaacctcttctaagctgtcagaacaaaagacattttcattaaccatgctaaaggaaagactaaattattttttattctctataggaatgtttcaaaatcattggcatatgacaagaaaaagtatacagcaaacaaaaaagtagaaggtattctagaggtatgtcaggcagtttaattaataaaaatattgttattttgctggattttgtgatgtcagtgctgtttgtattagttttttttattactgtataataatcacaaagttagcaggttaaaacaacatacatttgtcattccatagtttccatgggtccagaattggagcctcagctgagtcctctgctcagagtcccacaagactccactcaaggtgtcagctggggctgtgacctcttctgaggcgtgggggtcctcttccaggctccctaattgttggtagaatttagttccttgtgggtgtaggacacaggtgctcggattctacaagttgcccgcaggcccctgccatgtgccgtctccataggcagctcataccacagtggcttgcttctccaaggccggcaggacagtctccagccagcctagacggtcttataaaatgaaatggaaacatgggggtattcccttcgcctcactgagagtcacccgggggtgagatcgctggagtactcatctttaaaactttataatggattatgatttctcattcaatgtcaacatttactttaatgtccagtattacgtgtgtaattttgtatcttaaggaagggcccccataatgaataagcttcaaacccaaacctggttatcctcctgggtcatgctccccatgtcttataatgagacacttttgtgtttggtacctgcttttctttatcttattctggggggtcaaactggataaatctaatgtaatctgctgaatttccccaaaacgtttttgcataagagaagcaggttgggagatctgcatctgctttgtaggtcttttgtttgtttttgctcaaaaacttataatttgcttacgaaagcttttttctcccctataacagaggttggggaagagagggggtggtgagtaggggaattaggattagggagataggattagggaagtagttgttaacagaggtgagagagggggattttgcttccccagggaatattcgtaagtgcctggagacatttttggccatcacagcttgggggaagatgctaccagcatctagtgcgtggaggccaaggacgcactcagcatcctacatcacacaggacagccccgaacaaagtattagccagcacaaaatatccacaatgccactgttgagaaacctgcattagaggcagagccgtggcagatccaaggagagaagattcccctacagtgttagtgattgagaggccctgggttgccagttccaagagcaagttcagatacagagctggggccgggcgcggtggctcacgcctgtaatctcagcactttgggaggccgaggcgggcagatcacctgaggtcaggagttcaagaccagcctgaccaacatggagaaaacccatctctactaaaattacaaaattagcctggtgtggtggtgcatacctgtaatcccagctacttgggaggctgaggcaggagaatcgcttgaacctgggagatggaggttgcagtgagccaagatcgcaccattgcattccagcctggggaacaagagcgaaactccatctcaaaaaaaaaaagataacagagctagcactgctgaggagactaggagagcctggtctggaggtttctgggtgtgtgtgtgttggggaggggggcgggggtgggtaagaggagggggcagatgcatgcagaagattcgagagttttttctcttctttctgttctcttcacagagaccagggaaagctgtgcctggccttagtctgtttttctcatgggctaacatacttgagaactggaaagtggcagttattgaagaaattgtaaaataaaattggggcaaggaaggaatagaaatgaagtgatgtatgtttgggggaggagttctaatcgattttctaaaacggtgctaatagaaacttccatgatgatgaaaatgttctgtatctatactgtccaatacaagtggctattgtgcatttgaaatgtggctggtggctactatattggacagaatggttctagaatcataattttttagctcgaagagaccttagcagtaattgtcaaacctagctgattatagaatttcctgggagactttaaaaaaaaaaaacacctcctgaataatattggtggagttggagaactgggactctttcagtggtgctcttctggtggttctgccgcgtggccaggtgtggcagctcctgcctgagagatcatctagtcaggaaattgagctctgtgttcagggaggccggctgtctaaatcaagcttgtccaacctgtggctcaggatgactttgaatgtggcccaacacagatttgtagactttcttaaaacattcagagattctttttgcaatatatttttttagctcatcaggtatcgttagtgttagtgtattttatgcgtggcccaagacagtttttccgatgtggcccagggaagccgaaagattggacacccctggtctaaagtctcctgcaccattcagactctttgttcatagtgcatgcttaacccttatttaaaattgtttagcttatgtgatggaattttcatgaagattagattatggaaggagccatagtcccagagtctttattcttgtctaagttctgactttgagaaaaattggagggagctgccagggtggcagcagtcagattttaagctccttatgctcggcctaacatactcgtttttgccttttttgggagagtaaggttggggatggagaggctttggcagcaaccgtttcagactttcagtctctggcagcttagaggaaagtcagcttagaaagaaagggtccacgtgaagtttgtcttagactcttgggcatctgaaactgagccatgcagagctctgcaaggccagtaggggatacgtatggttcacgctaatggatacaaagactttgtgattttctgtttccagctgagcaatgtaaataaacatcagggttgtaatggaatgttggggtaatcagcatacttttcattgagtacagaggtatgtaggtacagcaggacattctgacttctgtgtcaaaggagccagtggaactctggctggctttatccttggaagctcagaaatatacagttgagataatttatggtagaattcagagattttcaggggacagtcgtgtgttggatttttttggcgtgtatttttctttttggaaaggagttaaaagaaggacacttgaaagcacaggcaagttttcacatctctatttggagataatttattagtacacgttgaagagaacctaatactaaacatgtcttaatatttttatttttgagtagctgttaactgacaatacaaggctctttttaacagtcttcctcaaataacctttaattcacttggacattttcaattccatttttaagttaaaaaaattttaaatcacagccttattaagatgtaatgcacatatgaaattcgctctttttaaagtgtacaattttttttttttgagatgtagtttttctcttgttgcctaggctggagtgcaatggcacgatcttggttcactgcaagcgccacttcccaggttcaagtgattctcctgcctcagcctcctgagtagctgggattacaggtgtgcaccaccatacctggctaatcttttgtatttttagtagagatgggttttcaccatgttagccaggctggtctcgaactcctgacctcaggtgatctgcctgccccggcctaaagtgtacaatttaataggttttttttgtatattcatacagatgtgcaaccatcaccattatctaattttagatcactttcatcactccaaaaaaaaccaacctacgtattagtagtcattccccgttattgcttccccgtcccacccctggcctctggcaactgctttctgcttctatggatttgcctattctggacatttcatatagatggaatcatacaatatgtggcctttatgtctaacttctttcactcagcatcatgttttgaaagttgttccatgttgcagcgtgcgttggtactacttcattcctttctcaaaaacccacaccactgaaagcctcttggtacactgtgttagttcattctcttgatgctgtgaagaaatacccaagactgggtagtttataaagaaaagaggtgtatagcctcttttcttccacagggctggggaggcctcaggaaacttacaatcatggcagaagggggagcaaacatgtccttcacaaggcgccaggaagaagtgcagagcgaagtggggaaaagccccttatgaaaccatcaggtcctgtgagaacgaactcactatcacaagaacagcataggggtaccgcccccatgatctcattgtctcccataaggtcacttccccaacacattgggatgataattcggattacaacctaaatgatgagatttgggtggggatgcagaaccagaccatatcatacatcttgccaaattacttttcagatgaattttatacttccgttatgaataagaactccagttttttgatatacctaatgttaaatgacgagttaatgggtgcagcacaccaacatgacacgtgtatacatgtgtaacaaacctgcacattgtgcatatgtaccctaaaacttaaagtataattaaaaaagaattccagtttctcacccttgcaggtgtttgcattaaaattttatactgacaataatattgccaagtgttctgctctgtgcctggtttcctcatctgtaaattgggatatctgcctgtattgtttaaaaacaaaaaatggcaaaacagagctataaagaacagaagtgttacgtaaaatgttgcttctgtagtgtcctgttcatagtgtgaagtgcccatatgtggaattttgttttttggcagattttgttccccttaagactttgttaattaccgataatgtttatttcctcagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcaggtatgtctgaaatgaaatagcagaagcccccaggaagctttttgccttttctcatatgtcttaggcctatgaagaatttggggctgagcatactaggagagggctgagcttgttctcaggaataattctgtctaaagaatcttctggggctttctgaatcttggcacattatagactatgatgattataatctctttgggctttcctgatctgtgatttctgaataaaataattttaagagtcttactgtccccgaaaacaatgaagctattccatataatcaagaacatataattttgttcctataaatactcagagattttcattgataaattaaccatctatcctttaaataatgttactaaaaaaagtagcaggtttagtctgtgttgaaggttatgaaacaatgactggaaagtgaaagatgggagtcaaaatgaccatttgctgctacttaaggactttcagcacagtggagggacgagaacgcggctttagagtcaggagacctggtttgaatccctgccttgccgctcactgaccatgggcaagtttacttagtgtcaggattttgtttctttctctggaaatgcacttgtgagttgagaaatgaaatgaaaggatgtattagactgtgaatttcatgtgggcaagaacctggctaccctccattgtcccctgtcacagtgtagacacatggtgcttccatagtgagtagaatatccattgttatttattttaaaatatggcaactattctccatgaaggtgttagagaagaaagaaaaagaaaatatagcagtgaaaaaaataccttcagttcattttgttataaagaaatagccttttgggcataattcttatgctctataaatgtctctttaccccatgcccttccctttctcctacataattgagttttaaaaaatctgttcttcttataaacatatctatctagatgactttttaagaagcagatctagagtttagtagggaactgaagagaaaaaacccaaaaatcaaatcagtttttttcattcttcagcaagttctggtctgacagtaaggtggtcaaccagaggtgaaaaggagaaagctagctatccttccaggacttggatggaagcatcactgagccagggaggcctcgggtgagcacaggtcacccagcagggctagtgaaagataatagggaggtgcctcagtgatgcttcatagctccaggcttcagagtcgaagacctacttttctggaagcagagtgcgtgtggtgcagtgactagttaagtgactatgactcattatgagaagttctgttaatttttagacatttcagaccttcctaagggctgctctgtttgaatgtagcccatgtatttataattgtttgcatctgcgtagtcctgtttttaatgcctcatagagggtaaaacaggacagatgcacacactctcttcttttcttccctgtcccgagccttttgatttcctgttgttctgtgacttacttagaagggaagtgggcaggagagttctctgcagaggatatggagaaatacaggtatttcaagtgctccttgtcctctcctcagtcaccacacatgcacagatagcactcgggcgttctcacagagttggagcagggctcccctcaatgtggaaaagggttttggttgttaggtggaaagagagatccttagaagaaaaaggacagatgaatacctaaaaccagaaagaaggggaagttgacctctgcgtaggtttctcatgttgttgggaacagaagaatgcaggtcaattatctgagccctgtggctaaactcaagtcactttacttcatgtctgttagcagttttaaaacagcatttgtgtactatcttccaaatagaaaggccccaatataaaatgacatgtgaatatgctgtcttccttgaaactttttctggaaaatattttatgaactaagataagttctgtcataagagaccagaacttggtactcccatttttggatcgatatgtttatcaatgaggtaattttgtgtgcccctgcaagactaatgagccagaaagctatcagtttttattgttcatagtttataatgatcacatgacttcaaatgtatcatgttctttgaccccagttcaaatgtaggctataacaaggctacacaaagccaatttcaagcatcttttcatcttttttagtttgtcttaaaatatttgatgtctggcacttaaattgactacatgaaaattttagtttttttttttgtttttttttttgtagatacaaggtctccctatgttgcccaggctggtcttgaactcctgggctcaagtgttcctccctcctcaggctcccagagtgctggcattacagatgtgagccaccacgcctagaaaatatttttattattgtgaaatgttaccctataccatataaaaatcaatacagatctctacaaaatacatttttgaaggggactctttttagaatgtattggcatataaaagtagaaatattctcatgggaccaaaataatggaaatggggtatttaatttttttaaatatttagttttgattagtactttcagatagctgataatttttagtagacgtaaaatttaatatgctacgagtaatggtatttttgtagaagacacttttgaagtacttttccatagggcttgtcgtatttcctttcatttttttcactttgtagtagaaaaatggtacgtattggaatgtgattactgcctaacatatctgtctcgattctgtggcctataacattactgtgtctgcatggaaactggggatgggatgacatacttgtcgtgtacacatgcagatctaatcaaaactgaagtttcaaaacaatacaatattcacctttcctacttgagattcccttggatatttctgatctggtcagttctgttctataatctatttcactgcaggggggagaaactgctggttgcgacccactagattggttttgtgatccactaataggctgccaccttccatatagaaaacactggatttcatagcttttatgtcacaaacaaatattttcaggggaattaagcattttatggagatagttcccttagcttgtttttattgcagagattgaccatttttcttctttttgtttttttttttgtgtgtgcataagttggggaccctgttgtgacgtaaaatcctgggctcctatccagacacttctgtaagactgagcccagaaatctgcatttgtgatgagcatcccaggggattctgatgtgggcaaactgagaagcagacttggaaaacacttgtcttgctcatgactgcctctagggagtgctttctcagaacatgccctaaatctagtgatttttttttttccttctgccttaggaaagccttttattttagatgggttcacaaaaccagggttcgttctttagtttttttagctgctgtatttttggtgtaacaccttagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtaggcgtgaattctgtgtatttctcagaaacagacctgagaaacagcagaatggaggcatctcatctgctgggttttagggaaccatttatgaaaactaggtgaagattctgattcctatgaatgtctaagccattatcatgattataatgagaaacattgagaggatgtcaccttgtatttcagacaactcacagaaccttttactttgtcatgaggcttcattagagtatgcttaatgtgttcttttgggtttttcttttttgagacaaagtctcactgtgacaccaggctggagtggtgtgatctcagttcactgcaacctctgcctcctgggctcaagcaatcctcctacctcagcctcccaagtagctgggactacaggtgtgcaccaccacactggctgttttttgtggagatggggtttcaccatgttgcccagggtggtctcaaattcctgggctcaagtgatctgcctgcctcagcctcccaaagtgctgggattacaggtgtgagccaccacacccggcggactatgcttactgttggtgtggtcctgggaaggatggtgggacgaggccattggtttgtgaaggctgggctggagggatggacgtcattagcttctgtgtgtgctctcaccttccacagccttgctcttcaggagcagggtgggcgggcctggctgcttctaggaggttcccctggaggtgcccttgaaagatacgtggagcttcttgattttgctctcattgagttattggtcagatttgttcttttcaccttactgttcactgacagagccacagtgttccatctttgtagtgtagtctctaaatagtatttgctctcagaactcaaatctctgggatctcttttttttttttatctcttatcccatcccagcatactttctcattcaaatctctgaagctaataaaagggtgaccttgagtgacaatgatgaatgctgacaatttgaaaatccacctatcagggattgctattgttaggccttttttctttttaaaattaaagttcaaggtggttgccacacagctaaaattttaacgctgtgccttaaagatgaggctttctgccttgacctcattcactagctctcactgcatatccatgtgcttgtagaatctaagcacatagcactttggcagccacacagtggacacgtctgctttttgttctgcagcatcagcatctgaatcccctatatcctgtcttctgtttctctttcttgtgcagaaacattcccctttgctttcattacctgacaagggagagatttttatccaagctttattttcacttgaagtgatgctagaagaacattggtatttagaatgttggtattagaaggggtttgctttagacgcacttcggcaagatacatctatttgtatgtatcgtacataaaaacatgtatcttaggagacatatacatataggatagatatacatataggatacatatattgtacaacctaagtccgtttagttgtaatctgcaatgggaagcgcgtgttccgccgtcagcttttctttatattgtcatctctcaactcttacactcttatattattgtgctacttaaaatatttttattaaattattttccagctgtggaaaccacacaggaaatccagaaatatggctcattttaaaaaaatcagggagactctctcagcttggaactgtggatgtgtatttcctggatgggttgtcgcgtggggggtctgtgttgtcatctccccttgtctgctggaccagcttgacctgccaaacaggaaccagcagagacttatgactggcagcatggtattcacttgtaaagaatttctatgaaaggtgtgataagatcagcccatgaacaactttgtcatcattttaagttggatgcactccattcccctcctcttgtcttttgctgttaggacaaaaagacaaacctgtagcatttgaaactgttcactgttgctgtcttgggcagtgctttcctgagaggctggcaagaagggatgtttgggttggcctgatctagctgggggctggggttgggggtgcttttctgtgcctggagctagtggtaaatgcatgtggagccccacactccagaggcttgatcttgcttttcaccaagaagaaggtgtggccatgaaggagcttgtggttttgtgtgaatgtctgaagataagggctgtgctcagtcccacacttgcagtctctgtcattctctatgagaaatctcaaatgtctcttcgtaggattcatattttgtctgcttgggtataatcagtcctctggcatgatggctggtagcagagggcaaaacccaaactactgtgacaaaaggataatccatatctaagtaacacactgaccttcaaaggacaagtctcatcagttcttgataaagttcctctcagctgacatcacaagggtcggaggagtggttgtcctgagattgagggtgggggagtgtgtgtggggagggatagggtggccagaaggacatctctcatcctccatcttctcagtcgcctagtgcaggagctttagttgttgatgctttacgccctccttctcccatcctactgcctccccagggtggctgttgtggagttagctgggaaagctgtcatgcataatgatgttccaacctccatggggtccttgtaaggattaaatcagatgcaggggtgtcaagagcacctgggagcagggactcattatggcattcttcccttccctggtggttggaaatgctagaaagtctgcttgctgttattactctcaatatttgtaaattttataaatgtatagatctgttatatgcaaaaatatgtcttacccttcatcacacttattgtaagattttatcattttgaaagcagctgttaggccgggtgcagtggctgacgcctgtaatccgagcacttggaaggctgaggtgggcattgcttgagctcaggagttcaagacccgcctgggcaatatggggagaccctgtctgaatttaaaaaaaaaaaaagctgctgctgcatggcagtgacagtacgatgattctgtccttggcttgagcagttgtgtgatacgagcagttgtatgagagatgtttgctttgtataattagaattttttaaggttaatttttcttatttgccccagagctattgtttctgttgacatatggtttataaaaatcagtttgactttgtgctttaaaatgtaactacatatcctgcttagtcaaattatttcattgaatccttaaatgctgtgttcacagtgtcaggttaacaaaagaaaaaaatcattaaatggctctttcttcactattctttttactctttactcctcacccccaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaatag

SEQ ID NO: 36077 - DNA, 41872 bp, Homo sapiens; identical to SEQ ID NO: 36076

SEQ ID NO: 36078 - DNA, 32873 bp, Homo sapiens
acttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagatagtaataatggctgagaacgaaggtaataatggttaccaagggtggagccattgcgcctgagtggaggggacctttagtggtgagaacgtttcgttcctacttaccactgcgatcttgtgtacattgtttacattccccacctctcttcccagatggttgatatcttacgactctgcttcctagcgtctgctgattgcataggcattgggtgtgagccctcagccactttcattgagtgaaactggccgctgttccccgtgcctcctccctctggtccactcccagcccagcctcccactccgtcccccagaaagcaagggccacaatttgaatgcctagtcaggcttcactgcctcctttttgctcttccagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaagagggtggtggtaagggggaaggaatgatactgaagaatgttgtagggtccacatcaaggagagcctgggatgtgaggaacgtgaagagaaacttgttgctgagaacttggtaaggtgtttgaatcccagctcgacgactgtgattaatcactgtgatttgtggtaagttatttaatctttcagtaccttaatttccccagctgcaaaattcagataataataggttcttcctcataaagtagtttatgaggattaaaagagaaatatatataaagcagttagcccaatgtttgacacagtaaacactcaaagtcaactattattatttgtggctaagagtatgggtcatagagtcagagacctgggtttgagatccagctttacttataatctgttggactttggggaagttatttaacctaactgagcctcagctttcctcatatgtgaaatctaagtaataatggtacagatggtccccgatttgcgatggcttgtcttagaattttttaactttatattggtgcagaagcaatacacagtcaggggaacatcaataaattacatgagttattcaacactttattataaaataggccttgtgttagatgattttgcccaactgtaggctaatataagtgttctgagcatgttgaaggtaaactaggctaagctatgatgttcaataaggtgtattaaatgcgttttcaacttaccatattttccatttatgatggatttattgagatgcagccctattgtaagttgagatgcatgtgtacctatctcagggttaataagcacaaatgggaaaaatcacataaaacagcacaatatctggcatgtggtgagtattctgtaaatgtcagctgctattaggtaggacacgccaaagagcttactctggttggtgactgagatccactgaagagttctgtttcttttttctttattattattattattattattattattatacagagtttcacccttgtcacccaggctggagtgcaatggtgtgatcttggctcgctgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtgccctggctgtttcttttcaaatagtagcatgatcacatttgcattttagctagtacactgtaccagcagttaggaaacagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgaggaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaaaaaaaaaaaaaaaactgcaagagaaagatgagggagtggtcacatctggttggagggatgaagaaaaggtttcagaacataatggcatttgacaccaggcgcggtggcttatgcctgtaatcccaacacttcgggaggctgaggcaggtggatcccttgaggtcaggagttcaagaccagcctggtcaacatggcaaaacgccatctctgcaaaaaaaaaaaaaaaaattatccgggggtggtgatgcactcctgtaatcccaggtactcgggaggctgaggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaaaaaaaaaaaaaaaaagatttttctgaatgtaaaagtcatagtgctcattgtagaaagtttgcaaaacagaagaatattttttaaataaaaaataagcctcaatcctagcactcatagatgatcattgttaactttctgatgtgtttcctttcagttacatagttatttaagctaataaatttggaatgctgtaactatagctttttatcctgtttttttaacctaacattataccatgagcatttcctcgtgtcttttgaaaccatgatattgaatgttccatgctctagttgtaccataattatttaatctgttattgtcaaatatttagacactggttttttgctattctgagtaatgccataaacaaacatctttaaatgtatctgtcactgtttccttagggtagatttctagagccggtgactgggtcaaagtgtttgaatattttgaggctcttgatatgtggtaaaagtgttgctttctacaataacagagtttcagaatatgttccactgcatttgtcttgggtgttaatacttagaaaatccaattgggtggccgggtgcggtggctcactttgggagcctgaggcaggtggatcacctgaggtcaggagttcgagaccagcctggccaacatggcgaaaccccatctctactaaaaatacaaaaattagccaggcatggtggcgggtgcctgtaatctcaggtacttgggaggctgaggcaggagaattgctggaacccaggaggtggaggttgcagtgagccgagatcgcaccattgcactccagcctgggctggcaacagcgagactccgtctcaaaaaaaaaaaaaaaaagaaaagaaaagaaaaaagaaaatccaattgggcaaacagaaagtatctattgttttgatttgcatttctttggcctgccgctttgaacgtttttcttaaatgcctgacagatatcaacacttaactttatactaatgtctcccacattcgtattactagcccagacccctcctgaccttcagacccatacttgcaacacccttccttcatgggtgtttcacagacatgtcataccttgaacccttggctttttaacccccaaatgtgcctcctcacccatctcagtaagtgtaccaccattgacttaggtttttaaaccagaaacctaggatttagcttcaattcctcactttttctgaattttcacatccagtccatcagcaaaggcctttccattccagctacaaaaggtatcttctatccttctatttctctccatctccactatcatacctcagtctaggctaccagcatttctcagctgagatagacaaatcagctccaaggccttgtgtgatctgctgcctgcctcttttcagtctcaccatgtatcattctcccctcgttcactagacttcagccacaatgaccgtctttcagttctttgaatagacccagctctgtccctctatagaatgtctgtgtgtgcagttctctttgcatggaatgctcgtcatatggctaattcttcatcctctaggtctcagcttaaatgtcactcctcaggcctttccagatcagtctctttaagtagttaacaactattattctctctttgcttcatgtttgtttccttcttggcacttgtgtgcagtcatttcatgtgtctttctgagttttgtctctctcccctactacagtatatactctatgagggcacaagccatttcttgttcactatgttatgcctgccatagagcttggcatatagaagttcctcaagcaatgcttattattgacaagcaggagaaacaagatgaacaaaagcccaaagccagggtatatttaggtatgttcaaagactacataatagtctggtttggcagaagctaagaggagtatggttgcagctctgcatgaagaagtgatgtgtatataaaatactgaaaaagaagagaggcagagggagaaatacaagttagcatgttataatagtactttaaataggaagaagtgataaaaaatgaagttatagctatcagagatactacttttgcaagaatagtttacatggttagaaaacaaattactcagatccttatttactttccagaagtcccccaacccatgcctttagatactgaggccatcttacataaaacagctgaatggtatgtcctctgtctcaaaacctgtttcttcatgtatgtcctctatttcccatatttgaggagtatgagtctgcttgagtaacagcacctccatccttttgagagaaatagagaagtggacgctgggtaagtaatgagtctagttttggatttactgaatttaggtcctaaagtgacaactggatagtcatttccatagacacatttacttgaaatgtgcaagtaaaatttatgagactgttttgtgactgatgtgaaaaatttaggaggcctgtgctttcgttggtgtagatgagtttgccaaggaaaaacatgtagacagaaaaaaagtcaaggataaaactttggggcaagttaagggagaaggaagaggaaggaaagagcaatcagaaactcagtaaggtggctgggtgcggtctctcacacctgtaatcccagcactttgggagactgaggtgggtagatcacaaggtcaggagttcaagaccagcctggccaaggtggcgaaaccccgtctgtactaaaaatacaaaaaaatttagctgggcctggtggtaggcacctgtaatcccagctactcgggaggctgtggcaggagaatcgcttgaacccgggaggtggaggttgccatgagccaagattgcgccactgcactctagcctgggcgacagagcaagaccctgttgcaaaaaaaaaaaagaaactcagtaaggtacaggtacttaaaggagcctggaaaagagaaaacaaatgttatgtcctccttgaagcctttccctaattatcttccctcccagataccatggcatttagttcatgttacttatcacagtataactatctgtcagtctctagacttgaaactcctcaaggtcagagaccttgactgattgtatctcagtatactaattatgtcgttgtatataattgcatccccttggtgcttaacccagtaattggatcatagtgggtacttggaggtgtctttgggagagacagagtggtcataaaaaagatggaagcaaaatgctgtagcggaaaaagcctagacttaggattcagacctggggtaactaatccaatttctaccacttaatagatgtggcatcatttagcaaccccccaccagcctcaatttctttatcagctaacagtgtattgctgctcacaaagcactctgatgtgtgtttttccatttgatccttttaacaaccccatgaaatagacattcttatccccattttagagattaaaaaaaagggggggggctctgagaattgaattgcccaaagttacatagctagtaagtggctaggttaggatttaaacccaggtcttcaaattcccagttctagtatcattcccactgtagcacagaaaagagaagagtaggccaggtgtggtggctcattcctgcaatcccagcactttgggaggacaaggcgggcagattgtttgagtctagaagttcgagaccagcctgggcaatatggtgaaaccctgtctctacaagaaatacaaaaattagctgggtggtggtgcacacctgtagtcccagccactcaggaggctgaggttggaggatggcttgagtctgagaggttgaggctgcagtgagctgtgatcacaccactgtactcaagcctgggtgacagagtagagaccctgtctcaaaaataaagagaagagtgatcatttgaaagggtagaaaaatgagttgagggaaagtgtttctaagacaggggaaaggcaccagtagagtgaaaaactagctgctaatgaccaggaggatgatcaataaatagagtgaggcccggaagaatgtgtggggggtactagattgataacaaaagtggagtggtaaagacattacctttggttgggcacagtggcttgtgcctttaatcgcagcactttgggaggctgaggcaggagggtcatttgaggcaggagttcaagatcagcctgggcaacgtagtgagacccccgtctctacaaaaaaattaaaaattagctgggcatggtgatgtgtgcctgtagtcttagctactcgggaggctgaggtgagaggatcacttgagcccaggagctagaggccaaagtgagctgtcatcacaccactgcactccagcctgcgcaacgaagtgagaccaaaacaaaaaaaacacaaagatattaccttggaaatggcttggtagagacagaatcagctccttaaagacaacagtaaaagaggaagagtgaagttatcgagttgttttttttttttttttttttttgtgagacagagtttcactcttgttgcccaggctggagtgccgtggcgcgacctcggctcactgcaagctccgcctcccgggttcaagccattctcctgcctcagcctccgagtagctgggactacaggcgcccaccaccaaacccggctaattttttgtactttcagtagaggtggggtttcaccgtgttagccaggatggtctcgatctcctgaccttgtgatccacccacctcagcctcccaaagtgctgggattacaggcgtgagccactgcgcccggccgagatggagtttttccttgttaggccggtctcgaactcccgacctcaggcaatccgcctgcctcggcctcccaaagtgctgggattacaggcgtgagccaccattcccggccagttacagagattttatggtgaagagggaaattgaattctacattggctggccatctggtgagtgtgatggtgataatagtcttcacaaaagatgaacgaaaggatggctgagcaagggtgaccactcagccaaagtttgacaatagtgatttgtagttgacccatttgatacaagtttctaattccttaactctcttcaacagcttgggaacagagaaaggaaatggaagttgcccagggtcagaagggttacaaggataggggattctagggtaacagggagtatttccatgtaatggcccaccatggagaatccataacagtgatgaaggtctaagacagtagttttccatatgttccttggagccctaaaatttcactgcaatgcctgggggttgggggggcgggtgttgacagccctcctgatttaaccaaggtaaattttacttgtttattaattatgggagttccgtggcatctctcattagaagaaaaggttcttttactaaaacagttttaaaaacactggcccaaatgaacaagtgttgagttagaagtttaaaagatgatgagcaggctgggcgcggtggctcacgcctggaacgcactttgagaggctaaggcaggcagatcatctgacgtcaggagttcaagaccagcctggccaacatggcaaaaccccatctctactaaaaatacaaaaattagctgggtgtggtggtgcacacctataatcccagctacttgggaggctgaggcaggagaatcacttgaacccaggaggtggaggttgcagtgagctgaaattgtgcggctgcactccagcctgggtgacagaacaagactctatctcaaaaacaaacaaacaaacaaagatgatgagcaaagtcatagaagctaggaagtagaagaaaaggaaggagcagagtgcagtagttaggccttaagcatgcagagaatgggaaaagaaacaaaagaaccttattcagaggactactagactaaccctgaatttaccctgaattatatcaccctaaggtcctcgtatgttatttttttcccgtgacttaggtacatccaggaaagagggttggggataggagtgagattggagttaaacattctcaagtaatatctctgatagcattcatgaactaggaattgtagttctttgtagtgttttactcaaaaagcttcttaggatgatgatgtgtcagttattcgtaacattatagtaaatgtccacttgttaggtaaaaggaacagaagagcctaaacatttttataatagccttttcagaacagtggttcttgacttttttttttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgacctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggtggtgcgcgtctgtgatcccagctactcgggaggctgaggcaggagaattgcttgaacctgggaggcagaggttgcagtgagctgagatcatgccactgcactccagcctgggtgacagaatgagactccatctcaaaaaaaaaaattgtgctgactataatgaaggggaagagaggaagaggatgggaatggagaagaaaggtagaactggaggagagggagaaaagagtaggaagagtgaaataaaagaccagggggatatgcttaggttggaggaggaattagaatttaaccttgccacaatgatgcactgtcacacctttagattacccacgtaggagacacagcaagggcatttccatgcacagaatgtccagtaaactggtaaagaaacctggtgtaacagctttggctatctttgaacatcataaccctgttttggagctgctgcttcaaaagaataggctctgctgccacttgttctttggttcaggacacaacatgaattgggttgaatttatcagcaagtcacaggcatttatttaagtcctcagagaaacctcttcctaatttgatttgtactaattagcccaggagctcttgcctcaggataacatcaacctagttcttcatgttaagagatcaaagaatgaacaattaatattctaaggttataaggccccttgagcatgtctagatgagtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcctttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggagagctaaggaatctctaccgttagtgttctgctgctatatcttagagactgataaatagaaagtgagtgaattttgaatccagagcttttcaagcacctgaagacttaagagcccgtatggtatgttgggtaaaatggcaaattcacctctcataattaatttccttcttaggcatcaacttctaactcatctcgccaggagaggcctccagtgaaacccttcattctcactcggaacatggctcaagccaagtaggtagtactagaaagtttgctttgcagccctctgcttttatggttcaatgtggcaattcattagtgacccacagactgagtggtgttgaaaagtcatgatcttgggtgggcgaggtggctcgtgcctgtaatcccagcactttgggaggctgaggtgggtggatcacctgaggtcgggagttcgagaccagcctgaccaacatggagaaaccctgtctctactaaaaatacaaaattagccggacatgatggcacatgcctgtaatcccggctactggggaggctgaggcaggagaatcacttgaacctgggagggggaggttgtggtgagccgagatcgcgccattgcactccagcctgggcaacaagagcgagactccgtctcaaaaaaaaaaaaaaaaagtcatgatctcacttacggaagttgttcttttatctaagggatattatctttcctgaaactttctccatgtctgtgttcctcagacacttccttcacaaactcaagcttaaaaataggcacacatgggccaggcgtggtggctcacgcctgtaatcccagccctttgggaggtcgaggcaggtggatcacctgaggtcaggagttcgagaccagcctgaccaacatggcaaaaccccgtctctactaaaagtaggaaaataagccaggcgtattggcaggcacctgtaatcccagctactcgggaggctgaggcaggagaattgcatgaacccaggaggtggaggttacaatgagctgagatcaccccactaccctccagcctggtcgacagagcaagactccatctcaaaaaaaaaaaaaaaaagcacacatgtaaacaagcaaataaaacaaaaaaggaaaataattgaatggagaattgtatactttaaagtttttttttattattacattattggcactcttcctgccttcagctacgattctcaaaaggacatatttgcctccctatgatttaattctgagttcttgagatatgtttccctagggtggcgggagtctccttgttttctgtacctttcagagtcaccaactataaatacccattccacggtgtcttcactgctttgtggagcattgccctctgggattgcttaatgggagatgatcctgggctatttatcttctcatgaaagctcttgactttaatgcccctttctggatgcccctttttacatatcctcccatgagtttgtacaactcctcagaagttgactgggtagggaacaaggctgaaacggacacagactttgttgttagagagactttttgtagtactgggttttttttgttatttttgtttttttgtttttttgttttctaaatgcagcgtaatttttgcagagtatttggagctggttatccaagtctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctctccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttggtaattggatcatagtgggtacttggaattgtctttggaaggggaagatgaagagggtggccaccaaaaaggtggaagcaatagggtataaccgaaaaagtatggacagacctgggtgaacagtccaactcctgtcactttttttttttttttttgagacgaagtctcgctcttgccctccaggctggagtgcaatggcgcgatcttggctcactgcaacctatgcctcccgggttcaagcagttctcctgcctcagcctcccgagtagctgggaatacaggcgcctgccaccacgcctggctaatttttgtatttttagtagagatggggtttcaccatgttggccaggctggtctcgaactcctgacctcaggtgatcggcccacctcggcctcccaaagtgctgggattacaggcgtgaaccaccgcgcctggccctcctatcacttaatagatggaatatcttagtccctctgagcttcagtttccttatctcatatattatcccatttgatccttttcaaaaaggaaaaatagagacagggtctcactgtgttttccaagctggtctcaaactcctgggctcaagcaatccttctgcctcagcctcccaaagcattgggattacaggcatcagccaccgcgctcagcttcatttgatcctcttaacaacttcatgaagcagacattcttattctcatttcaagatgagaaagtgctctgggacaaataggtgaaaacaaaaagaaaaaaaataaaaataaataagatgcgctaggcacagtggctcacacctgtagtcccagcactttgggaggccgaggcaggcggattgcttgagctcaggaattcgagaccagcctgagcaatatggcgaaaccccgtcgctaccaaaaatacaaaaaccagccgagcgtagtggtatgcacctgtagtcccatcttctcgggaggctgaggtggtaggatcatgtgagcctgggaggcagaagttgtagtgagccaagatcacgccactgcactccagcctgggtgacagagtgagaccctgtctcaaataaataaataaaatgaggaagtagtcactgggagctgacttaaagtggcctggctaggatttaaaatcagaccttcaaattcccaggttcagttctgtttctactatagcaccaaaaagagaagagtggtaatttgaaaggattagcttttcacctgtgggcagactgcagttactatgatgtaactgcatgtaacttggataggaacttgcagtcttactgtttgaggaatgagagaactgagatcagggtgaatagcaactgaaaaatgaaggaggttatcccagaaaagagagaaccacagagaagatgccctgattctgtatataaaccctactgaaatctctggctgactatgcatgcacagaatggactcttaagcacctcaactaaggctaaaataactgaatggagaattcagctgttgcccaatgcaagggagatagaatttggtattttggttttagacgagttaattgcctgctaaaatgaaaaatcagtactctttagaggaatgaaacagaattcggaatctctacaatatatcatttgtcacgtttagaattcaatcctaagctattagacatgaaaaaaaacaaacaggaaaatgtgactcataactcaaaagaaaaggcaatcaatggataccaaccccaagataactcagatgttggaattagcagacagggactttaaagcagctattatttttatcctcaagggcagagagcaaaatatgtttgtaattaatgaaaagataagaaatctcagcagagaaatagaaactatacacacaaattctggaatggaaaaatacaatatctgaaaatgtaaagtcactggatgagcttaataccagattgttgctgacagaagagcctgtcggttaacttgaagatcaatagaaattatccaatttgaaaaaaaagattggataaaagtaagcagtatctcagtggcctgcggaattatgtacaaaggtctcatgtatgcgcaattggaatgccagtaccagaggagaaagaagggaacagaaaaacttgaagaaatgatgactaaagatttcccaagattcagaaatgtcagcaaaccccaacagtttaaatacaaacaaaatcacacataggcacattatagtcaaactgcagaacaccagagagaaagaggaaattttgaaatcatccaaagataaagtacacattacacataggagaacaaggatatacattattgctgaatttccattaaaaactgtgggcgccagagatggtggaacagcttcaaagtggtggggggaggaacctgtcaacgtataattttatacccagtgaaaaatatccataaaatgaagatgaaattaagacattttcagataaatgagagctaaaagaattcttcaccagaaaattggcattagagaaatgctgaaggaaattcctcaggctgaggggaatggtatcagatagaaatgtaaatactcaagtagtgaagagcagcagaaatggtaattatgtgggtaaatacaaaggactgtcttcctcaacccagtttttaaaaactatacgtagcttctcaaagcaaaaattacaatattgacttgtgaggtttataatgtattaggtgtaatatatgtgacagccatcgcaaaaaggacagggtaaatggaactattttgtttgtgagattctcctgttttatgtgaaccgatacatgtctattgctgtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctgggactacaggcgcccgccatcacacccggctaattttttttttttgtatttttagtagagatgaggtttcattgtgttagccaggatagtctcgatctcctgaccttgtgatccgcccgcctcggcctcccaaagtgctgggattacaggtgtgagccactgcgcctggcccccatcacataattttaactcttaagtaggctgggaagttaaagatgaacattgtatttcctagagcagccacttaaaaaataatttatcaagagaatgagaaaacaagccacaacctgggagaagatacttgcaaaagacttatctgatgaaggactttgtatattttacccaaaatatacaaagaactcttaaaacccaacaataagaaaaggagcagttttaggccaggtgtggtggctcacaccggtaatcccaatactttgggaggccaaagtgggaggatcccttgagccgaggagttcaagatcagcttgagcaacatggtaagacccctctccacaaaaaaaaaaaaaaaaaaaaaagttttaaaaaactagccaagtgtgatggttcgtgcctgtagtcccagatactcaggaggctgaggtgggaggattgcttgagcctgtgaggtcgaggctgcagtgagctattatcgtgcccctgcactccagcctgcgtgatagagcaagaccgtgtctcaaaaaaaaaagggagcagcctgattaagaagtgggccaaaaaccttaacagataacctcaccaaagaaagtatacagatgacagataagcatgtgacaagatactctacatcatgtcattagggcaatgcaaattaaacaacactgagataccactatacacctgatagaatggccaaatccagagcacctcaaatgtaaatagaataaaccttcgaattagaagtcagggatcgattatcaggtctagctgcatgctgtctataaaagatacattttaaatacaaagacacagattggttacaaataaaaagaagaaaagatatataggtggctcacgcctgtaatcccaacactttgggaggccaaggcaggcggatcatgaggtcaggagttcaagaccagcatgaccaacatggtgaaaccccatctatactaaaaatagaaaaattagccgggtgtggtggcacacgcctgtaatcccagctactcaggaggctgaggcaggagaatcgcttgaacccaggaggctgaggttgcagtgagccgagaccacaccactgcactccagcctgggtgacagagtgagactctgtctcaaaaaaaaaaaaaaaaaaaaagatatataggttgagcatcctaaatctgaaaatgaaaaacctgaaatgctccaaaatccgaaacttcttaaggctaatgtgatgcttaaaggaaatgctcactgaagcattttggattttcagatttgggatgctcaaccagatatgatgcagatattccaaaataaaaaacaaatctgaaatacttctggtcccatgcatttcagataagggatactcaacctctaccatgctaacagtaagcataagaaagctgcagtagctatagtaatatcagataaagtagatttcaagacaaaaaggtattatcagagattttaaaagggcatttcctactgataaagtggcaatttatcagggagacatagcagtcataaatgcatttgtgcctaataattttcaaattatttacttgaatacttacaggctactgtagggttattcattggcccaatttcaatattgttgtgtctcaaggaacagagaggcctggagcagggttgggacagccagtcagtggagcagtcagaacataacacatttacccattaagttctctgtcttctgtgggcatggtttgtggtgccccagaacaattacactggtaataccaaagaccacagatcaccataacaaatgaaataatgaaaaagtttgagaaactgagaattaccaaaatgtggcacagtgacacaaagtgagcaaatgctcttagaaaaagggcaccaatagacttgctcgctgcagggttgccacaaaccttcaatttgttaaaaaaaaaaaaaaaaaaaaaagtctctgcaaagcacaatagagtgaagcacaataaaacgaggtatgccttcaccttcttttcagatacccatggaacattcaccaaggtagatcatatactggtccatgaaataagtctcaataaattttcaaaaattgaaatcacactgaatatgtcctcagaccacaatggaattaaattagaaatcaataatgtacctagaaaattctcaaatatttgaaaattaaacagtacacttctaaataacctataggtctaagaagaaattagaaagaaaattagaaaatacttctaactgggaataagttcaagagatctgttatacagcatggtgactatcgttaatggctgggtgcggtggctcacgcctgtaatcctagcactttgggaggccgaggcgggtggatcacctgaggttgggagttcaagactaacctggccaacatggtgaaacctcgtctctaataaaaatagaaaaattagccgggcgtggtggcgggcgcctgtaatcccagctattcgggaggccgaggcaggagaatcggttgagtctgggaggcagaggttgcagtgagtcaagatcacaccattgcactccagcctgggcaacagagcaaaactccatctcaaaaaaaatgaaaataaaatacagagtagatgttaagtgttcttactgcaaaaataacaatgtgtaaggtactgcatcttttaattagctagatttagctatcccataatatatacttcaaaacatactgtacacaataaatatgtttgcccatttaaaaataaataaaagagaatactttgaacagaattacagtgaaagtacagcatcagaatttatgggatacaactcgagcaatgctgagatggaaatgtgtgtaactttcaacacttatgttagaaaaaaggaagataaaatcaattacctaaggttttaccttaacaagggtgggggtgggggcatagggaacaaagaaagcccaaagtaaatagatgaaaggaaataaaggcagggaaactaggggtggtcatggttctggtagtaatgcacaaaaattggacacgtgtatactcccatgacctggcagtttcactactcggtatatacctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtgctggttgaaagctagtaagtgttcacccttagttggggatcatgaatggaactggacctacagggtcttctgaggagttagaaatattttgtatcttcatctgggtactgattacatggatgtgttcaatatgtgagaggtcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccacaagatccagcagttattggcatctgtgcaggagaaaaccagagttgacaggccatctgaaaaacttgacaaacagaattccaaaacagtgtattccctagaaagaatggcagtccaatttaagaactgcagttgaaactgggagggatgagtatgagggtccaatagtcagaaggtctgaaagcgatagagtagtctagtccttagtgaactcttgaagttgatccaccggtctcccttccaggacagggactcacactgaggagaaattgctgagagtagaattgaaattaagcaggacaggaatagaaaaagaaagaaaaggtccagatgaaattaggagagaggaccagaaccaggaactccaatcaagcaagtaatcatatttctttaattcacatgaaaacagcagaaagggagcccttatgaagttagaaaagctactctgaaccatgcttctttctacaagtttaggaaaacatttcacgtaaaaatgaacaacagattgtggtgatggttgcacaactctgaatataaaacactgaactgttggctcacacctgtaatcccagcactttgggaggcggatcacaaggtcaggagtttgagaccagcctggccaagatggtgaaaccccgtctctactaaaaatacaaaaaaaaaagaaaaattagccgggcatggtggtacgtgcctgtagtcccagctacttgggaggctgaggcaggagaattggcttgaacctgggaggcagaggttgcagtgagtcgagatcgtgccactgcactccagcctggcaacagagtgagactttgtctcaaaaaataaaaaaacaaaaagaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtatccaaaaaagagttggaagatattcagaaaataacataggacatggaaggacaatataaagcaggattagaaaaactcagaaatatgacagcttggggaacatgaatcatttcagaaatataggctaaagtagaaggaaacaagaatgagtgaacacaacagaaaatgccttactatggtaaaaggaaggaaaattttaaaacgaaaaaagataaacagggtttgaggaaaagtgacatatactaaagatagtaaagaagacctggcatatagataataggattatctgaagaagaaagccaaagcaaggaaaaagaataaatgctaaaagttaatattaaggaaagtttcttgggattaaaaaagttgcgcggggggaatctcttggtgttgggtgtgacgcgacccacaggcagccacagcagtgctgtgttccaaggcacgggtgctcagggtggctgtggagcttggtcctgggtccagtgtcttcttgaactgctgcgggacctgtgacatgggtgcaggttcagtctcaggcacaggtggatgctgctctcccaccaaggcaaggactatgactctgaggcacttctcagtagctcgggcccaggggcagggacgtagctgtgattcctaacctgggggtcagggcatagtactggcatggctctggggagggaggggtgttccagacgctcagaccccagggagcagggcacagtggcaattcaggcaccaggaaagaagatgctgtatagtggtgactctggaccctggaagctctatgaggccgggtgcagtggcaacacagccccaggaatggtagggcatagctgtggcttgggctccagggggtgggatgcagtgcaatgttggctttgctccccaggaaggtgggacacctcagtggctcagaccccggagggctggtccagatccagggaggtgggggtgctattgccgtttggcccagagagcagtgtgtacagattagccaaggctgtgtttccctggggggtccagggacctggtgccatgcaggctaaggcaccagggtcccagctgcccccctgggccaaagctccagttccctggggctgagacactgcaccaaagaggcacaactgctgcccggcaccaggcccagcttctccatggggcctaagctcctggtcctggagggctcgagcgccacggtcacttgataggaaaaatcacaccatgttcctgggaaaggacccagaatgaccaacaagacatagtctaataaaatttccgaactttaaagaaaaaaaagccacagacatctcagtaaaaatagtaagtgatttataaaggaaagcaacttaggttaccctcagattttttgagatctatactttatgccagaagaaagaagaaaatggaatagcaggtatttaagaaactcagagggaaaaaaatgtgagccaaggaacattatacctggtaaaactgactttcaagtataaagagtacagatatttatcaacatgcaggaattcaagaaatattgttccaccatcccatgaatttgctagagaatgagcttcagacagccaaagtgttgagagacattgaaataaggacaggtagcaagcgttaaatgtacagttacttgtagaattaagatgaaatgaggattaaaagggagatagagtatgtaatgcctatgtgcccagataatgtagataactttttaaaaatggagaaatggggaaatcatgcaaaattttaacagttctcagtaattatattggtggagtgtcaaagttagtgttattattccaagactatgtataatgtgagataatataaatgagcagttattagataatctaattctatcatcctctgtctttgagaactaggacttttaatgtgaaagaatacagatgtaattccaaagaatttagattttttttaaaccctgtagtactccatatgaactcatgagaaattttatttaaaactaaacacacacacacacccacccctgcttttgctctattcactgaaaaggcttagaaacaaggaccagcccagtagcaatgagtatacctagtaactccaattgtgatacagaaatattcttcccaatattctttcttttaagaaatcagggtgtcttagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaatacacacaagtccattgtgatagaaataagtggttgaataagtaaataaatgagggagaagagataaatctcccctacagaaaaatttcaattaattttatgtagatactcctgcttcaaggaggtgtagcatgactgtgtaccccgaaagtgtgggctgtgcttagtgacttgcttccagagactgcaatgtggaaggagacaggagaagtaactttagttggaaacctacaaataccactttggtcaggtcatcgaggttattatcagtgtgaagtcaggttgatagcatatatagtattgtcctccaaaacccataaccctagtctaattctgtaaaaaataggcaacccaaactgagggacattctacaaaatacctgacaagtactcttcaaaactgtccaggtcatcagaatgaaggaaagtctgagaaagagttacatcctagaggagactaaagaaacagacaacaaaatgtactgtggtgacctggataggatcctggaacggaaaagggacattaggtaaaacctaaggacatttgagtaatgtatgcactttagttgttaataatatattagtattggttcattagttgtatcacagaaactgtattaatgtaagaggttgatgataagaaactgggtgtggttatgtaggaactcagtactattttctcaatttttctgtaaattgaaaacttctaaaattaagaagttgatttaaatagttttttaaaacaataattgtgggccgggcgcggtggctcacgcctgtaattccagcactttgggaggcttaggtgggtggatcacttgaggtcagaagttcaagaccagcctggccaatgtgataaaaccccatctctactaaaaatgcaaaaagtagccaggcgtggtggcacatgcctgtaatgccagccactcgggaggatgagacaggagaatcgcttgagcccaggaggcggaggttgcagtgagccaagatcacaccactgcactccagcctgggtgacagagcaagactcctttgtctcaaaaataataataatagttgcaactggctgaaactcaccagatatgtttaaatctctaagttcataattatatatatatatttttatttttttagaggtgggtctcacactctgagcccaggccaggctcaagcaatcctcctgcctcagcctctcgagtgagtaggactacagccatgcactaccatgcctggcagattttaaaagtttttttcttttttataattttttgagccaatataagtgtcataaatattttttttgtagacacagggtctcgccatcttgcccaggatgatctcgaactcctgggttcaagcagtcctcccacctcagcctctcaaagtgctgtgattacaggtgtgagccatcgtgcccagcccataattatattataaaacaagaccaaattattcaacctcagaggctaataagggaacccaatatcttgagaaatggtaaataaagggaaagagtcaagtattttatcttttctactaggtaaccaaatagtagttgatgaggggaaggctctctttgtaaaagtattccagttaattttaaaaagttaaaattaagggtatcacctttttgaaaccccccaataaatgaatgggtctcggcattgagcatcaacagctcctaacattacaacgagacagagatatttacatgcctcctgatgaaggaatgcagcaccacctataattataattcatgctgaagggatcaaacttgagtcaaatcaagcctctgtattcagctgccaatctgcagaaaataaaggaggacatgttagactgcatcatgagtatgcaatcagcaaaatccagtctttgggaaacaaactctacaggtcatatgccccaacttcttcaacagataacttgaaagaaaggggtggagggggaacccatagatttaaaaagatatcaaaacatttttaaataggcaaggctaacctcaaaaatacgatgctaggccaggcgcagtggctcacacctgtaatcccagcactttgggaggccgaggcaggcagatcacttgaggtcaggagttcgagaccagcgtggccaatgtggtgaaaccccatgtctactaaaaatacaaaaattagctgagtgtggtggcaggcacctttaatcccagctactcgggagactgaggcaggagaattacttgaacccgggaggtggaggttgcagtgagccaagatcgcaccactgctctccagcctgggagacagagcaagactgtctcaacaacaacaacaaaaaaaggtgatgatgctaagtgaaagaagtcagccgcaaaagatcacagattacatgattttgatttcatgtgtatgaaatgtccagaataggcacatctatggagacagaaagttgattcatggttctaggagctgggggcagggagggaaggaatgggaattaactgtaaatgggcacaagggatcttttggggttatagaattttttaaattggattgtggtgatagttgcacaactctgtactaaaaaatacattgagtaaaaaaatgaatgtacaaatggacaattacagtgtctagtggtatgcacttgggtgataaagctgtgatgaactctaggaagttattactataaaaagcagtatagaggttacttttgcaggggaggagagttgatttgtataatgtacacagagaggcttttagggtggatacaggagatctgtttcttgacctgagtggaggctataaggcctccttacaaaaatttgttttatatgtacttgtgtggtttccaccatgttttattttatagtaaagggtttaaaagaaaagaacgaggcaaggtggctcacgcctgtaaccccagcactttgggagggccgagaccagcctgggcaacataggggaagaccttgtctccacaaaaaatgtaaaaattagccaagtgtggtggttcatgcctgtggttccagctactcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcacaaaggaaaaaaaatgcaaaagagatgcagcagttggtttaatttcttttgggtgtacactgcatgataaatgccatttggacctcagagcctatttcaagcactgcaaaataatacgtaggcattcttttctggtaggtccaactgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccacttagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacag

SEQ ID NO: 36079 - DNA, 5668 bp, Homo sapiens
gcttcttctgcccggagaggacgtcatttccgccgagtccctgacctgctgctaggatcgcgacgggaactggagcccgaggtccccgcgcggcccgggcctggcgccctgaggggaagagcggcccggcccgaggtgagaggaacatgcttgggcgacgggaagttgaacgcacaaacctgtccagagggcaagatgccccgagccccggggaaggatgaggacacacctgatgtccaggtgtatgggggtgggggcggggactcacacacctgggagacataactgactgtggaagggtcaccgatatcctgggagagagaggcttttaccagagactgggaacatacacccactgatctaactaaggcctggtggggagggcccgaggaagacgaggtgtatgagacggaggaggggagaccccctgaaggaagggggaagaaacgctaaaggaatgtgaaaggccaagcaatggagaacaaacctgaataggggggtgaagacctgagccctggaaagggttcatctcctcagcataaacacgcctgcatggagataagttctaagagagcagactttccctcttcactgttgtattttcattgtcacaaatagtgcctgacacatagtaggcactcactaaatgtctgctgaatgagtgtagaaataatcaccagagtcctggtgaggttgggggcttgtgagaagacaccgtgctttggtgtgcctgtttcaaatgtgcgttttggaggggagaaatacatatatctgaagaaaggaatgatggccaaacgctgggacactcaaaccctgggacagcctttaaagaaatgacagaggaggcctccttcttctagagtgctggccagtgtccagaacttctgtgttgggctttgcagggtgctggggtggagagttttactccaatacctttcctagccatgacggacgggatcctagggaaggcagccacaatggagatccctatccacgggaacggcgaagccaggcagcttcctgaagatgatgggctggagcaggtgcttctgtttgattcttctaattgtttcaatttaggaatccaatttataaatcctaggttctcaccctccattccagtagccttcccctgacttatctgactcccttcattctttttacgtatcattttgattctgtgcagacttcccttgtgtactatctttatgatgcttgaatccaaacttgttcccacctccaaaatgcttctgcagcccctatgttcctgaagcaacccctcttctctggcctataggacctccagcaggtgatggtgtcaggacccaacctcaatgaaaccagcattgtgtctggtggctatgggggctctggtgatggactcatccccacaggtatgaatgttcagaaacaggaatcttgggtggaggaggggacaggaatggtttggggaagcataggatatgtctaggaaagcttgaattatgtctggagatcttgggaacttctgcttgtaggaacctcatggactctcctcagcccaaaagcaactcccagcgttgtccatccatttcccttttgccacttagcccctgaaatggctcatttgtcctttccctgccaccacctgagtcaagttaagacctgcttcacaggaatgccccccctctacagcttgaggctgagttggaactttgtgaagcttctcagaatttttagattctaaagtttagaggaacaaacagccctgaatctcacactaagattccacatgggaatgcaaccaggtttcttgttatcatgacccaccatccttgactcctgctgcccccaaactcagtgtattttcttctgtttcctctgcccctgtacaccaacaactccctgcaaacccctcctctaacccccaaggaggccatatgtatatcaggatttggttctcaccgcgcaaagtccgagttcctcctagtaagcaggagcatccagttgtctctagcatctccttcagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataaggtaggatttaagcacctctcccttccccaaaactccttatgggtacctttttcccttttcttcgtgatcgtaatatcccatctgtggctgagagtaggagcctggggggtgctggggtagatacctgttgtgtggggaggctgttagggtctctgatttattcccccatttcccaatcagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggtgcctcacccagaccaaagagggtgggggaactgggcatgggccctcccaggcagtcattcctcatcctccctccctcctgcagcccacagggagaaccccttcagggtgggcccagccctacccccagcagcactcacctgtggaggcagcctaagggtttgtacagaggtccagaagttggagggggtgggggagggggcacactaggtgcctcacaaataacccctctctgcactggggagaatgccttcgtgctcagcctaatcagagcccctcccctgcttgccacactagctctcagactgttccagtcttgtgaacttacccaagaatgcccaccacccacattcctaccccaggtatccccagggtgatcccactaactttccggctaagagagccttgctggaggcagtccttggttgttccagttttgctggctgtgtcctccccggggaggaggggaatgaagggctctacagcttcagtcaggtagggagtgttattcaaggtctgttcctcccttctgccctcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggtgtgggcactggcagggcttagggtttggggagttggctggtatgggtggaaatttgggcattaggggcataagaattcaggaaggaaaggagagtatgtgttgaggataaaggagtggagaccagcctttatcaccccctccccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaaggtgccaaccccacccccttgaccctagcccacctttccatctgtaacactaaccttcccctcagaccctccccattattgaatgaggaaatgcagcctagctggggagtagagtgttcaccccctcaacccctgggcctttccagatcaccctccctccaattcctggccctttcctgttggaggatttggctgctggtcccaggaacataactgggaaaaatcaccccctgagctggggtacaaaaaccctaggcccacaaatccagtgaggtttcttccatcatactgacccttctcctttgactccctgggtagagttcagcccctaccccaaaagcaccatcagagcagagtccttgtgcccctggtctgtgcctgggctcaggctcatagaccctcaagaagggcgcctgagtccagccttagctgaccctgctggacccccagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctc

SEQ ID NO: 36080 - DNA, 895651 bp, Homo sapiens
ataaagccgggggtactgggcctcaggtcaggcctatggccatggccttcacagacctgctggatgctctgggcagcatgggccgcttccagctcaaccacacagccctgctgctgctgccctgcggcctgctggcctgccacaacttcctgcagaacttcacggccgctgtccccccccaccactgccggggccctgccaaccacactgaggcctccaccaacgactcgggggcctggctgagggccaccatacccctggaccagcttggggcccctgagccctgccggcgcttcaccaagcctcagtgggccctgctgagccccaactcctccatcccgggcgcggccacggagggctgcaaggacggctgggtctataaccgcagtgttttcccgtccaccatcgtgatggaggtcagaaggggctgggtgtgtgggggggctgctgccgaggcccagtctgaagcgcccatgtcttccctgcagtgggatctggtgtgtgaggcccgcactctccgagacctggcgcagtccgtctacatggccggggtgctggtgggggctgccgtgtttggcagcttggcagacaggtgagcccgtggggataagggccccagccacccagtgcgggccagaaagcctaggcctctgcattcatttttctttgttacagttgatttgtgcattttaaacagataatacatatagtacattcacatggtttcaaatcccgaaaggcacagaagagtctgccggggatcacccctttcctgctctgcccctccttgcagtaatccccagagggcagcctgctttctatgccttttaccagagacattttatgattctatgcagtcaagcaagtgggtgtatatgttccattcccccatttttcttttcctgttttgtatttgttttcttcttcatgtgcccccatttttttctttgagatgaggtctcactatgttggccaggctggtctcaaacttctacggtcaagcagttctcctgcctctgtctcccaagtagctgaggtgacaggcctggtcatcctttttttgtgcaaatgctggcatacaccccacgtggtcctgcacccggctttttcttcgctttggaggcctctcctattccttcagaaagagctgtcccattcctcctagtctttacactacatcccactgtatgaatgggccctaacttgttccccgttattttttagaggtgaggtctcactctgtcacccaggctgtagggcagtggtacaaacatagctctctgcagcttcaaccttctgagctcaagtgatcctcctgcttcagcctccccagtagctgggactacaggcacgcaccaccgcacccagctaataaaaaaaaaattatttttagtagagatcggggggtgggggtgggggggggtgtctcactatgttgcccaggctggtctcgaactcctgggctcaagcaatcctcctccctctacctcctaaagtgctgggattacaggtgtgagcactgcacctaactgacccctattgacagacgatgtgcagccagctcatggctctgaagttggctcctacgtctctctctctgcacctctttccccttcctcctcttcgctctctctcccctctcccttctcctctgcccttcttctctcagttcaggtttggggggccctcccggactccaccccacactctggagtgtagatggctccctgtgccacacacctcaggccctcatcacaccgtgtcatgatacaccctggtctttctacatgtgagcttgtgtcttatccagaatgtcttgtttgtcaccaaccctcaactcaggcctgtcacttagaggtgattaatgatcaatgaacattgtgtcacaatgaatgagtgaatgaaagaatgcatgaagaaatgaagaaacgagtgagtgagtgagtgagcaggcgagtgagtgggcgagcgagtgagtgggcagatgagtgagtgagtggactagtgagtgagtgagtgagccggtgactgagcgagtgagcgggtgagtgactgagtgagcgggtgggcgagcgagtgagcgggtgggcgagcgagtgagcgggtgagcaagcgagtgggtggataagcgggtgagtgggcgagtgagcgggtgagcgagtgagtgggcggatgagtgagtgggtgagtgagtgggagagtgagtgggtggatgagtgagtgggcgagtgagtgggtgggtgagtgagtgggtgggtgggtgagtgggcggatgagtgagtgggcgagtgagtgagtggatgagtgagtgggtgggtgatgagtgggtgatcgagcgagtgagcgagtgagtggatgagtgagtgggtgggtgagtgagtgggtgagcgagcgggtgagcgagtgagtcagtgagtgagtggatgagtgagtgagtgggtgggtgaatggataagtgagtgggtgggtgggtgggtgagtggatgagtgagtgagtgagtgggtgcgtgagtgggtgagcgagcgagtgagcaagtgagtcagtgagtgagtggatgagtgggtgggtgggtgagtgggtgggtgggtgagtgggtgggtgaatgagtgggtgggtgggtgggtgagtgagtgggtgagtgggtgggtggctcggtgggtgagtgagtgagtgcatgagtgagcgagtgagtcggtgagtgagtgagtgagtgggtgggtgaatgagtgagtaggtgggtgggtgagtgggtgggtgagtgagtgcgtgggtgggtgagtgagtgcgtgggtgggtgagtgagtgggtgggtgagtgggtgagtgagcgagtgagcgagtgagtcggtgagtgagtggatgagtgagtgggtgggtgagtggatgggtgagtgggtgggtgggtgagtgagtgggtgggtgggtgggtgagtgagtgggtgagtgggtgggtgagtgagtgggtgggtgggtgagtgagtgggtgggtgagtgggtgggtgagtgagtgggtgggtgggtaagtgagtgggtgggttggtgggtgggcgagtgagtgagtgggtgggtgagtgagtgggcgagcaagcgagtgggtcatggagtgtgtggagaagaaaagctgcctgtcttcttggcctgcttccctgctggccaagttgaggctgtgcgctctggccctggaccctcatttgcaaacagggcagatcaccctgccatcctgtccttgggcccctctgtggcatggcaaccctctggtccacataatgactccaccctggctcctgctcccacaccagggactggccaagggctcacccgctgtgagttctggttcgaggcctccctccagccacagcagtgctcaggtgacctctccccacctgccacacgcccctctggggctttgcagaatccctgcctttcctcgagcccggactaaatctcctcgccagcttccttctacactatgtccctctgtctgtgaccaacctctgccacgaagcctgggtcccagcagtttcaagtttctgttttggaagggtggctttcgcggggtaccccatcttccccgggactgccttgataatcccctgctcgggtgaaaggggcaggcgtgggctgcccatttgttccttgggggatgctgctgctgcctcccaaaaccctaatgcctgtgcccattctctggactcaggctgggctgcaagggccccctggtctggtcctacctgcagctggcagcttcgggggccgccacagcgtatttcagctccttcagtgcctattgcgtcttccggttcctgatgggcatgaccttctctggcatcatcctcaactccgtctccctggtgagtccagccgaggagaggccaggaagggcgggggctcctgaaagagcagggcgggggcggggggacaggggggtggcaacgtcgagggtcatcggacatttttctcatgttgttttgttgggattctcatccagcaacctcaactcaaagcctcccgccagagttctggacctgggggacctgggctcccgggtagtggtggccctgctggctgtgggtggggagtccctggatggcctttcccaggtctgggctttagtgtactcatctgtaaattgagagggttaggtttattttatttgtgaattagccaacaataaccacttactaagcacctattgtctccaggcttagtgtggggacacagaggccactgggacacaggagaggagtgagccatgatggtccccagggcagcagccagccctgaaattgtatgactctatgaaggctggtgattcctcagcttcatggtggagacctggctcctggatgccagcttggagtgttgcgcccccaagtgataagtggcaggctcagtcctcactctaggctggttctgggcagcccctgggtggtcctaggagaaagcatcacggggcagaaggaagcccacccaggacacaggcctgccacctacctatgtttcattttaactacttagcttgctcctggggacaccactgggcacggaaactgctgccaccatcagctgtgcaaagacaggatggatcttttatatcaggggtcaggaagaaatcttgggaccagagaaccaggacacctgacctcccctccctctcccagcacacagcgggatctcagccaatcccagcctacacagctcactctgcagggtgggcatccagccatggcttgaaacaggtgtctgaggtccacctcgtgctggaatgggctctaacacctacacagacacatacagacacacacagacacatacagacacacatacacacgcatcagagactgcccagcctcttaacacttcctgaggctggagaggccgggcactgtctggggacatctccgcctgtaaagacgactttgtagagattccatcgagtgccctggagctcccaccacaggccatgccctgcctcgggtcccaccgcacaagtgtggtgaccctccatacatatatgcctcccctcatgtttgttcctgcgcacactgttctgtatcttgattctttcacttaaccaagctgtcactggtccactgcctgatagagagcctcctagtgccaggagaggctctagaggttgcggtgaacacagccctgctccttggagtccatgttctagcgaggcgagatatcaccagcatgcataacgaatcgtatagtatgttcgaagacagtaagtgctacagaggaaaaccgaagcctggaaaggggataagaatggccgggttggccaggcgcagtgactcatgcctgtaatcccagcactttgggaggccaaggcgggcagatcgcctgaggtcaggagtttgagaccagcctggccaacatggtgaaaccctgtctctactacaaatacaattagcccgagcatggtggcgggcgcctgtaatcccagctactcgggaggctgaggcaagagaattgcttgacccgggaggtggaggttgctgtgagccgagatcgcaccactgcactccagcctgggtgatggagtgagattctgcctcaacaaaacaaacaaacaaaaaatcccacaaagaatggccaggttggaggggaggggtctgcagttttaattagcgtggtttgggaaagactcactgaaaaggggtcattttgagcaaaactggaaggagttgagggaatgagccctgcaggtttctggggtagaacattccaggcagagggaactgccaggcagaggccctgcaggggaaagtgtgcccagggtgaagagcaaggagggccctgtggctgaagcagagttgggaggtgggcgacaggtgaggtcggggagggcagttctgcaggaccctgtgtccagcgttctaggacttcagctttgtctctgaatgagacaagagccaccggaggattttgaccagggagagacctgatctgatttaggatttgagatctgataagatctatgtggctgccatgtgacaccaggacggaagcagggaggccggttaaggggctgctgctgtcatcaagcaagagaccaggttgaactgggccacggtggcagcagcagaggcagtgaggagagcttagattctggcttaattctgaaggatttgctgaaggactggacgcacaggcttcttgcccattgggaagaagcttcctcattaatttgttacagctgcctcgtaagggtgtgtcatcattacttaaccagtcccctacagatggacattcaggttgttccaagttttgctatttataaaaattagtattttctgtctttgcatggggttgagcacctctgcccattttccttttagcttgttggccgttttctaattgatttgtgaaaactctttcagtattagggaaattagtctttctttcttctttctttctttttttattttttgagacagagtctttagctctgtcgcccaggctggagtgtagtggtccaattcatttcagctcactgcaaccttcgcctcccaggttcaagcgattcttgtgcctcagccactcgagtagctgggattacaggcacacaacaccatgcccggctaatttttgtatttttagtagagacggggtttcgccatgttgtccaggcttgtctcaaacacctgactcaagtgacccgcccgactcagcctcccaacgtgctgggattacaggagtgagcccccgcgcccagcccaaaattagtcctttatctgctagttgggttacaactatatttttacattttttgttgacgttatggcttgacttacggtgttttgttttgttttattccaatgcggacattttttatttttacgactccaagtttgtcaacctccccttttattgcctctgggttttgtgactttcttggaaaagcctttccctactctaagattataaaataatctaccatgatttcttctggcattgttgtggttttattgtttattgagttctttgatccacttagaatttatctggagtgcagtagggacacctttgcctgtgtctcagagggtctctggaatgagtttaagtggtcagaatcataagggggggtgtggtgaattaaccacatgggtagctgaatgccgctgaatgtcactgttttctccccagttgtggagtggatgcccacacggggccggactgtggcgggtattttgctggggtattccttcaccctgggccagctcatcctggctggggtagcctacctgattcgcccctggcggtgcctgcagtttgccatctctgctcctttcctgatctttttcctctattcttggtatgtcctgaacagagtggggtgggggagggtgcacctgtgtggccgagtcttcacctggccctgtgagaggttggggtgtgcagtgaccggggcttgctggacttgacaggggacacaaaggatggcaggcgttcatggaggctgcaagctctcaagtcctcacgaatggctactgggacgctctggtaaaatcccttgcattagtgtggggccctggaacgtcccaagagcttttgccttcatcaactccttcgcatccctcaacacttcataagtactctaagtgcttataaagttataagaatataactggggcatatataagagggtaatgaagcacagcccagagagggcccatgactcacacaaggccacacagctggggtcagaaccagattcaaaaccgggtctgggataggtgtggtggctcacgtctgtaatcccagcactttgggaggctgaggtgggcagatcacttgaggtcaggagttcgagaccagcctggccaacatggtgaaaccccatctctacaaaaaaaataattaaataaataaaataaaattagccaggcatggtggtgggtgcttgtaatcccagctactcgggaggctgaggtaggcgaatcacttgaatctgggaggcagaagttgcaatgagccgagattgctccactgtgctccagcctgggcgacagagtgagacttggtccaaaaaaaaaaaaaaaaaaaaaatgccacgggtctgttgaaatcctaagtcctctgtagttttgtttttttttttttggttttttttttgttttgagatggagtttccctctgttacccaggctggagtgcagtggcgcgatctcggctctgcaacctccacctcccaggttcaagcgattctcctgtctcagcctcctcctgagtagctgtgattacaggcacacaccaccatgcccggctagttgttttgtatttttagtagagatggggtttcattatgttggccaggctggtctcaaactcctgacctcaggtgatccaccctcctgggcctcccaaagtgctgggattacaggcgtgagccaccgtgcctggccaagtcctctgtagtctttaaatactgttcagtgagtctctgtatgatgtactgcaaaaaaagggaagctggcatggcccccagacttcctgatgctacagacaggaggacaggtcatcttttttgggtctgaaagaaggtagacaagggggtattgggtttggggaatagaatgagctctacccagccccagatccttcttcctcctctcggtcccaggtggcttccagagtcatcccgctggctcctcctgcatggcaagtcccagttagctgtacagaatctgcagaaggtggctgcaatgaacgggaggaaggaggaaggggaaaggctgaccaaggaggtaagcgagctgggaggaaggaagggtgggaacagtcttcagtcttgctggcaacctccagttgtactagaatttagcaacttcccaggactcacgtgccatccaggtgtagacattgggaataaacaggacaggcagagttctcatgtgcgaaagatgttgtttaggtattgaatgattgtgtgatttaggataaataatttaactgctttgctcatcagtcaatccacctttgtaattaggaaataaccctattaaccttgacatccagttgaaattttaataaaataataaactaaaattattaaaatagcaaccacacagtaaaattactggggaatcaataacaaaagcaccattataaataccatttattataagatagttaccatttattatcaataagcatcatttctcaagccccatgccgggcactaggctgagagctttatgtatgtaatctcatttcatgtctcatttttgacaaagaggaaattgaagtggggacaggacgggtaacttgcctgagaacacacagtaggaagtggcagaaccacttggaacccctgctcttatctgactcaatctccgagtctataccaggaatggggtgggaggccctccagaaccgcagaacctcagtagtgttggagttcgtgttggagcttctcaacaccctggaaacagtgtgttggcacttctcaacacccctcaagtgccatcagtccttggacggagcggagacaagggccagccacctcaccaaagacctcaaccccagctctcctccacacagacgaaggggttcccagcagggatgtggggtccgagctccctcgctttccctgagcagagtcttcttacctaggtgatgagctcctacatccaaagcgagtttgcaagtgtctgcacctccaactcaatcttggacctcttccgaaccccggccatccgcaaggtcacatgctgtctcatggtgatttggtaggtgacaggctcatgcccaagactttcacctgaggcaggggcatgctctctgcccccactgaaaaactctgttctgaaatactcttaatgcaatgagcaggtgagccgtgtgaactcaatctcttcccacaccctttttccagcactcggcctctgctggatgctgagatgtggtgacagatgagatatcatgctaacccaggaaccccacttctgggcagtgggtctcacctgggtgggaggactattggaatcaccaaggcagcttttccagaatgtaatttgtcccatcctgatatgccctttgggctggctctccagtggattctgggaagtgtcgcactctggaaaaaacacttctggatccaggaggggatagacaggaaaattgtaattttcatgcagtgagacaagtatcctaacagcatttctgctagctggggctgctgacggcttcaggcaggagatagcatttagactgcttttaaaagatggttaattggctgggtgcggtggctcacgcctgtaatcccagcactttgggaggccgaggtgggtggatcatgaggtcaggagattgagaccatcctggctaacatggtgaaaccccgtctttaccaaaaatacaaaaaattagccgggcatggtggcgggcacctgtagtcccagctactcgggaggctgaggcaggagaatggcgtcaacccgggaggcggagcttgcagtgagccgagatcatgccattgcactccagcctgggcgacagagcaagactctgtctcaaaaaaaaaaaaaaaaaaaaaaagatggttaatcaagtttgcaaggtgggcaggaaggaatacctaacaggttcacaggcatgaagatgtgaaatggacaaaaatacaaaggcagcccatatgcagtagcaccaccagctgcaagctgacaaatcctaaggggaagggctgataaaaaacaaccgtgttgatttcattccactggatttcctgcacatttaaataattggtattgatacttatgaagcagggagtgcaggcaatgaattactatctccttccttccttcctctctctttctctttctttccttctctccttccttcccccctcccctcccctcccctcccctcccctctcctctcctttctttccacggagtctccctctgtcttcaggctggagtgcaatggtgcgatctcggctcactgcaacctccgcctcccgggctcaggtgattcttctgcctcagtctcccaagtagctaggactacaggcacatgccaccaaacccagctaatttttgtatttttagtagagacgggaactatctgttttctgtagcagactggggagtctcttttagtagatatcagctgggctctgaggccagactatccaagtgacctgagcaagtcagggagcccagcctcctggggcctctttcctacttctgtaaggtccttgtgaggatccagagttaagacatgaggccagcccgggtgactcatgtgtgtaatcccagcactacgggaagcagaggcgggaggattgtttgagcccaggagttccagaccagcctggtcaacatagggagacgcccactacctgggggtggaggggtatgtatacctgtggttccagctacttgggacgctgaggtgggagaattgcttgagcccaggagtttgaggctgcagtgccctgtgattgcaccactgcactccagcctagctgacagagcgagatcccatctcaaaaaaacaaaaacaaaaaccagttaaagcacgtaaagcacttaaaccacaggttgccccctgggaagctctggggtatagagtctttcctccggtttggatttggggctgtgacccctgtgtactgggaagatgggacggcccccaactctgggaggctgtgaggccttctgtccccaacagcgtggcaggcagcgcagttccggctctggggagcaagggggctcctgcgaacccgagtccaggaatgggcgtcttcctgcggtagcccctgccggcctgggcttgcccttcgtccaccttcctctttccgcgagggagaaacagatcctgagttcaaaattccagagctgaaagtcctctcttggatccttctggaaacagcaaaagcccgtttttgctgagaaagtgactcggcagctatccggagctctctgcctgcaggtggggccattctcctatggagccgacccgacccgctcaaagctgccccgggaaccgcaggtttggttcgcgcacgccgggacttgccaaccgcacccgaaaaatcggggccatgtccaaatgtttcgcttcgctgccggcagggagccgcgccgggctcgctcctgggatcaactgcacagtcctggctttggggagcgggaggcggtgagcctgcccgccccccgaccccttcctcaccagtgtgtctggggtgaggtggggatggggagtcctggggttcgaaaaaggatgggggaggagaaagaggaagtgttaggaactggtgaactttcacaaacttccacaaaccctattgtaaatgccttcaattaactgggatttttttctttactggttgattgatttaagacaaggtcttgctcgggcacccaggctgcagtgcagtggcacaatcatagctcactgcggcctcgacctcccaggctcaaacgatcctcccacctcagcctctgtagtagctaggactacaggtgcctgccaccaagcccgggctcatttttaaaaatagagatggggtggggtcttgcaatgtcgcccaggctggtctagaactcctggactgaagcgatcctcccccttggtctcccaaagggctggaataacagggttgagccaccttgtagtttttttctaaattctgagaagcatgcatactcattgttaaaaacattttttccccaaacaatccagaaacaggcagtgtagttcattggttaagaagcaggactcgaacgtactcctttggtttgaatctcagctctgccacttactggctttgtgatccttgacaagttacttaaccgctctgtgcctcagtttctccatttgtaacatgggcatcataatagaacctaccacataaggctgttgtgaaaattagtctgtaaagcaggtagaacagtgcctgaatatgagttgttttctgttatcaggtacataagtgcatgtccctctcaacctactctcccttccacctctgaacatctcccatctcccatttctgtcaggcatgaatttgtatccttgcagctcttagtacatacatgacacccacatacttacacacacacacatacacacgttcttatagaaatggatttaataggggctgggtgtggtggctcatgcctgtaatcccagcactttgggaggccgaggtgggcggatcacttgagtcaggagttcgagaccagcctgtccaacatggtgaaactccatctctactgaaaatataaaaattagccaggtgtggtggcacgcacctgtagtcccaactactcaggaggctgaggcaggcgaatcacttgaacccgggagacagaggctgcagtgagccaagatctcgccactgtactccagcctgggcaacagagcgagacagagtgtctcaagagaaaaaaaaaaaaggattaatactctacctcttctgcttttgtttttttaataacttaatcacatctgtaaaaacttttacaacattacatgtaaccagcttccggcatgtgatagctttgcaataaatatttgatgagtgaatgaaccaatgagtgaatgaatgaattttagaatattgtgagccacagaattataagatgaaaaggaatcttagagaatgtctggtccattctccctgccactgccaatctcgcctgagtggcaatgctggctagtcgtggtccagtctctctgggaagactccgtttctagagctcacattctcaggagcctttcccccttctttcctcctaggtgagcagacacgttaacaagcaaaagaactgaatgtaaaactggtggtttttgactgagtgtccctcaaatttctcaatggccactttattttttgtgaatgttatagtcttatattgcttataacaaatcaccataatttagtggcttaaaataacacccatttatgagcttacaattctgcaggccagaagtgccagctgggttctctgctcaggctcttaggaggctgaaacgaagcctcctttctggaggctctggggaagaattcacagccaagttcatttcaattgttggttcgatttaactgcttgcagctgtaggatttatgtctccatttcctcacaggctgttcataaaagccacctacattcctggctaagtggcctcctccacctcaaaggaatatcttcctcatatcaaatctctcccatgctttgaatctccaactcccagtctttgacctctagacccagatttaaatctcatgttattagatcaggccctcccagaaaaatctctgttttaaagttaagtgatttgggaccttaattacatctgcaaaatcctttcacaacacctagattagtgtttgaataactgggagaaggtttgtgtacacccgggccaggaatttgatggaccatcttggagttcttcttcccacatacaggtttatttgtttttttgtttttgtttttgtttttgttttttcaaggcagagtctcactctgtcacccaggctggagtgcagtagtgccatctcagctcaccgcaacctctgtctcctgtgttcaagcaattctcctgcctcagcctcctgagtagctgggactacaggtatgtgccaccatgcccagctagtttttgtatttttagtagagacgggttttctctatgtgggccaggctggtctcgaactcctgacctgaagggatctgtctgcctcagcctcccaaaatgctgggattacaggcatgagccaccgcacgtggcccacatatactttttattgaagtataacacacatgcaaaaatgcacaaggctcagcttgacaaattctcacaaactgtacacacccattaatcaacacactggtcaagaaacagaacatgatcagcctccagaaaccccgtccccccatgtcttcttcagtcattaccctcccctatgggaatcactatccttatttctaatgccacagattacattagcctgtttttgggctttatataacttgagctacatagtttttgtaatttataccgtttgtgagatgcactcatgttgtcatatgtaatttagttcgttctttcttcgtgtataacaatccatggtacgaatatactacttgtggtagacagaataatgacccccaaagatgtttgaatctttatagcttttctgtaaatatatatttattacaaaataaaaattatttttaaaaagcaaggtatgcagtagaataagatacttgcagaaaccaatatccaacaaaaaaccatatccagaaaatatatctacgtctatatataatgtatatatattactagaaatcaataagtaacattcgtccccatcctaatccctggaatctataaatatgttaccttctatggcaaaagggactttgcagatgtaactaaggatcttgaaggaggattaccctggatcatctgagtgggcccagtacgatcacaagggtccctacaagtggaagaagaaggtcagagtgagagagagacctttggagacgctgtgtgctgctggctttgaagacagaggaaggagccacaagtcaaggaatgcaggcagcctctagaagctggcaaaggcaagcaaacagattctcccatggagtcttcagaaggaacacagccctgcccacactctgacattagctcagtaacacacgttaggcttctcacttccagaagtgtaagataatacatttgtgttgttctatggcactaaatttgtggtaatctgttacagcagcaattggaaactaatacagaaacgttaccaatttttttttttctgagacggagtctcgccctgttgcccaggctggagtgcagtggcacgatctcagctcactgcaacctcctccgcctcctgggttcaagcaattctctgcctcagcctcccgagtagctgggactacaggcgcgtgccaccacgcccggctaattttttgtatttttagtagagacaggatggtctcaatctcctgaccttgtgatccgcagatctcggcctcctgaagtgctgggattacagtcgtgagccaccgcgcccagtctacctattttattgctgaagaacattgggcttttcccaggttgggctgttacaaatactgctgctataaatattcttgtacatttctcttggtgaaaaaacacacttgtctgtccttccttccttccatccttcctttcttcctttccttccttcctttccttccttccttccttccttccttccttccttccttcctttctttctttctttctttctttttctctctttctttctttccttaaatatggagacaggatctcactatgtcgcccaggctggtctcaaattcctaagctcaagcaatcctcccacttcagcctcccaaagtgctgggattacagatgtgagccactgcactgagcccacgcttgcgtttctgtcagatacatacctaggattggaactgctggatcataaagtatgggtgtgtttctctgtaatagaagcaagcagttttccaaagtggttataccaattcacaccctcattagaagcatatgagttcaacttgttccacatccctagtaacacttggtattgtctgtaatttaattttagccattatagtgagtgtgtagtgatactgtactgtgatttccaatttgcacttctctgatgtctaaggaatgtaaaaatatttgcatgaacttattggtattttggatggcttttttttaatgaaatgcttatccaagacttctgccaatgtttctacagggttatcttttttcttatcgccttacataagaattttttttttcttggccaggcgcagtggctcatgcctgtaatcccagcactttgggaggctgaggtgggcagataacttgaggtcaggagtttgagaccagcctggtcaatgcagtaaaaccccatctctactaaaaatacaaaattagctgggcgtggtggtgtgcgcctgtaatcccggcaacttggaaagctgagacaggagaattgcttgaacctgggaggcagaggttgcagtgagctgagattgcgccactgcactccagcctgggcaaaaagagtgagactccttctcaaaaatatatatatacattttatatatatatatatatacacacacacacacattatatatatacattatatatatacattatatatatatacacacacacatataaacatgtatatatttttttctggataaaatttattttctggatattggttttcttaaatatattctgttagcttaccttcataaaattttggaataaatgtgtatttattcttctataaatgtataattatagaaaagttgcaaagatagtacagagagttcctgtatccacttcacccagtttcccctcatattatcatcttaaattaccttagtacatttgtcaaaagtaataatttaagattggtaatttactattaactaaactagagatttatttggatttcaccagctggtatatcccattacatttagttattatgtcttcttggtctcctttgatctgtgactgtttcttagtctttccttatttgtcatgaccttgacagttttgaaaagtattggtcaggtattttgtagaatgtccctcaatttgaattttttttttcttttttgcccacgttggagtgcaatggcatgatcttggctcactgcaacctccgtgtcccgggttcaagggattctcctgcctcagcctcccaagtagctgggattacaggcatatgccaccacacctggctaatttttgcatttttagtagagatggggtttcaccatgttggtcaggctggttttgaactcctgacctcaggtgatccactggcctggcctcccaaagttctgggattacaggcatgagccactgcacctggcctcaatttggatttgtctgatggttctctcatgactaaactgggattgtggatttgggaaaggagaaccatggaggtgatatgaccttctcatcatatcatatcatatcatatgagggcatatatgatgtcaacatgactgattactggtgattttgaagttaatcccttggttaaggtagtgtctaccaggtttctccactgtaaagttaataaatgttctctttccatattcttgttttacttttcaattttaatctatttatttattttgagaccaggttatgagactggcgaatttttgtacttttggtagaaatggggtttcaccatgttgccaaggctagtcttgaactcctgggctgaagcaatccacccacctcagcctcccaaagtgctgggattaaaagtatgagccaccatgagcagcctctttccatatactattatttgaaagtgagtccagtccacactcaaggggagggaaactaagtttcatctcctgaaggaatggatttttttgtttgtttgtttgttttgttttgttttgttttgtttgagatggagtctccctctattgcccaggctggagtgcagtggcgcgatctcggctcactgcaacctccgcctcccaggttcaagcaattctctgcctcagcctcctgagtagctgagattataggcgcctggctaatttttgtatttttagtagagacggggtttcaccaacttggccaggctggtcttgaactcctgacctcatgatacacccgccttggcctcccaaagtgcttcgattacaggcatgagtcaccgtgcccagcctaggagtggagtatttacacacattgtttggagttcttctttaagaaagacttatttatgaaatcatttatttatataggctcatgtgtaaccatgtagtttatactttgggttataattcaacaacgtttttcctttatttagtagatactacattctttaccttatttcccaaattcctccagctttggccattgggagctcttccacattggctcctgtgtcctttgaccttcctccatcttcttctctttttattttttagcactgccttaatttcggcgctgaggtgggtactgcagagaaaagcaaacactccagaacccatgcactggatccaggagtgggtggtagaaagggatgtggagggaggggtctgagctctaatactaaagacagagacttaggagaccgtgaaggggtgtttatggaaagtcagggaattttacctccccgaggagaggaatcctgtgtcatccacctttgtgtcccctcccctgggctcacaacagtgaaccatggggtgaacaaggaccattccactgcctctcccaggttctccaactctgtggcttactatggcctggccatggacctgcagaagtttgggctcagcctatacctggtgcaggccctgtttggaatcatcaacaccccggccatgctggtggccaccgccaccatgatttacgtgggccgccgtgccacggtggcctccttcctcatcctggccgggctcatggtgatcgccaacatgtttgtgccagaaggtgagtcacccacttctgcccttgctgcacaccaagaactgggagcctctggggtctggtagacaacaaatttcacatggcagcaaggctgaagggtatgtctccggatctgaaaagaaagcaactgttaggctgggcacggtggctcacgcctgtaatcccagcactttgggaggccaaggcgggcaaatcacctgaggttaggagttcaagaccagcctggccaacatggtgaaaccccgtctctacagaaaatacaaaaaaattagctgggcgtggtggtgtgcacctgtaatcccagctacttgggaggctgaggcagaagaatcacttgaacccaggagacggaggctgcagtgagccaagatcgtgccactgtactccagcctgggagacagagtgagactcaaagaaaagaaaaaagaaaaagaaagcgactgttgattactagagtttgtattaagcacttagtgcccagtggcaattagtggcaggtggaggtcttgagccttggccctcagagcttctactgtgtggccagggaggttagacaggtgcacctaagcagctggagagcacaggggctggctcggtgtggccagcagtgtgtgcggccccccgaagtctgagcaggcagcatgtccaagggttgagaagttaggattcaaacctcagctggactggccctggaacagtggtttgcaaacctggctaaaatgaccttctcctggagcgctttgaaaactcccagggcccaggtgctccatgccagcgccctgggaatctcaaggagtggaactcaaccctcagtattttacaaactgtccagtgagtccagcaagacgccagggttgaatagcagcgacatagagcatgggccaaaccatgtgcccattgtgactgcagccttggccgtgggcaggttgtccaacttctctgtgccttagttcttcacctgtaaaatggataaatgttattattggtgtcttgacctatttcattccaatcttttttcctatttatagatttgtattcagcatagttgagatattttatatgtttatacatacaaaaatataaataggatacatacatatatatgtatatatgtgcatgtgtacatatatatatatatatatatatatatatatagtgcccttatttcattatatgttgaaacatacacattcttttccatgttagcacaaatgtttcatggacctgatttttttttttttttttgagatgaagtctcatttgttgcccaggctggagtgctgtggtgctcactgcaacctctgcctcctaggttcaagtgattcccctgccttagcctgcagagtagctgggattagagatgcgtgccatcatgcccggctaatttttgtatttttagtacaggcggggtttcatcattttggccagggtggtctcaaactcgtgacctcaagtgatctgcccacctcggcctcctaaagtgctgggattacaggcatgagccactgtgcctggcctcatggacctgattttttattgctatgtgatccttccctccctccctccctcccttccttcctccctccctcccttcttcctttcctcccttctgcctttcctccctccctccttttctttcttcctttctttttctttcttttctttcttttttaagacagagtctcactctgtggctcaggctggagtacagtggcacaatcatggctcactgcagcctcgacctcccaggctcaagcaatcctcccaccttagcctcctgagtagctgggactaccggtgcattccaccacacctggctaattttttgtattttttgtgtagagacagggttttgccatgttgcctagtctggtctcaaactcctgggctcaagcgatctgcctgccttggtctcccaaagtgctggggttatagacgagagccactgcacccagcctagataatatttcatctagattgatgtttctaactctggcctcacaatagaatctcttggggacctttaaaaaatacccaaatttgagcccatccccagtaggtcttgctagagtggacattgagtaagacccaggtgtgagtgttttataaaatctccccacctgattccaatgtgcagccagggctgccacccagccagagaaggcaccatcatttccttgactgctgtcctaacgttggatgtttgaataggggttttgctacttataaacaacagcgggagaagcatattgaaaatgaggacaatgggccgggcgcggtggctcatgcctgtaatcccagtactttgggaagccaaggcaggtggatcacctgaggtcaggagttcgagaccagcctggacaacatggtgaaaccctgtctctactaaaaatacaaaaattagctgggcgcggtggtgcacacctataatcccagctactcaggaggctgaggcaggagaattgcttgaacctaggaggcagagattgcagtgagccaagattgtgccactgcactccagcctcagtgacagagagactctgtctcaaaaaaaaagaaagaaagaaagaaagaaaatgaaggcaatggcaaacatttaatgggcactttgcacacctggcattgtgtccagcttacgccaaccccatgaagcaggtgctgctattttccttattttacagatgaggacagggaggtgcagagtgggtaagaaacactgacctaggtcagccagcggggtgagagctgcaatttgaacccaggcctgactctaaagcacctgcctacccagcaggacttggtgacagatgcaaataaaggagcaaggagggagaagtcagagaagggcagtcaggggactcctgggtcctaggaacagttgggaaggggaggtggtggaaatcctggttctcctctgggttctgagtgggctctgcctcttccccccacctcgccctatcccctcctgaggctccacccttctccactacaccctgggcctccctctcctcccctcctcctcagctgcaccctactcccctgtctaggcacgcagatcctgtgcacagcccaggcagcgctgggcaaaggctgcctggccagctccttcatctgtgtgtacctgtttaccggcgagctgtaccccacggagatcaggtgggtgcatggggggagatgctgcaggttgagacctgttgggctcaccgaggcaggacccctggtccctcctgccctgtcctctgacactcagggcgtggccctcttgggcccctaggggtgcaggttgctgcactgacccatccccatccacacacctcccacaggcagatggggatgggctttgcctctgtccacgcccgcctcgggggcctgacggcgcccctggttaccacacttggggaatacagcaccatcctgccacccgtgagctttggggccaccgcaatcctggctgggctggccgtctgcgtcctgaccgagacccgcaacatgcccctggtggagaccatcgcagccatggagaggaggtgaggggcctccagcaccaagaggccgaaagttacaggaaataactggggggcaaatggggtgccctccccactcctgcgtatcggaaatgtcctggccagatgcaccagagctgtgagatgcctcccccacctccatctgcactggcttagctttccccaagaacagacccaatcacgaaggtagaaaagaataaaccgtgaacaaggaaacacgtgggttggaagtgagacgtggcagagaagtgaggagaggagagcggaggaaagtgaagcaaagacaggctcccatggttgctgtgcaggcttcaaatttggttctgggcttcttcacaacagaaagggagaccccattcatggctgctcttggaaaggaaaacaaataccagtccctcaggagagtgaagctttccttagcatttagcactaggagaggtttctcttcactgcttggccccccacccctcttttctttttttttttaagatcatcttggcttcaagtgtgggtctcattagaaaggtcactaaggtgacagcaatgtcctggacaatgtttctaaaacaaactcaagaggggacttgatctggctgcttcttgcagcatttctcagcaacagtgggctcagggaagacccttagtttgcgggaatggtgacaggaacagtagccgcgcccgtctgtaaccctctctgaaggtcagcttgatcccaaaggtggacccatctgtacccagtggcctgtataggtgctgtgtttgcaaccctgaaataactcccataaacattccatctctaacctgagccatgggccaaggctgaactgcaagagatcaaggatatattctttggcaagtcctatcatttcttttctttctttttttttttttttttttgagacattgtctcactctgtcaccccggctggagtgcggtggtgcgatcatgactcactgcaacctccgcctcccgggttcaagtgattctcctgcctcagcctcccgagtagcagggattacaggcgcccgccaccatgcccagctaatttttgtatttttagtagagatggggtttcaccatcttggccaggctggtcttgaactcctgaccttgtgatccacctgcctcggcctcccaaagtgctgggattacaggcgtgagccacggcgcccagcccaagtcctatcatttctgcctccagaatagacttaaatctgtcattctctctccagccctgtgtccatggccctatatcaagccaccattgtctcttgtctggacaactacgagagcctcatatcttcccctgtccctgtccactttattccctgcaggccaagtgggggaggacagtcttcatctgggtgctgagcagggcttggagaggatgagggtatgggaggcggagtgttaaagtgcatgtatgggccaggtgcagtggctcacacctgtaatcccagcactttgggagactgaggtgggtggatcacctaaggtcaggagtttgagaccagcctggccaacatggcgaaaccctgtctccattaaaaatacaaaattaggctcttgctacttccttcttcccgctgccgggaacacaagcaaaacgttgagggctgcagcagccatctttgaccatgaagtaaccttaagaaaggaagccattctccctctccctctccctctccctccctctccctccctctccctctccctctccctctccctccccctccccctccccctccccctctggtctccctctctttccacagtctccctctcatgcggagccgaagctggactgtactgctgccatctcggctcactgcaacctccctgcctgattctcctgcctcagcctgccgagtgcctgcgattgcaggcacgcgctgccacacctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcctggccaccaccccgtctgggaagtgagcagtgtctctgcctggccgcccatcgtctgggaagtgaggagcccctctgcctggctgcctagtctggaaagtgaggagcgtctcagcccggccgccatcccatctaggaagtgaggagcgcctcttcctggccgccatcacatctaggaagtgaggagcgtctctgcccagccgcccatcatctgagatgtggggagcgcctctgccccgccaccccatctgggatgtgaggagcgcctctgcccggccgcgaccccgtctgggaggtgaggagcgtctctgcccggccgccccgtctaagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccgtccaggagggaggtcggggggggtcagccccccctgcccggccagccgccccgtccgggagggaggtgggggggtcagccccccgcccggccagccgccccgtccggaagggaggttggggggtcagccccctgcccagccagccgccccgtctgggaggtgaggggtgcctctgcccggccgccccgactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcttgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcaggttcctctgcctaggaaaaccagagacctttgttcacttgtttatctgctgaccttccctccactattgtcccatgaccctgccaaatccccctctgtgagaaacacccaagtattatcaataaaaaaataaattaaaaaagaaaaaaaaaaagaaaaaaaaaaaaaagaaaggaagccatgtgctaagaatggtggagaagaaaggaggaagtgcgtgatgaatttgtcaacatccctggactacctaattccagacttttttaagtagagaaaaataaacctctagtttatatataaaaaaaaaaatacaaaattagccaggtgtggtggtgggtgcctgtaatcccagctacttaggaggctggggcaggagaatcgtttgaacccgggaggtggaggttgcagtgagccgagatcgcaccactgcactccagcctgggcgacagagcaagactccatctcagtggggttggggtgggggagttgggaagattaagccaatcgactaaaatattataaatagaagagttaaaaagcaaggatagaaacatagataaaacagtatgaatgctggaaaaaatccaaaaatggaaacagcttaaagtagacaggagaaatgggcaagatatgaaacgattaaaacaagaggataacagcccaggcgcggtggctcacacctgtaatcccagcactttgggaggcagaggcaggtggatcatgaggtcaggagttcgagaccaacctagccaacatagtgaaaccctgtctctactaaaaatacaaaaattagccgggcatggtggcacgcctgtagtcccagctactcaggaggctgaggcaggagaatcgcttgaacccaggaggcagaggttgcagtgagccaagattgcaccactgcactccagcttgggcgacagagcaagacttcgtctcaaaaaaaaaaaaaaaaaagaggattaaaaaaactaagataattccgtgggaaaacagttatcagtgtccacaatacaaaaataaaaataaatggaaggaattagaacataaatcatttcaaagactagagggttcttttttaaggcgataggccaggcatggtggctcatacctgtaatcccagcacgttgagaggttgaggcggaaggattgcttgagccccggagttcaagaccagcctgggcaacatagcaagacccccatttctacccccccatcaaaaaaggcaaaattggatcttgtcaagtgatagaaagccagtggggtagcctcaggctatttgggactgagggggcctcaaagtccaggcaagccccccaccaccctcaacctcccctgacttcttcaagagccaaccagggcagggcaggagtggctcagagccctaatctttgtccctccctgcctcctggggtgggagaagaagggtgctaatagtgcccagtcgctgggggtgtctgctggcccctgttctccagccaagtgaccttgggcatgtgtccaccctctaggtcctcatctgtaagactctttgttgaacttcttgaccctgcagctctcccaagtctgtttccagacaggccagcctctgccagctgcaagaccccagggatagagcaaggagggagctggaggaacaataggagggtggccaccagggtgcccaagagaatccagaggaggggccactgcagcatccacctcccttctggcttcaggagggtggagctgcaccctgtgcatatggcaccaccctccccatgacatgcacaccacctgcccctcaccactgccttctgccttttcatttctacagggtcaaagaaggctcttccaagaaacatgtagaagagaagagtgaagaaatttctcttcagcagctgagagcatctcccctcaaagagaccatctaagctgcctggaacctggtgcttgctagcagcacctgagccgatgtccagacggccccctgggggcttctcccaggagcccctggggacactggtgctgaactggaggaaaggtcgctgaaaacatcatggctcctatagacagccacccacaagccagggctgcttggagggaaaccccaccagaaacagccaatctgtgttacaaatgcatagaaagccaggagaagccagtcccagggaccaaaggagagactgttttcctttcccatccccaatctgccccttaaaatgtctctgtattagtccattcttgcactcctataaagaactacctgagactgggtcatttacaaggaaaagaggtttaattgactcacagttctgcagattgtacaggaagcatggctgggaggcctcaggaaacttacaatcattgcagaaggcaaagaggaagcaagcacgtcttcacatggctggcaggagagagagaaagtgaaggggaaggtgccgcacactttacaacagccagatctcgtgagaactctttatcacgagacagcactaggggggtggtgccaaaccattagaaaccatccgcagtatccaagcaccttgcactaggccccacctccaacaccggggattacaattaaacatgagatttgggtggggacacagagccaaatcatatcactgtttattcttgttccacttgagaatgctgtgtctttgcagggttagggtgatatctctgccaaagggttgtccctggaatagccccactcatccttgagaaacgtggagaactcattctattccactcacccggaaagagtaaatactcttctgccttatgggattaaagctctttcccccgtgtgtgtgtgtcttacctccttgacaggaaaatgtctccatagcaggcattcttgcctacctttgtagctccagcagcccctcatagtggccttgcagaagctgcatgtttaataaatagttgatgaagaaatgatcaaaacagactcccgcaatagatggagacctttgtgcgttgtttgcattcctagcaataccactttgcagaactgggatatggttcttttccccagaagccttcttcaggtgtgtgccactatgatcagctattttttttatttcatagcaatagggtcttgctttgttgccctggctggctttgaactcttggcctaaagcaatcctctggcctcagcttccccaaatgctgggattacagagaggagaaggcctagtttggcacagcatcccgctggcctcagatctatttccagcccaggtgttggccatgtatccctgaccttaaccttcactggaattcagattagatttataagggattcgaatcttggcccattgggttgtcttggccaaattttcttgtctgatcccttcttcctggagttaccagataatccaacaagatcaattctcagtcccctacagcccaaagaaaggcacaatatagggaagaaacaagactatcacagtctgggcaggaagcatggcagcttgccgttttgccaagattagtcttccaacagcttggagcagaggtggaatgtgactcccccaaggacttgtcccaaggccctgttattgatgcactgaatcctcagctcctccccagggatttaacctctttttgaacatgtcagggaacacctgtgtgatccgctacatgagcttttccattcgagttgttctccacccacagccctcagcaaatcagtgatttcaataggcagagggctgctgtgcctggccatgctttgagattcaccttgggggttacctcttccaggcagctttcactgaccacacctgcctacctctgcgtgctgctccactcccccgcaccacccccatcccccccaccccagcctgctgccccatgccctctattgcaatctccttattgcactttcccattgtgttgtgatgggtccatttacatgctgatctctccagtggctcctcaaaggcaaagttaaatcatcttttcttgacctggcctgcacatggcaggtgctcagttcatgttgccagagtgaatgacttttttttttttttttgaaatgaagtctcactctgtcgcccaggctggaggtcaatggcgtgatctcagctcactgcaacctctgcctgctgggttgaagcgattctcctgtctcagcctcctgagtagctaggattacagacgtccaccaccaagcccagctaatttttgtatttttagtagagacggggtttcaccatgttggtcagactggtctggagctcctgacctcaggtgatccacctgcctcggcctcccaaagtgttgagattacaggcttgagccacagcacctggccgtgaatgactattattttatttatttatttttgagacagggtctcactacgtcacccagggtagagttgcagtggtatgatcttggctcactgcagcctcgacttacctggctcaagcaattatcccgcctcagtctcccaagtagctaggactacaggtgtctgccaccatgcctggctaatttttaaagtttttgtagagacagggtcttgctcttttgtccaggctggtctcaaactcctggactcaagtaatccttttgccttggcctcccaaagtgctgggattacaggcatgagccaccacacccagcctttatttttatttttgaagaaaatttagaataatggttctcaatcttggaatcacctgtgagctttttaaaaaaaaataccaggccgggcgtggtggctcacacctgtaatcccagcgctttgggaggctaaggcaggcagataacgaggtcaaaaaattgagaccatcctggccaacatggtgaaaacctgtctctaccaaaaatacaaaaattagctgggcatggtggcacacacctgtagacccagctactcgggaggctgaggcaggataatcacttgaacccaggaggcggaggttgcagtgagctgagattgctctactgcactccagcagcctggcgacagagtgagaccccgtctcaaaaaacaaaaaacaaaaaaaccagtgctagagcccactccaatccagcagataaggttaattataacaagactgtgacctcatagttaatgagttacttaccatggagttagtaagctaatttgatttccctgcacacagacaatacatacttttaagtgaacaaactagattttctttctttttctttttctttctttctttcttttttttttttttgagactggatttcgctcttgttgcccaggctggagtgcaatggcgtgatctcggctcatcgcaacctctgcctcccggattcaagcaattctcctgcctcagcctcctgagtagctgggattacacgcatgtgccaccacgtccagctaattttttatttttagtagagatggggtttctctacgttggtcaggctggtctcgaactccggacctcaagtgatccacccgccttggcctcccaaagtgccgggattacaggcgtgagccaccacgcctggccacaaactagattttcttgaagaaatattctgaccatgaagtttcctatgacaagtataaatgatcttgaggttacaggtttcaggccacggaatcaaaccataaagcctttgactaccattgtccttagccaaaaacactggccaggaactattaaataaaaatgagtgcccaatgatgacatatagactgggctgtttaaataggattccacatgcctggcaccttttataataatctttatggtaactggcaaatcacctccagacttcttttcttttccatctggaaacactgaatagtcagtacattttattttcaaaatctgtgataacaagtttaggcacagtggctcacgcctgtaatcccagcactttgggaggccaaggtgggaggatctcttgagaccaggagttagagaccagcctaggcaacatcagaagactccatctctgctaaaaaaaatttagctgggcatggtagtgtgtgcctgtagtccctgctacttgggagccctaggtgggaggatcacctgagcccagggaggttgaggctgcagtgagctacgatggttccaggctgggtgacagagtgagactttgtctcaaaaaaaaaaaaaaaaaaatatatatatatatatatacacatatatatatatatatatatatatatatatatgtatctgtatatatgaatgacaaccttcttactgaaatctctatacatttccaagtattattaggccatgtggctatgtggctgcaaggagacggctcaaggtcaaggtgcccggaggattcaggataccagtgattgcctgggcctggttcacaggcagatcagctaaatgaaagaccgaaggtgtcctgggccattgctgctgtgcagccctcaaggaagttgctgacaactgtgtgtggaaaagagaactctgcttaatctgggctgtggtgttgccccagaaaacagcagccagaatgcaccttgttacatcgtcacccacccatgaccacactggtcagacctgtgcagccaggcagcaggtatgttcaaaagatggacttttgcctttaaagtttagctctaaatgcaggtgtctccccggaggaatgccccccaccaacttaaataattgtttgattacgaggttggggaggagcaaggaggccgagactggctggatgagaccaaaccacataactcacccttctccctcttctgctttctttccatgcctactctgggaaaacaggctactggactttcaagtagcaaagaagagagtgagtgctgaggacggggagttctaacctcatgcttcttttgcagccactctggttgctggatttgggcaattatggagaccaatgataatgatcatgaacatgaggtgacagctcccaatgtggacctggcatggcccacagtcaggcagcagatgttttagaatagtacaaggtgaagccgggcgtggtggctcacacctgtcatcccagcactttgggaagccgaggtgggcagatcacctgaggtcaggagctcaagaccagcctggccaacatggtgaaaccccgtctctactaaaaatacaaaaattagctgggcatggtggtaggcacctgtaatcccagctactcaggaggctgacgcctgagaaccacttatagctgggaggcagaggttgcagtgaactgagatcgtgccactgcactccagcctgggcgatagagcgagactcagtctcagaaaaaagaaaagaaaagagcgagactcagtctcagaaaaaagaaaagaaaggaaaagaaaagaaaaaagaaaagaaacgaaacaaggtgtataaggagaaactgcctggcctcctaggcacaagtctgggcaaatggtatggggaagacctggcggagattagaaaaagggtgaagccatcgctgcaggaacttgtcatggggaccctggggctgtggagggagaacgggatccacagctggagggaaggaaactgggaggtcaggtggagacagggaccactgagctctttcagctcctgtccataggatgttcagccagttcaacccagactgccactgccacctcaacttgagcactgaccaatgaagaatcttaatcagaagtttcccaacatgccggacgtggctcacgcctctaatcacagcactttgggagacggaggcaggcagattgcttgagcccaggagttcaagactagcccgggcaacaaggtgaaaccccgtctctactaaaaatacaaaaactagccatgtatggtgacacatacctgtagtcccagctacttgagaggctgaggtgggaggatcacctgagcccaggaaggccaaggctgcagtgagctgtgatccagcctggctgacagagcgagactacatctcaaaaaaataaatgagctgggctcagtggctcacatctgtaatcccagcactttgggaggccaaggcaggcagatcacctgaggttaggagttcaagaccaacctagccaacatggtgaaacccccatctctactaaaaatacaaaaattagctggacatggtggcacacacctgtagttccagctactcaggaggcttaggcaggagaatcgcttaaatccgggaggcggaggttgcagtgagccgagattgtgccactgcactccagcctgggtgacagagcaagactctgtcttaaataaataaataaataaatgaataaataaataaataaataaaagaaacttcccaacagctactggctccgccaggaaggaacagcctgcacttaacacaatggtacaagattcactttctgagctggtttgattccttttgtttcatcctgttatttttggatggttttgtgtgtttttcacagactgtttgttcggaatgcaccaacacaagtggccatggacaatcacgttgccctggacttccttggagtcagccgaggtggggtatgtgtggtggccagcacctcttgcctcacaatttgcttaatggcatattttggtggcttggctctggctcggaccctggctgtgtaggcctggtcagcctgctggcagtcacagttaacggccacattcatctcatgttctctaaagaaaataaaatagttggttgggcgcagtggttcacgcctgtaatcccagcactttgggaggctgaaccgggcagatcacctgaggtcaagagttcgagaccagcctggccaacatggcgaaaccccatctctactaaaaatacaaaaattagccaggcatggtggcgtgcacctgtaatcccagctacccgggaggctgaggcaggagaattgctggaacctgggggggcggaggctgcagtgagcagagattgtgccactgcactccagcctgggtgacagagcaagactccatctcaaaaaataaaataaaatataaaataaaataaaataaaataaaataaaataaaataataaaataaaataaaataaaataaaataaaataaaataaaaaaataaaataaaataaaataaataaaatgttttggggccgggcatggtggctgacacctgtaatctcagcactttgggaggctgaggccagcagatagcttgagctcaggagttcgaggccagcctgggcaacatggtgaaaccctgtctctaattcaaaaagaaaaaaatgattttgaggccaggcagtggctcacacttgtaatcccagtgctttgggaggcagaggcgggtggatcacttgagttcaggggttcgagaccagcctgagcaatatggtgaaaccatgtttctacaaaaaaatacaaaaaattttaaataattgtttaattatggtattgctgggtgcagtggctcacgcttgtaatcccagcactttgggaggccaaggcaggcagatcacttgaggtcagcagttcgagaccagcctgaccaatgtggtgaaatcccatctctactaaaaaaacaaaaattagctgggcatggtggcgcacacctgtaatcccagctacttgggaggctgaggcacaagaattgcttgaagctgggaggcagaggttgcaatgagctgagatcatgccactgcactccagcctaggcaacagagaaagaccctatctccaaaaaaaaaaattatatatatatatatggtggtggcatgtgtctgtagtcccagctacttgagaagctgaagcaggaggatcacttgagcccaggaggcagagtgcaaacaactacagtatctgatgtggcagctatacctctgagagtccttagctggatacatgaaaggccagagaccagccaggtgtgggggctcacgcctgtaatcctagcactttgggaggccaaggcaggtgaatcacctgaggtcaggagttcgagatcagcctggacaacatggtgaaaccccatctctactaaaaatacaaaaattagccggatgtggtggtgcatgcctgtaatcccagctactcgggaggctgaggcaggaaaatcacttgaacctgggaggtggaggttgcagtgagccgagatggtgccactgcactccaccctgaacaacaaagtgagactccatcccaaaaaaagaaagaaagagagagagagagagagaaagaaagaaagaaagaaagaaagaaagaaagaaagaaagaaagaaagaaagaaagaaaagaaagaaagagaagactggccagagaccaaaatacttaggccaggtggcaaaggcttcagctgcagctcatctgagtcttggcatcagatgatgcctcttgcgatcatccagagggtcaaaggcctataggagttactaccaggccacctcccattggcctccccgtctccccctggaggctgtcatgagacggttctgcatcacctccaggttctgtgagatctgaggctctgcaccctgccctcctctgaatacagctgcagaagataaaattactcagctgcatctggaacaggctcctcagctacggggcatcgcccaactccccttgcagtcacaagccccttctctttcagggtcttcctttttggcgtagaggacaaggaccgcaggggctggcaccttaggcttgtcctccttttcactgtctatgtagagaataaaccctaaatctaaaagtggttcatcgtgcctttacaggtcaaatcagtcaggacttggcctctgcctggcctcgttggatgtgagcttgacagtggcctattgctccacctctcatcttaactaaggttgaatcagagaatttgggatagaatttttggctgtcacacaggtctaataatgcccctgagcttgggagagacaactgatttatggaacctcaataaatattggtgactggctttgaaattaagacacagggattatatctggaaggcttccatttaaatgggtcacatgaaaggtttaatccctgaaggaatatatacatatatattccttctatataggaatctatatagaaggattctatataggaatctacataggaatctatctatatatatgtgtgtgtatatatatagatatatagatatacatatacacacacacatatatatatatatagagagagagagagagagacagagttttgctcttgtcacccaggctggagtgcaatgacatgatctcggctcactgcaacctccgcctctcaggttcaagcaattctcctgcctccaactcctgagtagctgggattacaggcacctgccaccacacccagctaatttttgtatttttaggggagatgggatttcaacatgttggctaggctggtcttgaacccctgacctcagatgatccacctgcctcagcttcccaaagtgctgggatgacaggtgtgagccaccgcgcccggctggaatatttatatattgaggacaccttgtttcctgatggagagccaacaagatgtaagttaccagtgtgctggacaaatacccagaagctctttcccaacaatcctctagaagaatgaggccagggagtacatttctttgaccacaagggcgtgtgtggagaagcctcagtgatcagtagcagtgagacagtaggatcgggttcttggagttgctccacagcggcggcacaggaaacttccagatcatccagactgcactcacgctattccctgcgtgcctgctcacctgccacaacttcctgcagaacttcacagccataccccagaacatcactgccggacaggtgataactggaccaatagatctcctgtccgagccgtgtcagggatagggacctgctgggggtcttcattctgctgagcaaggacccaaagcttgagcaatgcttgagggtctctgagccccagtggcagatcttaaaccacagcagctcctcctctttgggcctgggcagtgaggcctgtctggatatatgaccagagcaccgtggcctcctccagcatcactgagcaggggcaaagctacagcggagtgctgaaccttcaaatcaccttttaaactttcttttaatcaagatataaccggccgggcgcggtggctcatgcctgtaatcccagcactttggaaggccaaggtgggcagatcacctgaggtcgggagttcgagaccagcctggccaacatggagaaaccccgtctctactaaaaatacaaaattagccgggcatggtggcgcatgcctgtaatcccagctactagggaggctaaggcaggagaatcacttgaacctgggaggcagaggttgtggtgagctgagattgcgccactgcactccagcctgggcaacaagagtgaaactctgtctcaaaaaaaaaaaaaaaaaaaagagatataaccttttccattaaatgtaaatttaagtacagctggataacttttatattttgttttgcctatgtttgaatttcatataaacaaaaccatatagaatgtattccttaggctgggcacggtggctgggtgacagggtgagactccgcctcaaaaaaaaaaagaatgtattcttttttttttttttagacagagtcttgctctgtcacccaggctggagtgcagtggtgcaatctcggctcactgtaacctccacctcttgggttcaagcgattctcctgcctcagcctcctgagtacctgtgattacaggcacccgccaccatgcccagctaatttttgtatttttagtagacatgggttttcgtcatgttggccaggctggtcttgaactcctgacctcaggcgatctgcccgcctcggcctcccaaagtgctaggattacaggcgtgagccaccgtgcctggcccaagctttgtttttttaaatcttgcctcccactatgcagaaagcctcagtttcagataacagcacggagggattttgggaggaagaaaatttgaataacaacaatattgatgttggcaaggatgtggagaaaaggaaactctttttttttttttttgagacagagtctccctctgttgcccaggctggagtgcagtggcgcgaccttggctcactgcaatctctgcctcctgggttcaagtgattctcctgcctcagcctcctgagtagctgggattacaggcgcctgccaccatgccggctaatttttgtatttttagtagagatggggtttcaccatgttggccaggctggtcttgaactcctgacctcaagtgatccaccagcctcagattcccaaagtgcagggattacaggtgtaagccatcatgccaggccaaaaagggaactcttatacactattgggggattgtaaattagtacaacttctatggaagacaatacaagggtttctcaaagaactaaaaatagaactaacatgtgctccagcaatctcactattgagtgtctacccaaagcaatcattacatcgaaaaggtacctgcaccagtacatttaccacagcactattcacaagagcaaagacatggaatcaacctaagtgtccatcaacagatgattggataaagaaaatgtggtacatatacaccatggaatactattgggtcataaaaaagaatgaaatcatgtattttgcagtcacatggatggaactggaggacatacatggatggaactggaggacattcatggatggaactggaggacattaagtaaaacaaatcagacacagaaagacaaatactgcacattctcaattctaagagggagctaaataatatgtacacatggacgtagagtgtggaatggtagagaactgagactcagaagggtgagtgggggtgaatgggggtaggtgatcagagattactgaatggatacaatgtgtgttatttaggtgacagataccctaaaagtcctgacttcaccactacacaatctatgcatgtaacaaaattacactcacaccccataaagttatacacatgaaataaataaatagtgtaaaagacagtcctggagaaactcagaccagaccctgaggaccatgctacactgccaccacctggtggcaatatacctacagtgtagggcggtgcctcccaaaattcccaaattcccgacttctggagagcatcaaaaataaataaaacatgtactcacactactgaactgtacacttacaaacggttaagatcatacatgttatgttatgtgtttttaccacaattaaaacacagatgactaggcgtggtggctcacgcctgtaatcccagcactttaggaggccgaggcaggtgaatcaccagagatcagaggttcgaaaccagcctggccaacatggtgaaaccccgtttctactaaaaatacaaaattagccaggcgtggtggtgcatgcctgtaatcccagctacttgtgaggttgaggcaggagaattgcttgaacctcagaggcggaggttgcagtgagccaagattgcgccactgtactccagcctgggcaataagagtgaaactctgtcccaaacaaacaaacagactaactaacaaaaaacaaaccacataaataacagtgtaaaataaatgaaataaaagtataaaataggctgggcatggtggctcacgcctgtaatcccagcactttgaggggctgaggcaggtggatcacttgagcccaggagctcaagaccagcctgggcaacatgatgaaaccccgtctctacaacaacaacaacaacaacaaaacactgtaaaaccccatctctacgaaacaaacaaacaaaccaaaaccaaaaattaaccgggtcatggcggtgtgtacctgaagtcccagctacttgggaggctatggtgggacgatcacgtaagcccagggaggtcaaggctgcagtgagtcatgatcaagccactgcactccagcttgggcaacagaacaagactctgcctgaaacaaaacaaaaccaaacctaaaattcctctttggcatccttggtgtgtgtgtgtaactatatgcataatatatattattatctatatatgttatatattctataaaatcttatatatgtcacatactatacatacttctgctatctgactcaattctctcaaagccacccttcatccttttgcagtttccaaacatataaattatcagagttaaaatcatgttccatctgatttccactctgtgctcactccaggtgggctacaatacatgtgaccatccactctgtgtgtgctaacaacagtgtaaaactggaccctggcattaacctcttctatcatttcacactaatgtgagatccatgaggtccccatttgcaatcggagtccaggaaatcagctacaggagctggttgtaaatttcactccattgttgcctgtgtgctccccacaacagtttctgtaaacctacccagatgcaatgtaaaggaaccaactggtccacagttactttctgttacttacagcttcgtgacctccagcgaatcacctctcttttattgttgacaataaaagacagtgaatcacctgtcttttattgttgagttgtaagaattcttgtttttgtttttgtttttttgagacggagtcttgctctgtcaccgaggctggagtgcagtggcgccatcttgcctcactgcaagctccgcctcctgggttcacgccattctcctgcctcagcctcccgagtagctgggactacaggcacccgccaccacacccggctaattttttgtatttttagtagagacagggtttcaccgtgttagccaggatggtctcgatctcctaacttcgtgatccgcccgcctcggcctcccaaagtgctgggattacaggcgtgagccaccgcacccgggcgagttgtaagaattctttatatgttctggatactagacacttctcaaatatatgatttgcaaatattttctcccattctgtggattgtcttctcactttcttgatagtaatctttgatgcacaaaactttttaatacattatcttttaaaagaaagtaaatgtttattatgattaaagtgacacattttctttctttctttccttttcttttctttctttctttttttttttttttttttttttgagatggagtcttgctgtgtcacccaggccagagtgcaatggtgcaatcttggctcactgcaacctccacctcccaggttcaagcgattctccccagcctcagcctcctgagtagctgggattacaggcgactgccactgtgcccggctaatttttgtatttttagtagagacgagatttcaccatgttgacaagacttgtctcaaactcctgacctcgtgatttacccacctcggcctcccaaagtgctgggattacaggcatgaaccaccgcgcctggcctgacacattttcttacacccattagttaaaggagaaaatcattcccttgcggggttgggtacaattcagcagtcattcctaataaactctctaagtaaaatagaactagataaaaaaacaacaccctgactatgctatgcattcctttttttttgtttttgtttttttttttgagacagagtttcactctgttgcccaggctagagtgcagtggtatgatctcagctcactgcaacctccgcctcctgggctcaagcaattctcctgcctcagcctcccaagtagctgagactacaggcgcctgccaccataccctgctaatttttgtatttttagtagagacagggtttcgccatgtcggccaagctgctcttgaactcctgacctcaggtgatctgcccaccttggcctcccaaagtgctaggattacaggtgtgagccattctttttttttttttgagatggagttttcgctcttgctgcccaggctggagtccaatggtgcaatctcagctcactgcaacctccgcctcccagtttcaagcgattctcctgcctcagcctctcaagtagctgggattacaggcgcctgccaccacgcccggctaattttttgtattttttagcagaaacggggtttcaccatgttggccaggctggtcttgaactgctgacctcgtgatccactcgcctcaacctcccaaagtgcagattatgcattcttaacacaacccaataacacccatcacaccgaaggaggccatgctgaagccagtgccatcagcaacaggaagaaggcaaggatgcctactgtgattcaacaatgattccaaggtttggttcaatgcaccaagacaggaaaataaaatgattagtatcaatatttgagaagaagggaaaaatattttttattagaaaatgttattataatctaggaaatctgagactctcctaaaacattaatattattaagagaatttggtcaaagtgactggttgcaagaaatatgtccaaggctgggagttgtggctcacacctgtaatcccagcactttgggaggctgaggcgagtggattgtttgcggctagcagttccagatccatctgggcaacatggtgaaaccctgaatctacagaaaattcaaaagttagccgggcatagtggcgtacacctatagttccagctacctgggaggctgaggtggaaggcttgagtgactgtaatcacaccactgcactccagcctggtcaacagagtgagatcttgtctaaaaaaaaaaaaaaaatttacaatccaaaagccagtaactttcctttaactggcaatgacaaaacaaaaaacaatacgggagaaacattacattcataaaagcaacagaagatattgtgtcaataaattgaacaaaaacagggtctatatgggaaaaactataaaattggattgatagacaaagacaaaaagcctaaaaaaatgaagagatataccaggatcctgtttggaatgcttaaagtattcatttctcctaaatatataaaaatatttaagtccttcctatcagaatggagggggataggatatactgtataaaatgactttaaaagtttaaaatggtttcctaaaaactaggccaggcacagtgactcacacctgtaatcccagcactttgggaggccaaggcaagaggattgcttgagcccaggagttccagacaagcctgggcaacacagcaagaccttgtctctattaaaaaacaaaaatattagccaggtgtgcgtggtggtgtaatcccagcactctgggaggccgagactggtggatcacctgaggtcaggagcttgagaccagcctggccaacatggtgaaaccccatccctactaaaaatacaaaactagctgggtgtggtgatgggcgcttgcattcccagctactcgggaggctgaggcatgagaatcgcttcaatctgggaggcggaggttgcagtgagccgagatcgctccactgcactccagcctgggcaacagaatgagacactgtctcaaaaacaaaaacaaaaacaaaaacaaaaacaaaaaaacagccaggtgtggtggtgcgtgcctgtagtccccgctacttaggagactgaggtggggggatggcttgaacccaggagattgaggctgcagggagcttgatcacaccactgcattccagcctgggcaacaaagtaagatcctgtccccccccaaaaaaaatagtaaaatgcttcaacagttttgggaagttactgtaaagctacctggggcaaacactactaagtgcttacctagtattaactcctttcttagtaacaaaatttgtatattgatggggtagcaatgtgtttcctcaataatattacaatataacttttaaacctataaggaggctttcccagcctcctttaaaggtatggctatgtggctaaagtataagcaaaagtggttgggaaggacttctagaaagactcctcttcaaaaatgtatagacaacggtttgcaaaagtcatttttttgtttcttttttcccttttcatttcatttctcttttcactctcttttcttgctttatgtttttaaaattttatttgccctttcttcttcctactttctgctacctggaatggaatgtgaatctgatggctggaattccagaagccatcttggacaatgaggtgactgtaaggatggagattaattcgaggacagtggagtggaacgatggaggcctgatgaacgtgaagccaccattttagccctgggctacctatctctgaaattattttatctgacgagagaaataaacttctattttgtctcagctactattgttttaggacttggctatgtcacagatctaaaacccacttgatttactcctgcaatcaaaatatattgacacagaaaagacaacaaataaatcagtggaataaaacagaaaatccagaaacagattcaagtgtttatggggacttgatacatgaaagatcacaattcaagtcagttgaagaatgttttatttactaagtataactgctgacatgctggctgtttgtcaggaataaaacaaagctaaatccttcctcacatcacaaataagattaattctaggtggattagcgaactaaaggcaaaacgtaagtaaaattaataaaacaaaaattggaagaatatttgcataagcttaggtcgaggagaccttattaaacaaagcaggaaacctaaaacccatacaggaaaagaattgcacagtgttgtgtggtagaaaaaaaaacccacaaagttaaaagacaggttgggaaaaatatgtatgtaacacatttgatatccattggttattgctgatggtgggaaactgcaaacattttccgtaaagagccagagagtaaatatttgaggcttaagggtgtgaaccccaaaagaggttcatgatggatccggagtggctaactaggcctaaattcaaaatacagccaagcagccattggctgactagaggtcacacatacttcggtttttgtttgcttttttttttttttaggcggagtctcgctctgttgcccagactgtagtgcagtggcacaatctcgacttactgcaagctccgcctcccgggttcacgccgttctcctgcctcagcctcccaagtagctgggactacaggtgctcgccaccacgctaggctttcttttttttttcttttttttttttttagtagagacggggtttcaccgtgttagccaggatggtctcgatctcctgacctcgtgatcctcccgcctcgacctcccaaagtgctgggattacaggcgtgagccaccgcacccggcctttgtttgctttttgagacacgatcttgctctgtcgcccaggctggagtgcagtgaggcgatcatgactcacttcagcctcgacctcccgaactcaagcgctcctccagcctcagcccccagagtggctgagatcacaagaacccgccaccaccgcccgctaattttttgtagagaaggggtttcgccacgttgcccaggccgatcttgaactcctgggctcaagttaagggaggagaccacccctcatattgtcttacgcccaatttctgcctccaaagaaagaaaaagtaaaactaaaaggcagaaatgaaatccacaagcagacagcccggcctcacaccctaggcttggtaaagatggacccctgacctaatcagttatgttatctatagattacagacactgtatagaaaagcactgtgaaaatccctatcctgttttgttctgatctaattactggtgcatgcagcccccagtcacgtaccccctgcttgttcaattgatcacgaccctctcaggcgcacccccttagagttgtgagcccttaaaagggacaggaattgctcattcggggagctcggctggtgagacaggagtcttgccgatgaccccagccgaataaaccccttccttctttaactcgggtgtctgaggagttttgtctgtggctcgtcctgctacaaagtgatccgcctgcctcggcctcccaaatgctgggattacaggcgtgagtgaccgcacctggcctgggatggacattttaaaggttcctgatacatattgctaaattgttttctcgaaacgctctataccatcccaccagcattgtatgacgcctacggttgagatttttggctcaaagaattacggtgtatttcaaggggagaaccctcttctcatcttacccctaaactctatccttgagtgacctaccttcactcccaagcctccagtcacccactgggaatctctacctggaaatcccagaggcactcaaacttaacgtgtccaaaactaaattatccgtcaccttcccacctcatatccccccaaatgccccagattcagaaaacatacccatcactgtggctggcaccacggtgataagcacgataataaccatggcaaccagattccctactgaagccattcttttaggatgaaccaagggcacaacaggcagagatgacaaggggaatggagaagggggtacagtaagttttagatagtcgaaggcacgcgcacgacaacgcctgcgcaccacggaacagggcaaaagggtgacaaacatgcgccactgagttttatcgagcagccgatgcccagaaaacaggcatccgcacacagactcagtttccttgtaggcaactcccgggcgttgcgagtcacaaccggcattctcgcgccgtgagagagaactgcgcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaatgtgagtcccgcacccctcccgccctgcagccgtgctccacgctctcgcccgagttcctcggcgcctagaaccgaaagtggagcgcttccaatttccacttcccctggagcagagttctcggtggctgtgagatgaagaatcaaacttgagttttgagatttaggatgtggggactttgaaatgcccaccgggtaccgcttggatgccaaatcaaaaataggaatatgcagcacgattttaaaccaactcgaagttcccgaaaggcggaattgggatgtgctagatagagactaggcactggtggcacctgagtttggaaattgttgaagccccggtaacaaagcaacagatgtgggggttttgaaatgtagctttttattcttggctcctccctttccagcctacaccttaaacctctgctgatccatcagttattttatcatagctgttggtggtctgtgcaaatatgaatcccttgaggtaggttcctaaaattgaatttgagctgtggaaggagctttagggagctttacagatggagaaacagacaaggaaagctaattgcctgagctgtctgtgaagccaggtgtcctgccttggagtcccgtgctgcatcatacgggtccatcgtgttggtcaagctgtagagcagtgtaaggagtcatttgaagcaaagcctgggagatgtggaagttctagaatcggtatgaatgtgcacctgccttaaccactcaacactttgaacttcttatatacaaaaagataacgaaacgttaatttatggtgagaaattcctttcagaaaccagaatacttcaagtcttcatgcccagtgccttctctctctctctttttttttttttttttttttgacagtcttgttttatcacccaggctggagtgcagtggtgcaatctcggctcacttcagcctccgcctcccaggttcaagcgattctcctgcctcagcctcccaagtagctgggattacaggcgcccgccaccaggcccgactaatttttttttgtacttttagtagagaaggggtttcaccatgtaggccagactgctctcgaactcctgacctcaagtgatccacccaccttggccttccaaagtgctgggattacaggcataagccagcaggctcggtccttctctttttaaaagaagactagccaggtgtggtggctcacgcctgtaatcccagcattttgggaggccaaggcaggtggataatctgaagtcgagaatttgagaccagcctgaccaacatggagaaaccctgtctctactaaaaatacaaaattagtcgggcgtggtggcgcatgcctgtaatcccagctactcaggaggctgaggcggaagaatcgcttgaacatgagaggcagaggttgtggtgagccgagatcacaccattgcactctagcctgggcaacaggagcgagactctgtctcaaaaaaaaaaaaaagacttaagtggaaaacctgatcatagtcagaaatgtatgtggtaagcatgaaatcagcatgagagaaattagttatgtgaaccagatttgtaaaggcttcaggccaagatgccagttgctttcatctcatggcaatggctttggaattgtggactttggatcatcagtaacttcagtggcaccttaatgtttcctgacagtcaaccgtatttccctgttttttttgttgttgtttgttttgttttttgagatggagtttctcattgcccaggctggagtgcaatggtgcaatcttggctcactgcaacctctgcctcccgagttcaagcggttctcctgcctcagcctcccgagtagctgggattacaggctcccgccaccacgcccggctaattttttgtatttttagtagagatggggtttcgccatgttgggcaggctgatctcgaacccctgacctccagtgatcctcccacctcggcctcccaaagtgctgggattataggtgtgagccaccacacctgttctactttttgtattttcagtagagacaaggtttcaccatgttggccaggctggtcttcaactcctgacctcaggtgatccgcccaccctggcctcccaaagtgctgggattacactgcgccaggcccctggtctctttactctgagtcttccagatgattgttttccaccttctcctgtaacatccttctgtcccaccctcactctcagctgacaaatttctattatttgctgaaaaatgtagaagcattagaaaacttcgatcagctaccaccattatgtctcactgacccatatctgtggcatatacctagccttctttcctattataatgaataagctttccgtattcctagcaaaatccaagtcctccacttgagtcctaaaccccattccttctgaagcaattaaggacatcactggtaattctcctgtcttacatattttctattttccttgctacaagatttttttcctactagtatagaaatgtgcttccaatcttgcctttaaaatactctgttgaccctacttcccactccagttctctccttcccaattacagcagacctcaaaagggtcggccgggtgcggtggctcacgcctgtaatccgagcactttgggaggcggaggagggcggatcacaaggtcaagagatggagaccatcctggccaacgtggtgaaacccggtctctacttaaaatacaaaaattagctgggcatggtggcgcatgcctgtagtcccagctacttgggaggctgagacaggagaatcgcttgaatcggggaggtggaggttgcaatgagccgagatcgtgccactgcattccagcctggcaacagagtgcaactctgtctccaaaaaaaaaagggggggggccttgccatctttaaatatttcctccttaaatccatttcagtaagttcttttgttgccaccacttcaccaaagctgctctactcaaggtcaccagtgaccttcaccatgctaaaaccagtgatgaattttcagtcctcatcttgaattgaattagcaccggcacttgacactgtttgtcattttttctttttttaaacacatttttcttttagcttcttagacactactagtttttctttcttttttttctgagacagggtcttgctctgttgcccaggctggagtataatgggcaaatcacagctcactgcagcctcaacctccttggctcaagcaatccttccacctcagcccccaagtagctgtaactacaggcacatgccaccaagcccacctaattgttgtattttttatagaaacggtttcaccctgttgcccaagctggtctcaaacttctgggttcaaacagtctgcccacctcaacctcacaaaatactggattacaggcgtgagccactgcatccggcttactcctagtttttcttcagctttgcttgtgtcaccgcttctcaggctttgccgattcatcctcagaggccctaaggcgccccaagactcaagcctgggatcttttctcccttctagatacgctcactcccttggcgatctcacctggggtctcatagctttatatcccatgtatttactgatggttcccaaatttatacctccgcccacaacccttgcctgaactacaggctggtttgttcagcctgctgtctccagttggatgtctaaatggcacctcaaactctgcatgtctaaaactaagctcctggtatctcctctctctcctcagagtagttcctctggctcttttccccatctcagttaatagggacgccactcttcctgttgcacaggctaaaaatatcagcatcatccttgactttctttttctcataccttacattcagttagcagatcccactggcttcacttccagcatgtaaagtcctatccagagtccagccacttctcgccatctccactgccaccaccttgatccaagccaccatcatctctcacctgggcttttccatgattctttaattggtccccctgattctgcccttatcctcttttgtctcccctcagtggtgagctttgtaaggacaaggatgcttctgttttctcattgcccaaaacagtgcctggcactaatagattctgaataaacattgatggagtaaaccaggattatttttgcttttctaggtgaaacttcgagaaatgaactaagtttttacttgtccaattttcctttctacagtggtagagctttgtgttcagtatggacagaatgaggagggaatggtaggcgagcttatagccttctgcaccagcacacataaagttggccttacctcagagatcctgaactcttttgagcatgaggtaagaacaaaatgaaagcaaactaataatgtgattctccatttctgctctacaggggaggcattgtgatatattgagaggagtgtgggctttcgagtcaggcctggattccagtcccagtgtgagcttggacaaactatgtccctgagcctcagtttccttttctgacattgggtctaataatctgtattttttatgattgttataagaattaaatggggctgggcgccgtggctcatgcccataatcccagaactttgggaggccgaggcaggcagatcacaaggtcaggagttcaagaccagcctggccaacgtggtgaaaccctgtctctactaaaaatacaaaaattagttgggcatggtggcaggcgcctgtaatcccaggtactcggaaagctgaggaaggagaatcgcttgaaccgaggaggtggaggttgcagtgagctgagattgcgccactgcactccagcctgggacagagcgagactccatctcaaaaaaaaaagaaatgagaatggacataaagcacttaaaactatgcccagcaggtgataagtcttcaccaaataattggtattattaggattgttatatgttatagacagtcatgggatgtctttgtttttagtctgtgtgtatcttaattctttgaggaatgttagatctttgattatattttgaataccttttattatctcaaggcttttgaaaacacctctgctattacttgactatgaagtactgtattcactatcttttctttttcagtttctgagcaaaagattatcgaaagccaggcatagtacctgcaaggacagtggccatgcaggagctagagacattgtttccattcaagagctgtatccttttctgctgaaggtctttgcaccaagctacatgttgtattttataatttgtctgtagtcgcatgtgtaatttaaaaacaaataataaggccgggcacggtggctcaggcctgtaatcccagcacttttggaggccgaggcaagcagatcacttgagcccaggaatttgtgaccaacctgggcaacatggtgaaaccctgtctctatcaaaagtacaaatttttttttttttttgagttggagtttcgctctttttgcccaggctgaagtgcaatggtgcaatctcagctcactgcaacctctgcctcccaatctcaagtgattctcctgcctcagcctcctgagtagctgggattacaggtgcacaccaccacacctggataattttgtattttttttggtagagacagggtttcaccatgttggccagctggtctcgaactcctgacctcaggtgatccgcctgcctaggcctcccaaagtcctgggattacaggcgtgagtcaccgtgcccggccaaagtacaaattaaaaaataataataataagctgggtgtggtgatgtacgcctgtagatccagctagttggtaggctgaggtgagaaaatctcttgaacctgggatgtggaagttgcagtaatctgagatcaggccactgcactccatcctggacgacgaggaaaccccatctcaataataataatagtaaaaattgcctaatattgagatttcttctagcaatcagcccttgccttatatgaaagtttattattattattattattttttttttttgagatggagtctcgctgtgtcgcccatgctggagtgcagtggtgtgatctcagctcactgcaagctccgtctcctgggttcatgccattctcctgcctcagcctcccgagtagctgggactacaggcgcccggctaattttttgtattttttttagtagagacggggtttcactgtgttagccaggatggtctctgtctcctgatctcgtgatccgcccatctcggcctcccaaagtgctgggattacaggcatgagctaccgtgcccagccattattgtttttcttaaccagtgttcttagaattgaagtggaagaagaagaggaaatcctcttgaactcttacaccacaccttcaaaggtaagtaaacagtgtttggacattgcattttacaagtaacattttaaaatagtttcacaacatttgaagatctgagggaaaaaatcaaccactctcatgcatttcctactatatttccacttatacatcttcctttctgatcatatgtctaaatgttttacataatggcagtccttataaacatatagttatcctgcttttctcagcacaacataaaacatttctataaacataatttctccataattgccctttttgaatagtttcatagttttatactataattgaataattcagttctgtgttggatcccagtgtgaaaggtcaagtagggtagtggaaaagcattgccttcaaagtctgagtcagaagacctaggtgacctggagtgagttgttttatctctctgagacagtttccttatccataatatcaggattcattcattcagttatccagcaacaactatgtggccaggcgcagtggctcatgcctgtaatcccagcactttgggaggctgaggcaggcggatcacgaggtcaggagatcgagaccatcctggttaacatggtgaaactctgtctctaccataaatacaaaaaaagaaattagccgggcgtggtggtgggcgcctgtagtcccagctacttgggaggctgaggcaggagaatggcgggaacctgggaggcagagcttgcagtgagccgagatcgcgctactgcactccagcctgggcgacagagcgagactccgtctcaaaaaaaaaaaaaaaaacaacaacaacaactatgtactgcactagacattgagtaaacaatggtgaatgaaacagacatggatgggctctgccctcaagaagctgacagccagtgcacaatatcccccatcttggagggcttgaagaggaaataaataggtaaagtatcaggccctatgcaatgtattcagtaatggtaactattctttatactaactaaataagtttgtagacattcataaacatggagtgagccttaattattcaaagtaaactacatcataagaaagaggtaatttacattgccctatgcaatgtattcagtaatagtaattattcttttttgttgttgttgttgttgttttgagatggagttttcctcttgttgcccaggctggagtgcaatggcacgatctcgggtcactgcaacctccgcctcccgggttcaagcaattctgcctcagcctcctgagtagctgggattacaggcatgcgccactacggccagctaatttttgtatttttagtagagacggggtttcaccatgtcagccaggctggtctcgtactcctcacctgcggtgatccacctgcctcggcctccaaagtgctgggattacagatgtgagccaccgtgcccagcccagtaattattctttatactaactaaataaatttgtagaaattcataaacatggagggagccttaattattcaaagtaaattacatcataagaaagaaggtaagggctgggtgcagtggctcatgcctgtaatcccagcactccgggagaccaaggcaggaggatcagtgaccagagatcatgccgctgctctacagcctggatgacaaagtgagaccctgtctcaggaagaaagaaggtaaatagtttagatatgcctgtggagagtaagagggccaaaaatgtgccccatgaagttgctaacacaaaaccaggtgcatataatattaaaagaaataattaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaaggtcaggttttcttgctcacatctctcccactggcttttcgtctttcctcctgatatgcaaagtttgaaccagcatatgtgaagttctgtaggagctggccccctcctccttctgtcctctttccctgctcccctttgctctctgcttctgccgtgccaaatatgggttcatttcctatgtctccttgtcagggaacaagcctgcctaaaagaacaaagcccttcttctgttttattttcttgctttatttttctccttattattctcttgctttattaccaccaaacatgttatatacttacttttttgttttagtcggccttccctccattagatggaagctccttgagaatagagactttgtttttacttgctgctgttttcccagcaccctggcatgttaatagttgttgaaagatctctgaataagggagtgtggttggctctctcaattgcaataccaatgggaccaccacggttttatctggttaacagcttcacagatccagaattttatgtaatttgtctgtgtatccagaattgatcatattccggagtctgactcatggtaacccagctgtcagtagactgatgcgtaagccaggtgcaaatttgtttactttactattgaagtagatacccttccaatgactgaaatcccatatttaggataccccattcctgctatggaaatacttaggagactaaattgtgaatcaaagtttgtgactgtgaggccgagtgcagtggctcacacctgtaatcccagcacttcgggaggctgaggcaggtggatcacttgaggtcaggagttcgagaccagcgaaactccatctctactcaaaaaattagctgggcatggtggtggtgcctataatcccagccactcaggaggctgaggcaggagaatcgcttgaacccgggaggtggaagttgcagtgagccaagattacaccactgccctccaggctggatgacagaaccagactccgtctgaaaaaaaaaaaaaaaaaaaagtttgtgactgtgaattccacgctaaatgagttggagtgaaatgttgagcaaacaatatgtccaggctagagatacgtaaaatgcttagaacagtacttatcacatggaaattgttcagtcactgttaggccatgcatcaatggcagcatgataaaatagtcaaagtgtggccaggcatggtggctcacacctgtaatcccagcactttgggaggccgaggtgggaggatcactggaggtcaggggttcgagaccagtctggccaccatggtgaaaccccatcgctacaaaagtacaaaaattagctaggcatgatggtgggtgtctgtaatcccagctactcgagaggctgagacagaagaaacacttgaacccaggaggcggaggttgcagtgagctgagatcatgccattgcacttcagcctgggcgagaaagtgagactccatctcaaaaaaaaagaaaagtgtgaatgttggcctttccatacaaacagtgccaggctgaggttgcctgacccttgtcaggtcttgggaacaggtgtccctctgctatagaggtaaatatgatatgtcagtgattttagcttatcactattaaatatttcacctgtacgattgacagctgttcttttgcttccgtgttcaccataaatctgctgatgatttggctgccatgtccctaacggagagaatgtgttagcctgaggacttgacgttcccatacccttggcaattatatttctagtaaattaataaactggcatccttggttataatttgattttctctgtgagtgtgagaatgtgcttaccctaggatatgaaaatatggtaccattggtgactacatttctgattaaaaatgatgaaaccggccactgcggtggctcacgcctgtaatcccagcactttgggaggctgagatgggtggatcacctgaggtcaggagttcaagaccagcctggccaacatggtgaaaccctgtctctactaaaaatacaaaaatattagccgggcgtggcagcgggcgcctgtaatcccagctactcgggaggctgaggcaggagaattgcttgaacagaggcggaggttgcagtgagctgagatcgtgccactgcactccagcctgggcaatcagagcaaaactccatctcaaaaaaaaaaaagaaaagatgaaactagccaggcgcagtggcttatgcctgtaatcctagcactttgggaggccaaggtggatggatcacctgaggtcaggagttcgagaccagcctggccaaaatggcaaaaccccatctctactaaaaatacaaaaattatcccggcatggtggcacatgcctgtaatcccagctactcaggaggctgaggcaggagaattgcctgaacccaggaggcggaggttacagtgagctgagatcatgccactgcacactccaccctgggcaaccctccgtctcaaaaaacaaaaacaacaacaacaaaaaaacatgatgaaattggcattaagtgttaataatgaatcgtatgagcttggttaaagggagcgcatccttgagaactggtactggagttggtgaacactattggatttcagccctgaggctgaggactagaacaccagactgtgccttgtttaccaaagtgctgtcaccttgccacgtcttgcgagacagactgtcattctctcaaaatatccctgccccacaacactggccgtggagtgttgtagcccactgtatattaggagaatcttttggagggatagtttgagaaaatgtgttaaaattataaaatcttttttttttaattataaaaaaaataaaggcagggtgtcactatgttgctcaggctggtcttgaactcctgagctcaagtgatcctcctgcctcagcctcctaaaatgctaggattacaggcacgagccaccatccctggccaaattcataaaatctttttctatcatttgacccagtaattctccctagggggaaaaaaaaaactcttctgaagaaataattcaaattatgggaaaagctgtatgcatgaagatacgcattttagcatttttttaatttaaaatcttaatttgccaaatcacttttcacctgagactcagcattacttgtaatcactgaaaattacaagcaacccataatccagcaatagagaagtaattatgtaaatcattgtaggtcagtttaattaaataacacagctactaaaaaggataaagacctgtaatcccagcactttgggaggccgaggcaggtggatcacctgagatcaggagttcgagaccagcctgaccaacatggcgaaactcacatctctactagaaatacaaaattagctgggcgtggtggtgcatgcctgtagtcccagctactcaagaggctgaggccagagaatcacttgaacacgggaggtggagttgcagtgagctgaggttgcagtgagccgagatcgcacatcgcactccagcctgggcaacaagagcgaagtgaaattccgtctcggaaaaaaaaaaagggaaaaagattgggtcaggtgcagtagctcatgggtgtaattccagcattttgggaggccgaggcaggtggatcaattgaggtcaggagtttgagaccagcctggccaacatgacaaaaccccatctctactaaagatacaaaaattagctggatgtggtggcgggcacctgtagtcccagctactctagaggctgaggcagcagcatcgcttgaacccaggaggcagaggttgtagtgagccgagatcttgccactgtgccccagcgtgggtgacagtgactccatctcaaaaaaaaaaaaaagattaaaaatgtaacagtgtgggaaaatgttgataattaatatagagtgaaaaaattcagcacataaaatacttaggtttatatttaaactaagattatgactataatttgtatattctaatttgtgtatttgtaatcttaatatacaaattataaggcaccacgcctggcttttctttttcctcctcagacatgaggtctcgccgttgcccaggctggtcttgaactcctgggctcaggtgatcctcccaccttgacctcccagagtgctgggattacaggcatgagccaccacccctggcctagaaaaatattaaaataccattaaggaatattcaaaactggttattatatcagggtagtagaataagggattttttttttaatctattttccattgcagctggttttgatggttttgaatctgttctctggcattctgtcctgcagttgccaccagctgaccactctgcaatataacttcttaaacttgcagccaggaggagccctagggcagggaaagctgcagactagctggcttcctggctgctatccaggcaaggattttgttttctctattacagtcgattatcctagactttagggagcaataggtctctggactgtaggtttcagcctccgttctgggcttatctttggattcttgttgatgagtcaaaaaaaaaaaaaaaaaaaaggagtgaccatcagatgtttgctaactcttcaagtatgagctcaaccttgttatctgcctggagtcatttcctttgaaaatgtatggtagactttgccaaagtaagtagtaatgtcccattccttctcaggaaaatgtgtacacatagatcaaaactatgcattgtaaaactcatatctgtttgaaaacatagaggtagggacagaaagtaaacatatgaaggatttgacaggacacattaccagcctggtggtcctttttggaaaatgtttgctttctcgtaattgccttcaaaatagggacagtgtcctgaatgttggttacagttgttgaagatttctttttgagattatgcttggatgatggggccttaagaagagaacccacccagtcctattttgtgccttcgtttggacatgttctcccttttcttccaaggtactatacacttaattagtattgggtctagtaggactgagattttgttttccttttttttccctagggttctcagaagcgagctatctctaccccagaaacccccctaacaaaaaggagtgtgtcaactcgtagcccccatcagctactctcaccgtcaagtttctctccaaggtatggatcataattcattcaagtgccataaagctggcctcccctcccctttctctggctatctgaggaaggctaacagcagagttattaattaactataggtgggcatgtacctctgcagtgaattggcttgaaagcctattgctctctgccttccttgctctccttttctttgtggaaaattactgtttcttacggtaattaaggaaactcactttccacccacttttctagggctcatttcctagatcgggaactgatatcttgtattgaaaacaacctgtctattcagaagtctaagagtcttaacaggtcttgtcagtagaggcaagtaggtttccacctgcttctgtttgtgttttgttgggtttctttttctttcttttcatctaaagtttttttttttaaagaaaagcacatatctttgttcataatgtttcataacctgtttattgtttccaagtcaggttagaactagtttctgagagttttcttgtcactgtgactctgccctgacttaattggtattttgtccctctgccaccattgcacataaatccacaaagatcatatgtaattttttgaaatccataaatgacacgtctcatattagagaattccataggcaagtgctctgctgagtagatgggtttttaggagtttccacatcaagatgaggctccggagcagtagtattaacccttcagggaaacaccaactgccaggagtcattacctctactttggatcacttctagatgaaccagagcttaagattgttcaactctatcactttttttttttttttttttgagatggactctcactctgtcacccaggctggagtgcagtggcaccatcttggcttactgaagcctctgcctcccggttcaagcgattctcctgcctcagcttcccgagtagctgggtctacaggcgctcgccaccatgcctggctaatttttgtatttttagtagagacgaggtttcgcctgttggccaggctgatcttgcactcctgacctcaggtgatccacccgccttggcctcccaaagtgtaggatgtcaagcatgtgccactgctctcggccttttcagctctatcactttagaaaggtggtgatagaagctctgcagtcattcaaggtgagtggtcattggattttttttttcttttctttcttttttttttttttttaagataggcttttactctgttgcccaggctggagtgcagtggcacaactatagctcactgtagccttggccttccaggctcaggtgatcctcctacctcagcctcctgagtagctgggactacaggtgtatgctaccaagcccagctaatttttataatttttgtagagatggggttttaccatgttgctcaagctggtctcgaactcctggcctcaagcaatctgcctgccttagcctcccaaagtactgggattacaggcatgagccagcatgcctggcagtaattggattttgaaggacagttttactttagggtagtctactgctgctttggggagttctcaggctttttggaagaaagctttctagacttaagagcatctttgcaacctggtatgtagggatggttcttatagacgtgccagcaccattgcaggagttatattctccaaatgtcaatacaatgctctgaaacctgtagatctgtttacaactgtcctcatgtgagcatcttgctgcattaaagggcctgctgtaatggatggctcatggagcttcccagggaagagcttggagaagctggcaaaatgctgcctagtcattttttaatgcacactaataaagctgacagcagaaactggttttgtaatgtatgaaagtaacttctaaactattcacgtagaggtggcactggagattgagataattaattgagctcattttctgtaggctgtgaaaagaaagaatgatggcattaattgcgatggtgccccacataaaactggttcccgcagagtttcagtgcattaaacaaagcctgttttaaatagacctctctgtacggcgtgtttacaaccagaggattagaagacctcactgtcatctaagcagatcagcaatatccatgtgttcttagaggtataatttaccagtcagggagtggaaatgtgagaacttggcagttgagcctagaaaaatgggaatgtttgcacatcaccagactgttaattcattacttacccacctccatagacactggggaaaattgattaatttgaatttcattttattgttgtttctaccttgaaccatattgtgagtttttatatatgctcagcaagttttagcttatccacagttgcaggctcagatgatgttccaataaatgctaaaaattcatgagaagaaaaaaatgggacttaaagtttgccttttaatcaattcagaatctggggatctttttgccttgcttagttttaatgccaagagaacgacaactttttaaaatacgtttctgtctctaaacttctctaaaaatgtttggtattcctcagcctggtattcctcagcccttcattcctgaaattccttaaaggtctgggtatgtccaaccccattaaactgattcaatttataaactatgaggccaccttccttttctccagtccccatttccaaaggtaacctcattttattcttctctccctttagatatgaacacagtaatattaacctgttttgcttccaattagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaaggtgattgtttttccctttgaaattctggtggatataaaaccacctagaagggtgtagagtaacaaagcttcagctaggctggtagaacaagttccaaggttgcctttcaatgtatgagttggtagatgtcctcatggaagccctagtaatggagggacacgggcaatactatcagtgattgccccaagtcacttcactttgctaaaacgcacataaccattcccagcagcaaaaacttgaacgatgtaaaggaattcaacttaaagatattcatggttccttcgttagaagccttcttcaggttggccttgacttgcctaaaacctcagtgaggacttgagtaaagggcagacttggagatggggtggggttcatgctgattccctggaattgtgctatggggtctcctgtggccagatggaaggccagattcagcaaccaaatatcggaaaattggcaaaggttttagaaggtttaaactggccagatgtccaggcacccttcctgcttctgtaaaatgactgactttaatattttacaatgtgctgtattttctcttcttggcaagtgaaatgtcttaaacataatacttttttccacttctgggattgtagttctgacctgtaagatagaagaacttggcagcgaactcaaggaacattacaagattgaagctttcactcctttgctagccccagcacaggtaagagttgttctaatagttctcactaattaatattacgtttttaaatcgatgaccaagaggcatccttcttgcttcctttttcacttcttgtctgtgttctagtttgaacatctgtcttggttgaatttgggaaaatgggcccttctgaagaaagatttgtaagtgctgtctggttttgtggccagagagtgattttcttcccacttggattagagtcttgcacataagcagagactcaaggccttgtttcccttggtggtgagtcaggtagctccccggggatttcccacaaatagaagcattcacgtatcgagataaaaggacagcagcgacggtggggttttcagaatcttgttctctggacaatgactcacagtctctcccctggtttggtctcttgttatagacaaactgctgccaatagtatctttatatcatagtttaatctggcatatataccagtgctttctctctagaatgttttctaatctaaggggaaatatattctagaagtttctttaaagtacctttgtcaatgtttacattcaaagaatgatcagttggggaagtgatgcagaactgtgtcatagaaggaagtgttagaggacttggaaggaagtaattgagggaaggcagggaggcacaatcactgggaaagatgagacttcctctgttttctcccaagagtgggaacagaacagaggaagccatggagacagagattttagctcaattaataaagaacttcctgttaagaggttgtatggtatgtggctaaggatatggctctagagccaaatttctggtttcaaacccaagcttcacccacagtttgaccttgactaaattatctaacctttctgttgcttgttttcctcatctgtaaaatggatacagtaatatccacccgatggttgttgcaaggattaaatgagttaatacatataaaatgcctaagaatacattttagaacagtgcatggtatttagtaagctcaagaaatgttagctattattaagtagttatagctgcccaaagatgcagtgggctgccctggggtggtgaggacagggtggggtaggcatccaggggcaagttcccctacactagagatgctcacacttaggcagcctcctaggaaggctcaagtgctgggtggatgggtggacaagatgccctttcagagttcttccatcctgagagtcagtgatgacgcggtagtcacctcagggtcaaagcaatgccctgccaagaaatgtatttgttgtttgcagtttgttttgctattcaccctatcgacttcagattttgagctcctgctccaaagactgtcattcttatgctgtgaccttcctttggtaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggtgagattggaggagttccaccagaatgcaggcgcactctttacccctgtagtgtaggtgctgtgccatgcgcagctgctcctcagttcctgtctctgctgccatggggtgcagctggagcacatgccccagagcagacaccactgttgggattcctgtttcccccatgctctgacccaggctctgggacctgactgcgcagcctcaaatcccaactccccgctccatgaggtgcatgactgtgcacaaggtacttaaccatctaaactacagtttcttcactcacaaaatggaaataataattcttacctcataggattgttgtgaaaattagatcacttatatagagcataattattattactaatgcaacgcccttaattcgttttctacaaaaatgccctaagtttatgattacagaatgagagtagttggacaatgcttttaactgcctcaaaataatgtattccagacctcattgatctccactgcttagcaatcctgtttgtttttgtctttcaggttgtaattatggaaggaatcaacaccactggtaggaaacttgttgccaccaaactctacgaggtacacagcagtacccccacttgcctcttggtttgcttcagacaaagtatgtctggaagctgtctgttctagaaactggtcctttttaggagcccatttatttgttagtcagttctccatctgtaagtgggaacccacccctaggccaggggtcagcaaaccctttctataaagggccagacagtaactcttttagactttgtagctatatggtctctgtcacaatgactcaattctgcctttgtctacaaaagcagccatagaggactcttaaacagatgactgtggctgtgttcccataaaactttatttaaatagtgggctgcagccaaatttggcccagaggccgaaaggttacctatccctgctctaggcaacaatcctccagagattttcgtagaatgccaggaaaagtagcaagaaaccattctctcccatccttgcctagaagtacactgatactttaggcacctgttttgctcccacttgttgctgggtattttatgacaattgagtagtgacctcccattacctgggtttctttgccctctgagcagtatagaaaaatggcaggtcccatcagatccagggagcaagacagaggcacatccttcccctgccctctcgctcctccccactgtcctcccatcacacacctgcaccacccccaacctggtgccctcccctttccttaccaaggtgatgcctggcgcaagaccttacttgagcttttcccctgtttttagggtgtgccacttccattttatcagcccactgaagaggatgcaggtgagtttcggttcaaatattgttttgccaacaatgaggatggtagacatgagtccaggagtgcagtttcccaagcccaagaaagctgcagaagctgctgaagagcaatgtgaccaagcagtgagggcgccaccatcatgagttcgtaggttttttgtcacaagacccctggtctgagcccagtgagcgttggtcgtgctgtcgcctgagttctgcctacatgaagcatgttgtttaaagactaatgtttaacaggtatttttgaaggttgccttggaaaggaaaagatgtacgatttcaaaaagaatttatttacatgcagcatgggcagatgcggtggctcacacctgtattcccaacactttgggaggccaaggtgggaggatcacctgaggccaggagttggaaactagcctgggcaacatagggagaccctgtctctactaaaaattaaaaaaaatattagctgggcttgtggtgcatgcctgtagtcctagctaatcagaggctgagacaggaggattgcctaagcccaggagttcaaggttgcagtgagctatggtaacaccattttactccagcctgtgtgacagagcgagactctgactcttaaaaaaaattaaaattaattaattttttgaaagtataatgtggcatcctggattggatccttgaagagaacgggaacatcagtggaacaactagcaacatctgaataaagccaggaatttacttttttatttttctggctctaacactcaacctcgagaatccaggaatttagttaacagcgatataccagcattaatgccttaattttgacaaatgttcatggttacctaacatgttaagattaggggccactggtgaaagacacacaggaactctgtactatcttcataacttctctacaattctaaatttgttctaaagtgaaaacttaaaaataacttcctttttttttttgagatggagtctcgctctgccccccaggctggagtgcagtggcaagatcttggctcactgcaagctccgcctcccgggttcaggtgattctcctgcctcagcctcctaagtagctgggattacaggcgtacaccacacccggctaatttttgtatttttacaaaaccccatagtgatggggtttcaccatgttggtcaggctggtcttgaactcctgaccttgtgatccgcctgccttggcctctcaaagtgctgggattgcaggcatgagccaccatgcccggccaaaaagaatttctttaaaaccctagtgttatgtggtaactaatctagttgtggaaaggcaaaaagaaagtttgacaaactttgcttctaaatatttcaacataatttcagcacttcacagggctgaggtgggaagatcacttgagcccaggagtttgagaccagcctgggcaatatggcgaaaacctgtctctacaaaaaaaaaaaaaaaattagctcggcatggtggcatgtgcctgtggtcccagctgctcaggaggctgaggtgcggggatcacttgagcctgggaagtcaaggctacagtaagccgtgatcatgccactgcacttcagcatgggtgaaagagtaagacactagatagatagatagatagatagatagatagatagatagatagatagaatttatttatttcaaggtggccaggtgtgatggctgacttctgtaacccagcactttgggaggccaaggtgagagaattgcttgagcccagtttaagtttagcctcccggcacatagtgggtctgcatctctacaaaaaataaaaacaaaaaaaatcagcttggtgtggttgtgcacacctgtatagtccccactacttgcgaggctgaagtaggaggattgcttgagcccaggaagtcaaggctgcagtgagccatgattgtgccattgcactccagcctgggtgtcagagtgagaccctgtctcaaaaaaatatatgtatgtatttctgtatttcaaggcattgttttttttttcttttttttttttttagacagagtttcactcgttgcccaggttgtagtgcaaggcgccatctcggctcaccgcaacctccacctcccgggttcaagcgattctcctgccttagcctcccaagtagctgggattacaggcatgcacctgtaatgcctggctaatttttgtatttttagtagagatggggtttctccatgttggtcaggctggtctcaaactcccaacctcaggtgatctgcccgcctcggcctcccaaaatgctgggattacaggcatgagtcaccacacccaaccctcaaggcatttttgtaagcacagtggagcactgttaaggattagcaaccagatcactgatactagcatgttgtcaacaccccatgcatgtaacagtggccagagccattcttggagatgacctagaatcaggagtgaaatttaggaccttgtgatattgcacattttatcagaaaacacaagtttggccgggcgtggtggctcatgctggcgcaggaggattgcttgaccacaggagtttgagagcagcctgggcaacatggtgaaacctcatctctacaaaaagtacaaaaattaggccaggcgcagtggttcacccctgtaatcccagcactttgggaggccgaggtgggcggatcacacggtcaggagatagagaccattctggccaacaagctgaaaccccatctccactaaaaaatacaaaaattagcttggcttggcagcgtgtgcctataatcccagttactcaggaggctgaggcaggagaatcgcttgaacctgggaggtagaagttgcagtgagccgagatcgccaatgaactccagcctggcgacagagctagactctgtctcaaaaaaaaaaattagctgggtgtgggcatggtggcatgtgcctatagtcccagcaacctggaaggctaaggtgggaggatcactctcctgagtccaggagttcaaggctgccatgagccatgatcataccactactgcactccagcctaggagtgagagtgagatcctatctcaaaaaaaaaaaaaaaagaaaaagaaaaaaaagaaaatacaaatttatagggggcaagggtggcatgctggtattaggtcaacttcaggtaatgaaatcaacctggctgagataccaggagcctgagctgtgtaccagagaagcctttggaaacagtttaacaggttgttaatgaacttttgtacaaggaattaaatgaggcactcatggagatacagaataagacatggccctcgccctccagagactcactgcttacactggggctcacatctcctgtaggcttctcagagccaaacttaactttgtcccctaccccaccaccacatgaaacctgctcttcaccttgaatgctctgtcagttcatggtattattaccatgatagactgaatcacagccccaggaatccctggaacctgtgaatattttaccatttgtggtaaaggagactttgcccgtgtgattaagttaaggctgttgagatgggggattagcctggattatccaggtgggtccactataatcacaagggtccttataagaggaatggcaagagaatcagagtcagagcttagaaatgttaggctgctgtgatttgaggaagcctaaagaaaaattttatttcaaaatagagaaatcttaggcttctggctttgccgctgcaggtggggccatgaaccagggaatgcaggtggcctctgaaagctggaaaaggcaaggaaatggattcttctctagaacctccagacaggaggaactcagccctgcccacaccttcagtttaggatttttgacccctggaactgtaatataataaattcgtgggcttttttttttctttttttttgagacagtctcactggagtgcagtgggcatgatcacagctcactgcagcctcaacctcccaggctcaagcaatcctcccacttcaagtaactagaactataggctcaggaggtacgcaccactctgcccagctaatttttgtattttttgtagaaacagggtttcattatgttgcctaggctggtctcgacctcctgagctcaagggatcctcccgccttagcctctcaaagtgctggaattacaggcgttgagccaccacacctggccaaattcgtgttgttttaaggcactaagtttgtgataacttgttatagcaacaataggaaactaacacaacagcatgttaagaagccagggatctttggattttgttgttgtaagccacagaaactggctcagactaacaagaaagcaggaatttattaggggagatccaggtagctcacagactggacacgtggctagaaaccgaggcttggaaccaagatgagagcccaggaactctagcatccaggtagcaggaattccccagctgtctcatctgggcacctcagctggaataggttagctctaatcttttttctctccttggatcgttcacctcaagattgcagaccctgggaggagagtgtgaatggccttgtgccattctgggtcatgtgcctgcccttggctagaggaagacagagcacccaatttacagccccatgtagactgccttgtggagggatgggctgattctccaaaaggaaagcagctgctgttaggaaaaaggcaaagcgtgatgggtggcccctgcaccccatcaccctggagtctcccgttccagtctcccattccccggcctgtctttctgggctcttcagtaccccacattctccagccacactggacgaccagacatttcctaacactgagcacactcaggtctcagtgctatcctgtaccctgccttgcccttgatccccaaaaattctcaaacgtgttagcaaattccaccttggtaaattctttcctgactgccactttcctcgaatctttcatgtgcacagctcataaagtttctactgcatgttctaggtattcgtgtacctgcctgtctctgtctctatcacctagtggagtgttcttggagggtggacatgaggtcttccttaccttgggtccccagagtttcacacataaaggactcaatgagttaaatcctgtggcatttcccatcattgtcctttctcctcccaccattctaatactagtcctcttctaatcaagacctataacctctgtcttagactttgagcaaagcatggtcctggttgcctgtggaccatacaccacatctgacagcatcacgtatgaccccctgcttgacctgattgctgtcatcaaccatgaccggccagatgtctgcatcctggtaagaggcaccagtgggaaagctgaggagtcagccttggaaaatggctttaatgaagttctaaatttttaggaagcatgtcagtccctcctccttttagaaaatatcttttcattcttaatctacatctttggagaggtatatatatctatgggcctttgctagatttaaaagcccaactttggccgggcgcagtggctcacgcctgtaatcctaacactttgggaggccgagatgtgtggatcacttgagggcaggagttctaagccagcctggccaacatggtgaaaccccatctctactaaaaatacaaaaaaattagctgggcatggtggcaggcacctgtaatcccagctacttgggaggctaaggcaggagaattgcttgaacctgggaagcagaggttgcagtgagctgagattgcaccactgccctccagcctgggcaacagagtcagactccatctcaaaaaataaaaataaaagcccaactttttttttccacccttcgttgattttacagtattcttacttctttctcattactccaacttctgaactaatctctttttaaagctcaaaatactattattagtatggtgatcaatttaccttgctagatttagaaagtcagaaaacccagtgtgcatttttattgttcgtttgttttttgtttttttttttttttttgggacagagtttcactctgtcacctaggctggagtgctgtggtgcgatctcggctcactatagcctccacctcctgggctcaagtgagcctcccctatcctccctgagtcttccgaatagcttggactacaggcacacgccaccatgcccaactaatttttgtatttttttgtagagagagggtttcaccatattgcccaggctagtcttgaactcctgggctcaggcaatctgcccacctcagcttcccaaagtgctaggattacagatgtgagcccagtgttatagtggttatggggctctgggagcctccctccatctggggcaaacgtgtttctgcctgtgaaattggcttggcgccccgccagcccatctgctaactgtccccaggctctacaggcagccttggagggacagatgagccctccacagagaactgccagaggaggtatctgaagtcattcacagacacaagtgattctgatttgttcttttggtgtctttgtttctccccttgcagtttggccctttcctggatgctaagcatgaacaggtggaggtgagtgggctggggtgggaaggggtcctgggtacttgaatccagtcaggctctcacttttcattttttagtgtttatcccacatctgtaacaaacacattaagtcctgtggctaatcagaaaatcattttagcagagcactttattaataaagatctggaatccaagggcctcctttcaccagaatacaaggctgtctggaagctgggggagggacatataagtcctaatgttcctttgtttgtgatgcctgctgctaaggcacaagagcactagcacaaatgcaggtgtctggcagtcatgggctgccctgtgaaagaacctgtcctggccaataccccaagcttataactcatcttgctgtcctttgcataaaacacgaatggtccttcctgggacatctccatggctgaggtctgggacctccaatccttcgtctcacgatactttaccttccatggaaaatatttcaaagtactctttcttttagtctctctcagattgcattcaagagggttaattcccacatctcttctcctcccttcgactagacttagctccttaagacaaagaccatgtctttttcatctttgcgtctccttcagctcctagcccaacagctgacttctatgggtcacctaacaatgttaaacaagtgaataaacaccaaacatctgccgtctaaatctgtctcctttcctttcttgcagaattgtctactgacaagtccatttgaagacattttcaagcagtgtctacgaacaattattgaaggcacaagaaggtcagatttcaaaatactggacagaaccttaagcttcttaggtttctccagagcttcccattaagaaactgaaactgcttaaaagtcgtggcagggccaggctcagtggatcacacctgtaatcccagcactttgggaggccgaggcgggcacatcacctgaggtcaggagtttgagaccagcctggccaatatggtaaaactctgtctgtactaaaaatacagaattagccaggcgtggcggtgggcacctgtaatcccagctacttgggaggctgaggcaggagaatcacttgaacctgggaggcagaggttgcagtgagccaagatcgtgccgttgcactccagcctaggcaaaaagagcgcaactccatctcaaaaaaaaaaaaaaaaaaaagctgggcgtggtggctcacgcactttgggaggccaaagcaggcggatcacctgaggtcaggagttcaagaccagcctgatcaatatggtgaaaccctatctctactaaaattacaaaattagctgggcgtggtggcacatgcctgtaatcccaactactgcggaggctgaggcaggagaatctcttgaacccaggaggcagatgttgcagtgagccgagaccacaccattgcactccagcctgggcaacaagaacaaaactccttttccaaaaaaaaatcatggcagttcctattctttccttccttttgaactaccgagatcagctagaacccttgaacttcaagtgcaagttaagaggcatctctgtaaaacacaaagataaacatacttgacaaggctgcatcggctctcactctttggttgctctttctcttctatacttagttccttttctcactcccttttgtataaactaatattccacgggaatcttcccaggatggttttgagaagtgtttgatgacttacgcagtgaaatcctgtgagaccccaaacatcttgttgtgtaagtgattgtattgggtaagcccaagttcctcccaagtcagtgcttccccagggtgcgtgggaagctgccagtggctacagctggtggtgatagaaactctcagtgagggtggggccttgaatccttgccatagaccaaacggaaggaactgtgagaggttacagcagtgatgagagagctgtgcagttctcatttgagaggaaagtcactgttccaggaagaggctaaagccggaagtggaaagttattcagaaatctgacatcctccattcctgtcccttttccccagtgccagggtttgaaagaagttggtataggtggtagatctcctcacaagatctgcatgcttgtagctgagctaataaaatacaaatattcctgaggctaagcatttaaaaacgagtctgtcacaaaggtggtttttaaaataagatgtctaaccttccgccttttagccatgagaactgatcccagaatcaataagttgtaacattaccttcttgtaccagcagtgtgggccaggatggtagatgtcacagctggaataaagaacatcccccaactcaccccagaatcagagacttgggttgtgccagtgacaaccatgtctggttctgccctttcctcccctgcctccctcagatgaaggtgatgcaggtgccttccctcttccccagatttgctgtgatcctggtcaagttcatcaggcctggagagtggttggaactcctcaggagatagacccccaaaacacaggagcagggctgtgttcttttgtcagcccttggggataggcagggactgtgttgtagtgccctaacactggctgggtgctttcagtttgaggtcgggttctgtttttggttccttaccccgtgtggtattgacagcagtgatagaaataaagcacagatgaggcattgtcacactggggatgagagcccagcaccaccaggcactttcatctatggccagtgtgtgccacagggcagggggagctgccccacccttctagaaacagtatataaacagttcttgggcagagaatttctttgtattcctgagaggtcagaaatgcagagcattaagctgagtcatcattagtaaaagtcagagccaggctaagcacggggctcacgcctataatcccagcactttaggagactgaggcgggcagatcacttgaggtcaggaattcaagaccaacctggccaacacggcgaaaccccatctctactaaaaatacaaaaattagccagatgtggtggtgggtgcttgtagtctcagctactcgggaggctgaggcagaattgcttgaacccaggaggtagaggttgcaatgagccgagatcgcaccactgcactccagcctgggcgacacagcaagactccatctcagaaaaagaaaaagagccagtgagaaagcacctcagagaaagcgagcagagcccgcggttctcgtcctgtttgcgggagcagctggaggaccctcccgctgtgacgtacgaggttgtgcaatgctgagcatagttgggatgtttttctgatccctccttctataggcgctttctaaccatgagcaggaaggctatttcctccttaactattgcccttccaaagcctacactgaaacagggcaattttgtcccttgagagcagccagctgcacctcagtcctttgtgtttatcacagatgtcaagcccttgagatgtggagcacagattgtcccattcaagttaccctgtggcctgtttaccagaccctggcacccaaatggtggactggatcaccctagtgagcttctcagtgtcaaagggacaataatgaatatgcaaacacctttggtctcaggattctgattttctgttatagacatctcagttcacactctgagaggacaccacaaacagtgataagggtgacagctgtcaccagcacctttatcacatgtgaaagtgtatgtatgcctgagaagtccacatgttttaagcaagagacagagatggaagtgagagctattggtggattttaaacatgcccgcaaagtaataccttatgcctatttgatttataaacggcccctctgccaaggtcatcttaagggaaccaaggaaacggggctttcttcctcttttgtgtggctgggaaaaataaatagttggcccccagagttacaactttcttcttcacttgtatgttgtaaccctagagattctcctgctccatcaaaggaaacatctgctgtcatctgtgcttttactgttgctgttaaatatttctttcatttttgcatgacaacctgctgagaaatagaaactcagggcattatttccatgtgtgagaggggagggatgcgatggctcagggagaggccgcttgggcttttctgcctcccactggaaatgtctgtgtctcggttgtccagtaattatggcccagtgttcagtcagtcagagggtttcagctggatcttctaaatacgaagccaggccaggtgtggtggctcacacatgtaatcccaacactttgggaggccaaggtcggtggatcacttgaggccaggagtttgagaccagcttggccaacatggtgaaaccctatctgtactaaaaatacaaaaattaggtgggtgtggtggtgtgcacctgtagttgtagctactcgggaggctgagacacaagtatcacttgaacccaggagatgaggttgcagtgagcccacatcatgccactgcactccggcctgggcgacagagtgaggctctgtctcaaaaaaaaaaaaaaaaaaagcagtctcagggtctttttagtatgcctgccttctccctaggaaaaatgccccagctccatgcaccctaccaaggtgtggcagggacactgtttactgcctgcaggctacacctgcttagaaggtgtaatgagtccaagctgtggtttaaactctggctctgaggctgtgattctttattcacatccttgtctttctagactttctagatctccatttctttgcccctttttctgccaaaaaatagtctccatcctctcagtagaaagccacacagagcaacaagaaagtgtcccaggcaatcggagcctgtccagatggatgggtgtgaagtagaacaaactgtcctttactcccagtgtcccatgggaaacagcgtctctgttcataacagagtgcagttctgagctgcctccctcggggtgggctctgcctccagcctgaggcatcccacctgttgcgcagctgttctaactcaactgcactcacttttctcactcttctgtttgttcttttgccatactagctccggctcccaccttgtctttgtcccgtcattgagagatgtgcaccatgagcctgtgtacccccagccgcctttcagctactccgatctgtctcgagaggacaaaaaggtagcagcacccactccttgaccagcaggcagccagaatccagcatgcctctgccactagctctggccctgaaggggagggtggagaggcctctttagggtgtgcgtacagcctgaatcttaaactcctttttttaaacaggcaaatgtgtccaaaagcttgatgtatgttggtttggtccccctttccgtggtctccccagccctcagacaacccccactttcatgggaagatgtttctagctttggcatacaaatgtttgtttcaatccgttctcattttagcaagtacagtttgtgtccgagccctgcagcctctccataaacggagtgatcttcggcttgacatccacagatctgcttttccacctgggggccgaggagatcagtaggtaagaagtgtgttccaggccccaagcaggatgactggctttctggtcccagccctttctgcagccaagaaaatcaaggggctgcttaacggtcttgaccagagagagctgaaagcagcaagctgtgccagaccctctagccatctgagtttctctgtacccaaggggaggggttggatgcattagtttctgttaccacctctctaaactgcgtttgagaccccaaagaaccacgtccattctgtctttgcacttaaaggcatcaaaattcatctacattttcttttctgctccccttttttttcatttcccaaatttgtgacctgaaaacaaatgtggacatcctgtttgtggaggataaactgggaattttctctgaaggattttcttcactaccagtacaacatccagctctgcagagaatcaggccctgacaaatttgttgagttgaagttgggcagctccgttctgccgtcatccttgatgggaaggggcatgtgaagcgactcgcgtgtgaagcgagacgggtgcggctccttggctgaggtttgagattcaggtcagcctggctacacacccgcctcatgatggtgccaactttgcatcctcttgcacagtacggtgctggctaatggccttccttgatcttgattatgagggattcctgtgctttcccttctcaacctggtgtcctgcgtccctcctcatgtggggacagactgagctccttgtgggtgggtctttaaacttccccagaggcatcctcctcttgttgctgtgccttggccatttaccttctctctggtttattaaattctccagtcctccctgaagagaaatgggctgaaaaacagagttctgttttcatgctttcttttctttcccagttcttccggaacttcagacagattcagccgaatactcaagcacatcttgacccagaggaggtgagcttgccgctgggacccctgactgtggagagagtgccttggggtcatggagctatgacaagcatgactgtaagagccttcaccaggctaccagcagggaactttaccctgtgatgacaagcctgcattctgccccacacacacagagaaaaagtcggtctgtggatgccagcagcacgaaagccagtacctagggggactctgtctgagaagggggccccccggtcagctagtgctgacaatttctctctgtctctgtagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctccccaagagaacgagagcccagatgactaggaaggccctcaaatgagggctttcaccaggccacatagaggtgacctggggaagatttcatatgtacacttgcctgtcctctgcctcccaaattctgatatgacctccaagtgggctcagctgggaataccttgaagaagctattgggtcattttgatctctgccaccctttagccctgcctgccttggagttaggtcccttacaaggaatctgcctagaccagtccccctcttgccaaacaagagttagttcaatctcaagaggttaaaaaaaagtttttcacatgagaaagcagtaaacagctagatcaggtttgtctccaagtttaggagctgattgtcattctgccaagtcacctcattcttctgtttgaaagacttaaaaggaattcaaagctttctagtgacaagttaacatatgtgactgaggccgggcgcagtggttgacaattgtaatcccagcactttgggaggccgaggtgggtggatcacctgaggtcaggagtctgagaccagcctggccaacatggtaaaaccccatctctactaaaaatacaaaaattagccaggcatggtggtgtgggtgcctgtaatccaagctacctgggagcctgaggcaggagaatcgctggaacccgggaggtcgaggctgcagtgagctgagatctcaccactgcactccagcctgggcaacagagcgagactccatctcaaaaaaaaaaaaaaaaaaagtgactgaaaatgtgtctggtgatttggttgccttcgtttccattttctaaaaccctctttggggtccagccatgtgatggcacttctttttcacattggttcccagttagttgaggctctccaaacctgtcacctctcctctcctccccaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctgagtttgacctttcttctattttcttttatttatttattttgtttttagacggagtctcgatctgtcgcccaggctggagtgcagtggtgagatctcggctcactgcaagctctgccgcccgggttcatgccattctcctgcctcagcctcctgagtagctgggactacaggcacccaccaccacgcctggctaattttttgtatttttagtggagatggggtttcaccatgttagccaggatggtctcgatctcctgaccttgtgatctgtccgcctcagcctcccaaagtgctgggattacaggcgtgagccaccgcgcccggcccctttcttctattttctttatcctggtagtagacaaagaatgttgcctatttgacctatgtccagagaaggcagagtgtcagtcacactgggtttctatccagccccagtcctgtccagtgggtaactctcagccccactcctcatcccccaaaggccccagtgacctctatgctgcagaggtgcactgggtgggccctagagctgggctgcagagcaagcaactggctgcatgcctgggcctccctgcgcagttcctcacatgcatgctgtggtcccagcctgacctctccatctggagggggccgcctcgctgggctgttccaaagctggagtcctggtggcagctgctttgccaagtcgcgcagtagccagggcttgcctgcagcccagaacactcagacagggtcaggccttccagggttcacagcacgtcccatgcccctatgtcctggcatctggggaaaagctgtcactggccagacgtggagtggcttcctgccctaagctggcaggctgtcctgcctcacatgccagagccaagaccggcaaaccccagctgtcagggcagggaagtgggcaagggggcagcaagctgctggtgtctatgccttgactccgagataaatagatgacctaacagtggccaacttttgcctctcacctttctgacggtgaaatggaatcgagccccagacctgaccagggtacagtaaaaggtcttcctttaaacacaaggagcagctgttttatttcattagttttataggcacctcctctgaggccaagaattagaaactcatccctgcgtggggagtggatttttccgttctcccccagctcctccacacatgaagcagccagctgtgttccacgggggcaccatgacttgtcagcctccggatgtggaattttgggagcccaggcaatggttgcctggataccagtcgtgtgactgttggaaatgatctgggagggccgggagggccggagcaggcatttaagagtcagacaaagagaaagcgggatgctaacaccagagcagacaggtctggcaggcgtgcctctgccaccagacagttcctttttgctcttgtcaggaaggtgccaagtgactgctggctgaccgtccctagaccccacttcagctgtgtcaccagtttccccaggcatctgtcatcccaggtattctcaagcaggctctgggggcgtgtcagtgacggagggtgggagggtgcccaggaggtcaggcccgtctgcctcagccccctttggtggcctctccctgatctggtcatggcccctgcccttgagacaccaactagacggtcctgaagaaatagtcccgagctcttgccaggatttgcctcccatgcccatgcccttgccctgcctctgccctggcagaaggagccgccctcccttacccgcctcgtggcttccctttagggttccagtctctgagagggagagggagagctgctgagggaacagaagccactcctagttgctgttcctgggaacccaagtgggtgccaagaatgcagcgagggaattagggcctcgaggggcacccaaggttgggggccggcagggccatggcgcggatcctccatccagctctgccttctgcagccactggggcttggggtttcctttcctttgacctcagggcacccggcccagctcaacctggccttgctgcttcactactgctgggagtagccatctgcgctgatttctcactccaccaaccccaccccgacagagtctcactctgtcgtccgggctggagtgcagtggcgcgatctcggctcactgcaacctccacctcccaggttcaagcgattctcctgcctcaacctcccgagtagctgagattacaggcgcctgccaccacgcccagctaatttttgtattttcagtagagacggggtttcgccatcttggccagactggtctcaaactcctgacctcaagtgatccacccgcctcagcatcctagagtgctgggattacaggcgtgagccaccatgcccattttaaagtgtatgattcagtggtttttagtatgttcatggtgttgtgcaggcctcgccaccatctaattccagagtattttcatcaccccaaaggaaaccctgcacccattagcagtctaatcccatcccctggcaatcattaatctaatttcttttctgtagatttgcctattttgggcattttgtataaatggaatcatacaatacatcctctttttttttgagacagagttttgctcttgtcacccaggctggagtgcagtagcgcaatctcggctcactgcaacctctgcctcccgggttcgatggattatcctgcctcagcctcctgagtagctgggattacaggtgcctgccaccacacctggctgatttttatatttttagtaaagacagggttttgccatattggccaggctggtctcaaactcctgacctcagggttcagcctcctgagtagctgagattacaggtgtgtctagaactcctgacctcaggtgatccactcgcctcggcctcccaaagtgttgggattacaggcatgagacaccgtgcctggcccatgctcttttctgtcaggttttgtttgtttgtttttttgtttgtttctgagacagagtctcactctgtcactcaggctggagtgcagtggcacgatctctgctcactgcaacctccaccttccgggttcaaacgattctcctgcctcagcctcctgtgtagctgggattacaggcacccgccaccgtgccaactgatttttgtatttttagtagagacagggtttcaccatgttgcccaggctggtctcgaaccactgacctcaagtgatccgcccacctcggcttcccagagtgttgggattacaggcgtaagccactgcacccggcctgtcaggtttgtttcacttagcatgatgttttcaaggtttgtccctgcagcagcatgtatcagtccgccattcttttttatggctaagatcccactgtatggctatacggtattttatcagtgcatccactgtcgggtttttccccttgtggactattatgaatagtggacgcttgtgtgcaagctttgtgtgaacacctgttttcagttctcttgggtatgttcctaggaatggggaggggctttagatttacgaaggaagacaaggcaaagagagggagggaggagggacagagggcgagagaggggtaaaagaaaagagggaaagggaagggaggcagtgatgggcccggaatggtgcttcagagccagattgtgaagtcttgctaaggcatttggacctgattctttctgccccagagaatcttggaagggtttgcctcccaccccctgtgcctcaccctgaccacccaacaaggaccaacttaagaggagtcccaggtgcagcctcagtacctggtagcatgtagcaaaggggtggtttgaggggagaggggctcaggggaggggcctgggtctgttggggcaggtcgggaggaagaggggcaccaagtgggccattggaatactggaagcagcactccagtgagacatgggcgttggaggggtagatgtgggagtcactgcagtcaaaagccacagaactgggtgctgggagggtggccgagagatggatgggcaacatccgcaccatggagaggactctggccagcacttgcacttagcatcactgatcaacaaggcaaaagggtgggactggcctgggggcaggggagggaagagggatggcaacagagaggtgctgggatttctggctaaagagaccagaagacacccatggttgttcatggcaagactcccagctgcattcaggcatttgggaccttctgtcaccgtcattggtcattctgggtcttcagtccccaagcgaccatgcctactgctgctttcgtgggtcagccctggaaatgcccaggggcctaggggctggcctgccctcagacccagctggactgccgctggctctgaattcctccatcctgccccgcctcttcccggggctctaggctcctccccacccagagcctgcctgacagctgaggccctgcagctgcccaggcaaaggggcccctgggaggtctcagggacagctgctgcccataaccttgctgaccctggcccctgcacactgctccctgagatcccaggcttctgcccagcagccagcaggaccctaccaagccccatcttctctgctcactcccatcgctcccagatcttcccaggggctgaagcattttgggctgagcattttcgtgctgagtcagcaggccccacccaaagagtgagaaaagctgctgggtagaggcacccctagccccgctcctgcttcagaggaagtgcctttcaggggtggatgaggggtacacctgcctccgtcaggcaggcttggccctgttcaacagggtggggaccctgccctcccaccacctgcctcctaccacagaacagggcacaagggtggcacaaggggaaaaaggagaaggcaccatcactcctgattcccagcgaatagggggaaaaggcatactcactcctgattcctggcagcttcttcccttgaaggtccactttcctcctgaggactcgaggccccttcaaattgccccttagaatgtttctagtaatagtagttgcctctggggacgggtgtccaagggctaggggtcaggagtaggagggctcagagaacgatttgtcatgtccacactcaacctgtttgaatttttttttttatttttttggagacagagtctcactctgtcgcccagtctaagtgctgtggtgccatcacagctcgctgcagcctcaacctcccaggctcaagtgatcctcttgcatccgcctcctgagtagctgggaccacaggtgtgcgccaccacacccagctaatttttgagtttttgatagagacagtttcgccacgttgcccaggccagttcaagcaatcctcctgcctgagcctcccaaattgttgggactacaggcatgaaccaccacacccagctgtgtttgaaattttttaccatgtgtctggattactttaaaagaaggtgggggccaggcgcggtggctgacgcctgtaatcccagcactttgggaggccgaggcgggtggatcatgaggtcaggagatcaagaccatcctggctaacacggtgaaaccccgtctctactaaaaacacaaaaaattggccgggcatggtggcaggcacctgtagtcccagctactcaggaggctgagtcaggagaatggcgtgaacccgggaggtggagcttgcagtaagcggagatcgcaccactgcactccagcctgggcaacggagtgagactctgtctccaaaaaaaaaaaaaaaaaaaccgaagaaggtggggatgggcacagtggctcatgcttataatcccagcaatttgggaggctgaggcaggaagatcacttgagcccaggcagtggagattgcagtgagctgacattgtgccactgcgctccagcctgggcgatagagcaagactcagtctcaaaaaaaaagagggggtagagtggtgggaatagacatatacaaatgtttatatgtcgatccagctttctgtaagcactccacaccccacagctgttgtagcatccacctccttgggaggcaggctctcagaatccctgctccctgagggcagggagtgtcatgttcactgttgtctcactggtccctagacagtgcttggcacatagtaggcccacaaagaaactcctgcagaagcagtgccctcctatgacatgcctctccaccttccagaagcaggcagcttggaaagaaaagaggtgggaggcccacctgcagggacagcacaacacctgctaagggccctgcaggttgggggtctctcctcggcagcgggatgcagaaatgaatgagtggacagaatctctgctgccacccagagctgccactccagcacagaaacctgtaaacagtggacactgcagagcatcagatggagtcaagtgtgtcagatggagaaaaccagagcaggccaagggcagaggtgcctggagttgtggtgggtgctgcacagaggaggggtcaccagctcccaacttttatttcctaaacatgtgtctcccatacaccctcttcttgctatccccggcatcctaccatccacccatccgtccacccatccatttacctaaccatccattcttccatccatccgtccatccattcatctacccacccacccatctatctatccatccacgtaaccatccatcctttcttccatccatccatccttccatccacccacccacccactcatccatccatccatagacttaaccatccatccattcatccatccacccacccatgaacttaaccatccatcttttcatccatccatcaacccacccatcaacccacccatccacccaaccatccacccacccacccatccatccactcatccatattcactgggtgcctaccacatggcacacactctgggggactggctatgatccaatggaaaatggacatgaaccaaatgacaacgccacggagaggtccatggtccagagtttcccacggtatcacaaggtgacccaacatcaatgggggtccagaaagcttccctgaggggagacatcacagctgagagccacgggaggcatgggggtggccaggtgaggtggagggagcaaatcgcagggctcatggaggagcatgtgcagggacctagccctggaggctgggcaccgccgacagctgacaggcacatgttcagggcagcaggcatggagcactggctggaggctgaagaggctagcaggggccctgctgcaggtttgtgaccatggcagcacacgaacagggcacgtggcagtcagagtggtgtttttgtctatcaccatgtggtgtggagaataggcaggcagcacatcatcctggcccccaaaacccttgcgggctccattctccccccacccccaccctgtcacccaagttgtaagcctggactgggcctgactcccccttcttcctccatggccctccatgggggctaacctatcacctaatctcagcctttcaacttcatcatctccatctccagctctcacaccactcttcaggaccaaattttctctcccttctacgctaactgtccccagaagtggcctctgcctctagtctggcctccctccaggcccccctctccaaagctgcccggcaccacctctgcagaaattctgcagttcattcaccaaaaagaaacacatgtggctcttaagcaaatgaaaaggtgaccagcctcacgcatcgtaagagaaacgcaaactctaactacacccaaattcctttgttttgtttagtttttgcctttcagatggacaaaaatcaaaataggtggaaaccaggggctggtgagcctgaggagaaacagccctgttgactgtgtgggggcctggtacctggcacagtctccaagaaggacaagctgacagagctgacaaaatgaccactgcaagctgggcacggtggtgcgtgcctgtagtcccagccacgcaggaggccaaggcgggaggatggcttaagcccaggaggtcgaggctgcagtcagctatgatgacaccattgtacattgtactccagcctgggtgacagagcaggaccctgtctctaaaataacaataataagacaccactgcatgtatcttttgccccccagtcctcccaagtcccttctgggaatgtattccgcagcagcgctcgtgcatgtgtgaaagggcttttgtacagatgactcactgcggcacggcctgtcttgagaaagggctggaagcaacctgaaggtccctctgccaagaagtgcatctgtaaattaccatacatccttgtgctggaataccgtgcagctgtgaaaatgaggacacactctatgtattgatgtagagtggtctccaaaatataacgttaactggaaaacgcaaggtgtcaaacagcatgaacagcagaggctcaatgaaagggcttctcacagtcccgagcaggacggccctccgccagctaccaccagggcctgcagtactttggaactctacttgtctaaatattgacatttgtgttaaaaaaaaaaaaaatgagaggggccctgctcgttcatgcaagaatatccctagaagtgtttacaagaaactgataacaccagttggctatagcagaatggagaactgtccctgggggacagggatgagacttcttgcctcttaggacttcagaatttctttttctttctttcttttttttttctttttgagatggagtttcactctgtcgctcaggcacccagtacagtggtgtgatcttggctcaccacaaccttcgcctcccaggttcaagcgactctcctgcctcagcctcctgagtagctgggattacaggcacccaccaccatgcctggctaatttctgtatttttaggagagacgaggttttgccatgtgggccaggctggtctcgaactcccgacctcaggtgatccgcaccccaccccctaccttggcctcccaaactgttgggattacaggtgtgagccaccatatccagccaacttctgaattctgaatcacatgaaagcattacctcagccaggcgctttggctcacccttataaccccagcactttgggaggccgaggcagatgaattgcttgagcccaggagttcaagaccagcctggacaacatggcgaaaacccgtctctacaaaaaatacaaagattagcaaatggcatgtgcctgtggtcacagctactcaggaggattgcttgggcccaggaagttgaggctgcagtgagcagtgatcacgccgctgcattccagcgatacagcaagaccctatctcaaagaaagaaaaagaaaagaaagagcattacctaatcaaaaagtaattattattattattattattattttattattttgagacagagtctcactctgtcgcctaggctggagtgcagtggcacaatcttggctcactgcaacctccgcctcccaggctcaagtgattctcctgcctcagcctcctgagtagctgcgactacaggcacgtgccaccacgcctcgctaatttttgtatttttagtagagacgggttttcaccatgttccccaggctggtctcgaactcctaacctcagctgatccacccgccttggcctcccaaagtgctgggattacaggcgtgagccaccgcacccggcctcaaaaagtaatttaaatgaaagaaaatgcagttctgatggtgttgtacctctacacacagatcatcgttgcctttcccacagcactcggcaactctcatgagtgatcacctgcctttagctattctgcaatgggcccttcattctcagtggcaagtgacagacccaaccctaactgtattaagccaaaactggaatttgttggctcgtagaatagaaactgcttcaggcatgactggatccaggagcacaggcaatgtcattgagattcattctcttggtgctgttttcttctatgttggccttattcttaggcaggctccccccttagggtggcagagctggccaccagcagctctgggctggcatcttgacatttgtgaccctaacagtcccatcaagttcctgggctgatgctctctgatgtcatatgctggagccattcccatgactcagactggctaggcacaggactcaaacccacttttagagcttgagggttgggggccagtcacactggagactagaaaactgagggacagtcaccagagtgagagatggatgctgggcagggaaaacagtgcttacccactaccctcttggcctgtcccctctcctatgccatgggcaactggacctctcttgttttctgctcataccatgactttacttgcaatcctcctggcctttgccttgccaggcctctgcctgcttcccctggaatgtccttccctttctgtgcctggcaaactcctattcatccatttatgccctgttcacatatcaccttctccttgaagcccttctcactctcccatctgctttcccacccatagcagacagatctcatggctgttctctttggtttttcattcaattcccagtcattggctgaacccctccgtgctggcccgggagggataaagggcagaatcaattatttgtttctcacgcaggttatctgttccctgagggctgggtccagctttggccacctgtgtcttctctagtccagcatagccctaggcacaagagagatgcaagcctaggttttcagaatgaggaatgacaggatacctggaaggcacagaaagtgtggaagacagcctctgctgactccacaatttactccctacgacaaaatgacagccttggggctgggacgctcccagagggctctgggaggaagtgcttgggctggtccctgctaggacaaggctgtcaccactctggaaacccccatagccctgggcccgaggccaaaatccagatgcgaagggaagtgcccccagcaaggccctgccacccaactcccaaggaggggtcccaggcagaggcagcagctggagccaactccgagggtgacctctcatctcaaatcccagcctccagtgggtcacagttctctgaagtggggtgaagagcgaggagggcagggctggagttggcaggagtccaggggaggaaggaagcaagaaacaaggaaaaaatccaacccaggtctggggttggctcaggccacagggccctgcaggctgagcttaggctgggacgtcagaagcttccagagggtggctgagcaccttctcagctccctgccaccctgcatcccagcagagggactggggcacctccagagacccctgtcacttcttagcacctcccctagatgcacccccaagatgcgcctcccctagatgccactcttccctgtgactctgctcccagaccccaagtccctgtcatctcacctgccccccagggtcctgggttccaggtttcgtgcccatggagagctggcttcagcctccctgggggtaggagggagcttccctgctggtctctccaatctggccagtgttgccggagggggcttccaactccatcccccaggtcccatgggggtgctatggccgctggtgatggcaatttccaggaaggagaggctgggaggggaaggaagggctgagtcagtccctgtgtagtgatcacagtcggggaggtggctgtggggttggttggggagcctattgggcccatctcaggacaagggagaggctccaggctgaggagacagaagccaaataccctgctctgggtgtttctccatcgtggcctgctctgcccctcccaaatgcccttttgttttttttttaattttaatttttattttcttagacggagtcgcgcactgtcgcccaagctggagggcagtggcgtgatctcagctcactgcaagctccgcctcctgggttcatgccattctcctgcctcagcctcccaagtagctgggactacaggcacccgccaccatgccaggctaattttttgtatttttagtagagacggggtttcaccgtgttagccaggatgatctcaatctcctcacctcgtgatcggcctgcctcagcctcccaaggtgctgggattataggcgtgagccaccgcgcccggccttttttttttttttttgagatggagtcttgctgtgtcacccaggctagagtgcagtggtacagtcttggtcactgcaacccctgcctcccaggctcaagcaattcttctgcctcagtctcccaagtagctgggactacaggcgtgtgccaccacgcctggctaatttttgtatttttagtagagacggggtttcaccatgttgaccaggctggtctcgaactcctgacctcagttgatccgcccacctcagcctcccaaagtgctgggatgacaggtgtgagccaccacatccagccccagatgcccttttggatcctgcccctgaggtagcagggtgtccaggagcccttctgtccaggacagtccaggccctggctgaggcatcagaccctagggtccaggctgggggatgcagcgcttggcctgagtgtcttgggtcaaaatgcaggccacgcttccccgtggctcaggctattccagcctccctacccacaccccaggcccctacatatagcctgagaacttgcacaaaaaagccaagtttagtaaatgaaatcctgttttatacatggccttatgaatggcagggctcccatggcgatgctgggtgtgcacacaaagatcctgtccattcagcagaacctcctcagggatcccctgggccccagccaagtgacaaccacatctgtgaatggggagaaggaagcgccctccctgcatgcttgcacagcgcagaacccagggccaggcgccgatcactcctgcgatgtggacttggtcgggccccctgctctgaatgacagcaggagtggattgagcggcaaggggactggcactgggcggaacacgtcacatccaggtgggttgaaaacagtccccagagtgcagatagcatttctagtcctggttggaaggctcagggaggaaagcaggagcttggaccaggtttgcgggctctgctgctctctatccctacccgagggacccctaatcacccaccccccacagaacttcttcaaagagctccggggttggtccccagctgtgtgtggccttgggtgagaggctttgtttctccatcttccatccctgtaactctgttttgtccccagctctgaatggagtgcctgacccttccctgaccgctaccccccaatggaggactctcagcagatgggcaggggatgagggcttggcctgagcctcattcccgcaggcttaggtggcttcatcattacagccattccgatcaagcagcacagccagctggccaggccccaaagctcttgtctaatgtgtccgtgaaacaatgccacctgaggggctgcgtattcccatgaacaaaatacatgcatgtccatcccttatctggtttgggacttgcctgacctgatgctactaccccatattataggcaaggagactctggaagggaaggtcctttgcctgtggccacagagcaaagcagcagcagagacagctcagaatctgactgatggctcagaggccggggctcaaggcactcagctgcccctcctctctgagagctgtgtcctggggatgggcaggaatgatgcctgtggggttagaagcctgagagaaggaggggccagagcccacatgccttgccacttctaggctcagcaaatcactgtcggtgccctgagctttagttcccatctgtaaaatggggatcgtgattcaggctctggccacgtcactaggcacccccaggaggatgtaaagaattcaggaacatgaagcaatgggtaaagggcacagggcggcctggcaaagtcccatggcaagaatggggagaggcacaccctttactcacccctaccacagcttggcccagggccatcattgccacttactcaatggtccaggcctgttttcctccaagctgccaggccattcctggcagaatccacctgaccaatactccctgcagagttgagggcacactcaagattaaaacctgaacctccttggattcgttttctatcactgctacaacaaattatcatggaataggtggcttaaaacaacagaaattcgtgatcttacagttctataggttagaaggtcaacatggggctgagcgaggtggctcatgcctataatcccagcactttgggaggccaaggtgggtggatcacttgaggtcaggagtttgagagcagcctggccaacatggtgaaaccctatctatactaaaaatacaaaaattagccaggcatggtggcgggcgtctgtaaccccagctactcgggaggctgaggcaggagaatcgcttgaacctaggagatggaggttgcagtgagccgaggttgcaccactgcactccagcctgggcaatagagcaagactctatctcaaaaaaaaaaaaaaaaaaaggccaatgtgtgagtctcactgagctaagatcaaggtgaggaggtgagggcagggctgtgttccttctggagcctctagggtagatagggtagaacctgtttccttgtattttccagcttctgaagcagttccttggtttggggcctctgcctccatcttcaaaggcagcaacacatcatttctctggcccttcagtcatcacatctctctcttttttttttgagacggagtctcgctgtgtcactccagctagagtgcaatggcacaatctcgactcactgcaacctctgtctcccaggttcaagcgattttcctgcctcagccccccaagtagctgggactacaggcacgtgtcaccacacccagctaattttttgtatttttagtagagacggggtttcaccgtgttagccaggatggtcttgaactcctgaccttgtgatccacccgtctcagcctcccaaagtgctgggattacaggcgtgagtcgtgagccaccacgcccggcctatcacatctctttctctgtctcctgcttctacttttaaaaacccttgttattacactggcccacccagatacttcagcataagctattttaaagtcagctgatttgcaaccataatttcattggcaattttcttttttttcttttttttttttttgagacggagtctcgctctgtcgcccaggctggagtgcagtggtgcgatctcggctcactacaagctccgcctcccaggttcatgccattctcctgcctcagcctcctgagtagctgggactacaggcgcccgagtagctgggactgcaggtgcctgccaccatgctcggctaatttttttttttttttgtatttttagtagagacgggatttcaccatattagccaggatggtctcgatctcctgacctcgtgatccacctgccttgacctcccaaagtgctgggattacaggcatgagccacggcgcccagccctcattggcaattttcatttccatttctcatgtaacaaaacatattcatagattacacaggttcggatgtgggctttttttcttttctttttttttttttacatgggtttttgctctattgcccaggctggagtgcagtggcgtgatcacagctcactgcagccttaacctcccaggttcaagcaattctcctacctaagcctccagagtacctgggactacaggcttgagccaccatgtccggctaatttatttgttgtagaaacagggtctcactatgttgctcaggctggtgtcagtgtcaaactcctggacccaagcaatcctcccaccttggcctcccaaagtgctgggattataggcatgagccacagcacctggctagatgtgaacatatttaggggggctgttattttacctaccatgatccccttcttcccatccggacctcccagcttgtctggcatcttcccccacccccagcatcctgcctcccccactgaggtcttcccggctctgcctccctaaaagcccttcccacactgacagcattgaagccaaccatcctggtcacactgagctggcatagctgtcatcctctagaaagtgaggtctgtccaccccgtcactacccaccacttcctctgccccactcttcttagcacttacccacctggaagggtatcatgatgtacctgggaacttggatttcccccatttcccttctctgggctgcaggtcccaatccagaggctgaatccccagggacaagaacagcgctaggcacttggtagatactcaacaaatctctcttgagtcactgagaggtgcagtttccttcagtctgtctccagcaccctgtgcggtgcctgcccttcaaaacatgtttctgggccgggcgcggtggctcacgcctgtaattgcagcacttcgggaggccgaggcgggcagatcacttgaggtcgggaattcgagaccagcctggccaacatggagaaactccgtctctactaagaatacaaaaattagccaggtgtgctggcacatgcctgtaatcccagctactcgggaggctgaggcaggagaatctcttgaacccaggagacggaggttgcggtgagcagtctgggcaacaagagcgaaactctgtctcaaaaaaaaaaaaagtttctggccctgtaggaatgactgactgactgactgaaagaatgaatggaccaggaactagtctgaatatgagccccaccttcactctggaagcctgacagcaaagacgggggtccaggccacgcggcctctgccttcccatactgtcttttctagtgggaggtaaactgatcaactagcttgtaagtttgtagtattctaacgtaggcgcttccaaggaagtcgctgaatatacttgtgccggcgcttccccgacgcagccctgcagggaaggatccggtccaaggtctctctgcgatttctgaagaattcggtcttcccggagcctctcccccggctcttctagaaccgaaggttttagttcccatgggcacagccggaggccgcctgcgccacccggccctcagccgccagaaccaggacaggactccagggcgcgcgcgaccgctggacccgggagcggcacctcccacgccgggagccccgggcggtgcccggagtggggcggggcctgggcggggatggggaggggcttggctggcgcggccccggcattggctccgcgggccggggcggggctgcggggtccgcggtgcactctgtaagttcaccgccggtcgggtccggccgccgcgctgtccagctcctgagaccttgctgtccgccggtctgccgtctgcgcgcctcacggtgagttcgggctgggattttcgcagcttcgcgggggtcccccgagaggcccatctctgtggcgccccgccccagctcgcgccctggctctgcctctcacctcactcagttcctttcgagggctcctagggctccatggggcttcccacccgcatctgggttcccgcagcctcgcccgtgcccgccacggtccgtgggggcgcaacgcatcccgaccccgaattccccgttctgccctccattttgtgtccgggcccccgcccccctcccgagacccaggggtgccccgccgcccagcatccccaccggggctgggggccgtatttttagccgatagtgagttgttctcctatctttagctgcggccgcgaatgtcctgaaacggatccgggctgggctgggctccgcccgggtaggagtggggaggggtcggcgcaggaacccgagccggagctaaggagccggacccgtgggaggggcgggggcccgcacgcccgagctctggccctgtgccgagcggacactaggacatcgcccaggccggaaagcacaggggggaggctcctcccagagcttggagactagggcagggtccccaatcgccccctttttccccgattgtgggaccagaaaccccgaagcaaaaagatctcgcaggtaatccccatctggtacttgaacgcgcagctccttggggaccgcctgcctggagcccgggggaggggcgctggagaccccggtgcgctctcggagtcctccgggacacgaggcgatcaagggagcacgcgcgccacctggcggccgcggagccgggcacctctccggaggcaccgggaccccgggagacccagcggccgctagagggtctctgcatcctcgaggtctaggagggcgggaggaggtggacgcctggggtcaggagcccttcgtttttgctattgttcaaagcactggccccggagaatcgaagtgcttgaggaaggaaggccttgtagatatttgctgaatgaatgataaaacctacagtgacccgctgaaccccgctattgtacattggcgctctcacctgcaatattgcagtgggatctccagtggccctttagtggtggcttcgttgtcagcccattttatagatgggaaaggtgagacccagagaggagaggcgtcttgctgaaggttactgaggaagtcccaggtggagctggatttaaggacagtctcctgatttaggagaagagggggtgtgaggtggcctaatattcttcatgataggaggatccctgcctgccggaagtcattttctcattgggaggtccagggctcctgtccagggcaatcacagagagctaggatgctcctatctgctccccgactgctgcagggagctcccctcccagctccccacagccctgtcctgatggagacctcattctcatatctctggacacatgaaagttgggcagacgggggcagccaaaggtcaggatgtagatggaggagatctggggacccactgttcccagcctagctgtgagcccctttctctcccgctccccaaacatattatggaagtaggcgtggcccactgcatgggaaccacgtggaccaggctgggtacccactcttccacttcctaactggatgacgtcgccaatgttacttaacatctctgaggttcagcttcgacttctgtaaagggccgtaatgaccccaccatgccgtgactgggagctttaagatgagaaactgtgcgtggcaagctggatcctagggtcttgcagttgccaaatctaaattcctggggcgtgagggttgtaattcccagctctcccctgggccgctgatgctggcctcaccctcgattctccccacatctggaattgggtgtgtacatctggctgtgagtgagacagctgtcagggacgcccaatttgttgtggaaacactcaggctgtcttggcgctgccgtgtgatggggttgggggtgcggggaggacctggcccaggctctgggtacatcccaccagtcagccccacgctccatgagtgaaaaggaagacaagccccccccaggacttctctcctgacgagcgacaaattgcatgtttgtcagcatggcccccaggcctggcatggttgacacaggatgaatgcgtgacgggattccaagacctcagggtgcccatgcgtccccacccttcccccagctccttgcaagctgagctggatttccgccacgggagagtcattcctttgtttcctgttaagctccaggtgctctgggaggggtaagatgtccggcctctgtggctcagtacgactgacccgggtgtccggtcctggggtggggtttcctgagcaagggcctcagctggtggggggaggggggcagttggactctgcttctcctgcatcctccttcctccttcctgctcccgcctcccaaccccctcacccccaccctcaccctgcccagaatgaaaactgaggcaaagaactggcaagagccacctttggtgagcccctggctgggcctggggagggagtggtacaggagggtgggctcatctggcttgaattcccatgctgcccttactcactgggtgaccttggacaagtttctctctttgccttttatgctgagtctacatctgggctcatgtgtactggaccaatcaggtcccatgtgcgtcccccaccctcaagcagagggagtgcttgcttcatttcttttttctgttaaatcagtatgacaccccttcatagctatttatttttacacattaaaaatagcttaatttttttctgactacataaatatgtgcatataaataatacattgcttattagtaagaatttgaattcatagaggtctgaacaagaaaggaaacatcaacctgaaattctaccactttgagaaaaccactgttccatcttttcatatttatatatattacacacatttatcatgtcatagtcatgggaccaaaatattataggttatttttattgatgactcctttcctcccatatcagtgaccccaccccccatccctgctgtgtaccctagtcaaggtagcccatatgacaacctagggctggccttctagatttttctctgtgttttaaattttttttttaattttttttattttttttgaggcggagtctcactctgtcacccaggctggagtgcagtggcacgatctaggcccactgcaacctctgcctcctgggttcaagcaattcttctgcctcagcctcctgagtagttggtattacagacttgtgccaccacacctggcaaattttttttttgagacggagactctctctgttgcccaggctggagtgcagtggcgcgatctaggcccactgcagcctctgcctcccgggtttaagtaattcttctgcctcagcctcccgagtagctggtattacagacctgcgccaccacacctggcaaattttttttttttttttttttgagatggagacactctctgtcccccaggctggagtgcagtggtgcgatctcagctcactgcaagctctgcctcccgggttcacgccattctcctgcctcagccttccgagtagctgggactacaggcgccagccaccatgcccggctaattttttgtatttttagtagagacggggtttcaccgtgttagccaggatggtctcgatctcctgacctcatgatccgcccgcctcggcctcctaaagtgctgggattacaggcgtgaaccaccgcgcccggcctaacacctggctaatttttgtatatttagtagagatggggtctccacatgttggccaggctggtctcgaactcctgatctcaggtgatccgcccacctcggcctcccaaagtgctgggattacagaagtgagccactgcacctgactttttttttttttttttttttttttttttttttttttttgtataggacagaattctacacagacctgtacccatgcagttacacaacatgcatatgtgtcagagcagggaggcaggtaggtagtcaatgctttcaataaatggatgatctatattatgtttttgcattttgcttctctctctctgcaatgccctgtgggaatcctccaaaatttttcacctgtaggttcacctcaggttcaattttgaattttgacacctctgattttttttttttttttgatggagtcttcctctgtagctgaagctggagtgccgtggggcgatctcggcccactgtaacctccacctccggggttcaagcgattctcctgcctcagcctcccaaatagctgggaccacaggcatgaaccaccacgcctggctaattttttgtacttttagtagagacagggtttcaccatgttagctaggatggtcttgatctcctgacctcgtgatccacctgcctcagcctcccaaagtgctgcgattacaggtgtgagccactgcacccagccccaacacctctgatttttaaatagggttgataatagggtggttgtgttgattaattgagatgtgtctgcaaagagcgcagaagaatttcaggtacagagcagaggccccctcaactaaaaaatatatgtactccccactccaccttctctttagatgccagggtagggaggaaggccagaaagtatcctagactcagcccctacccataaggaactcttaataggcagaggagaaaacacgaccccacctccaggtgggacatgattgggtcaaatgggaagtgccagccacccagcacccttggccaaacatctgctgtgctccaggtccccgccaggcttgggcgggagagacagtggtcacaaagctctctgtccttggtcaagtagggagtcaaggccatttgtgaggccccccacaatctggcacttacattgtggggcacaggtgatgtgcaatggaggtggggggtatggtatgagtacctggataagggtgatgagacctactttgccggggacccagggcaagagaatagagcaggactttctgtgtgactttggacctgtcattcaggttcccacctcagtttcccacctgtaaggggaggagcttggccctggtggtgagtctataagatgcagtaggtcttagagtgaagacatgcttctcccagtacaattccctgcaaggggagtgccccaccccctcaggatcccatggctaccacaagaggcccagaaacaagatgtttctggccaggcacggtggctcacacctgtgatcccagcattttgggaggccgaggcgggcggatcatttgaggtcaggagttcaagatcagcctggctaacatggtgaaaccctgtctctactaaaaaaaaatgcaaaaattagccaggcatggtgacacgtgcctgtagtcccagctactcaggaggctgaggcagaagaattgcttgaacctgggaggtggaggctgcagtgagctgagattgcgccactgcactccagcctgggtgacacagtgagactccatcttaaaaataaaaaagatgtttgcatctgaccttggtcccgctgtctctgacaggtgtgcaccctttgtgtttcagctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaacgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtgtgcaagggaccaacagcttctccagcttaagagcaccgagggagcatgcaggagggatgcttggagctgggagggtctaacagtgctgcttcaagattcattccatccacggctgtttactgagcatctccagtatacaaggcacggctccgggtgctggggatacaaggcagacgccatccctgctctctaagagtttaaattctagttggaagggggatattaaattggtaaacaaataagagatgatttccagcagtggtaaaggctacgaagaaaacaacgtgatcaggaatgcctagcagggaggtcagggagtgtcagggctcattaatgtgatcagatgtgattctgagccaaatcggagctaccagccagataactcatatgtaagcacaggcactgaggaaccagagtgaagacagagcagacaccacacagcaaaagagcgtggacctccgagttgcacctggcctgagactcagtttccccatctctaaaatggagcaggccaggcatggtggctcacacctgtaaccccagcactttgggaggccaaggtgggtggatcatgaggtcaggagatcgagaccatcctggccaacatggtgaaaccccgtctctactaaaaatacaaaaattagctgggcatggtggcacgtgcctgtaatcctagctactagggaggctgaggcaggagaatcacttgaacccggaagctggaggttgcggtgagccgagattgcgctactccactccagccttggtgacagagtgagactctatctcaaaaaaaaaaaaaaaaaaaaaagagccactgatagctacctcacagggttattgagaaaactagggataacatttatactagccacagggaagggttttttgttgttgttgttgttgttttgttttgttttgtttttttctgttgagacggagtctcactctgttgctcaggccggagtgcaatggcacagtctcagctaactaaactctgcctcccgggttcaagctactctcctgcctcagccttccaggtagcttggattacaggtgcacgccaccatgcctggctaattttttgttttgttgtctatttgtttgtttttttgtgtgtgacagagtctcactctgtcacctgggctagagtgcagtggcacaatctcggctcactgcaacctccgcttcccagattcaagcaattcttctgcctcagcctctcgagtagctgggattgcagatgcctgccactgctcccagctaattttgtgtatttttagtagagacggggtttcaccatgttggccaggctggtctcgaacttctgaccccagttgatccgcccgcctcagcctcccaaagtgctggtattacaggcatgagccaccatgcccgtccaggaaaggtgttacaaatggttgcagtgtgtgatgaaggaaagaactggggctcgggaagggcgggactgtgaagctggaacacaggctggcggcagcagggaagagtttcgctggccaggctgacgctgaggcgatggggtgctgctgaaggacgtgaaagcagaagagataggtggtcagatctagacctgaggaacgacatcacccacgccaggtcggggatggaggtagccatggcaggcatgagcaggaggactggacccaggtgaggatggtggagacagagaggaggggagtggcctaaggtggggcccggtggccccttcttccaccctcagccagttcttttctacctgtgtgaccttggaatcccagacacccaccactcccccagcctttcacaaacattacacagtgtgtgtgtgtgtgtgtgtgtgtgtgtgtgtgtgtgtgtgtgtgtgagaatgcatttttttattatttctggacattttatttatttatttatttatttcgagacggagtcttgctctgtcgcccaggctagagtgcagtggcacgatctcagctcactacaacctccgcctcccaggttcaagcgattctcctgcctcagcctcccgagtagctgggattacaggtgcctgccaccatgcccggctaattatttttgtttttgttttgagatggagtcttgctctggtgccaggctggagtgcagtggcacgatctgagctcactgcaatctccgcctcccgggttcaagcgattcccctgcctcagcctcccgagtagttgagactacaggcatgcaccaccacgcccagttaattttttgtattttagtagagacggggtttcaccatcttggccatgttgtgatcctcctgccttggcctcccaaagtgctgggattacaggtgtgagccaccgcacccggtgcccagctaatttttgtaggccaatttttgtatttttagtagagacaggattttgtcttgttggtctcgaactcctcacctcaggtgatctgcccaccttggcctcccaaagtgctgggattatggacgtgagccactgtgcccggccttattttattattattttttttttgatactgagtctggctctgtcgcccagggtggagtacagtggcacgctcactgcaacctccacctcctgggttcaagagattctcctccctcagcctcccgagtagctgggattacaggcacatgccaccgtgctcggctaatttttgtagttttggtatagatgggttttcaccatgttagccaggatggtctcgatttcctgacctgatcctcctgcctcggcctcccaaagtgctgggattacaggcgtgagccatcgtgcccagccttttatttttattttttgtagagatgaggttttgccatgttgccctagctggtctcaaactcctgggctcaagtgatcctccctcctcggcctcccaaaatgctggaattacaggtatgagccactgcactcagcccgcatttttttttttattgtggtaaaatatatataatataaaatttaccattttaagtatacatttcagtggcattaactacatttacgttattttgcaacaatcaccaccatccatctccagaattgttttcatgtttccaaacggaagctgtgtctccatcaaacattagctcccattctccccaccccctagtccctgcaaccaccatgctactttctgtctctataaatctgactactctaagtacctcattgttagcatcatgtcctcaaggttcatccatgttgtaacatatgtcccaatggccttcctttttaaggctgaataatattccattgtatacatgtatatactacactttgtgtatccatttgttcgtccatggacactcaggctggatgtaccgtttagctatggtgaatagtgctgctataaacaagggtgcacaaatatctgttcaagaccttgctttcagttcgtttgggtaaatacccagaagtggaatggccggatcacatttttaattttttgaggaactgccatattgttttccattgtgtctataccaatttacattcccaccaaactttatgtttttgtttcccttttttttctttttttgagacagagtttcgctcttgttgcccaggctggagcgctatggtgcaatctccactcactgcaacctccgcctcctgggttcaagcgattcttctgcctcagcctccccagtagttgggattacaggtaactgccaccatgcctggctaattttttacatttttagtagagacagggtttcatgatgttggccaggctggtcttgaactcctgacctcaggtgatccatccatcttggcctcccaaagtgctgggattacaggcgtgagccactactcccggctaactttttgtttttcacttgaattttttgtcatcatatggagactggagatttgatatactatcaggaatgggatttaaacccaggtctgtgggaccccaacagcctgtatttgactgcatctctctgtccctacaggggttcagcttcaggccctggtaacgtttgtgaagacagagggtcggggaactgaagggccagcaccttcttacctgtggggcccctcagcacttcagtggtttatctcctgctctctggggaggggaagacaagaaaaaaggacaccatccttagagcttcacccagtggaagacagcaactcaccctggacctgagctgaggccggagtagccatggaaggaggagattcttgtcctgggtccccaaagtgctctcaactcaccctgcatcaggcaccagccacagggccctgggaaaccactcggggctggtctgccctgttggggtggagaaagggaactaggcaacagaactgaagcattggattagcagctcaggataccgccttcaaacaaggtagctggccgagcacggtggctcatgcctgtaatctgagcactttgggaggtcgaggtgggtggatcacctgaggtcaggagttcgagaccagcctggctaacatggtgaaaccccctctctactaaaaatacaaaaatcagccaggtgtggtggcgcgtgcctgtaatcccagctacttgggaggctgaagcaggagaatcacttgaacctgggaggtggaggttgcagtaagccaagatcacaccactgcactccagcctgggtgacaagagcgagactccgtctcaaaaaaaaacaaaaaaacccaaaccctccctcccccccaaaaaaaacaaagtagctaaggtagagagaaggaccttcccacttcggcttatctagacactatactgcacaaacacacctacaaaggaattccccaaaataggcagagaagttgttggacaatcaacaaaatgacaaatgcccctgcggtgcactgttttacatgcccaacagtcatctatatcctattctctgtcttcaaaaaacagcaacaacatatctggcctatgtagtatagtgagtctatccctctttctgtcaaaaatacattcactcggccgggcacggtggctcacgcctgtaattccaacactttgggaggccgaggtgggtggatcacctgaggtcaggtcaggaattcaagaccagcctggccaagatggtgaaaccccgtgtctattaaaaatacaaaaattagccgggcgtggtggtgggtgcctataatcccagctactcaggaggctgaggcaggagaatcgcttggacctgggatgcagaggttgcagtgagcagagatcatgccactgcactccagcccaggcaatagagcaagactccgtctcaaaaaaaaaaaaaaaaaaattcactctctccgaagggagacaagtcaaagtcttgctaattatcatatccactcccaagtctagcgtttctggatgatgtccattcctcctgcaattcccttatcatccatctcaacattttgcaacctatgaactgtatcgtaaagttaattactaccaatacaccctatgtacaggagcagagggaaataaagaagaatgaagaattaaaatctattaaaggccaggagaatggctcacacctgtaatcccaacactttgggaggccacggcgagtggatcacctgagatcaggagtttgagactggcctggccaacatggtgaaaccccgtccctactaataatacaaaaattagccaggcgtggtggcacgtgcctgtgatcccagctactcgggaagctgaggcaggagaatctgggaggcagaggttgcagtgagctgagatcatgctattgcactctagcctggacaacaagagcaaaactccttctcaaaaaaaaaaatctattaaaaatatactaactgagtgcagtggctcacgcctgtaatcctaacactctggaaggccgaggcaagcagactgtttgagtttaggagttcgagacagcctgggcaacatagcaagaccccgcctctactaaaaatacaaaaaaaaaaaaatagctgagcatgggtgtgcaacagtggtcccagcttctctggaggctgaggtggcaaggatcccaggaggcagaggttgcagtgagccaagattgcaccactgcactccagcctggataacagagcaagactctgttatcaaaaaaacacaattttctttttttaattcagctgggtgttgtggtacatgtatgtagcttcagctgcttgggaggctgagatggaaggatcgcttgagctcaggaggtcgagtctgcagtgagccaagatcgtaccactgcattccagactgggcaacaggagagaccacagcaagaagagcaataatatatggagaagctacaggccaggcgcagtggctcacacctgtaatatcagcactttgggaggccgaggtgggcggatcacctgagatcaggagttcgagaccaacctgaccaacacagcaaaaccccatctctactaaaaatacaaaaattagctgggcgtggtggtgggcacctgtaatcccagctactcgggaggctgaagcaggagaatcgcttgaacctgggaggcagaggtttcagtgagccgagatcacgccactgcactccagcctgggcgacagagcgagactccatctcaaaaaacaaacaacaacaacaacaaaaagaaataatttgaggcctaggattacagtacattccttcaggaaggatgttacttggtaccaaatatgcttgcttttgtcaggtaactgggaacatttcaaaaatgggtccatcttgggccaggaggggtggctcacgcctgtaatcccagcattttgggaggccaaggctggtggatcatgaggtcaggagttcgagaccatcctggctaacatggtgaaaccccgtctctactaaaaatataaaaaattagctgggcatggttgctcgtgcctgtagtcccagctactcaggaggctgaggcaggagaattgcttgaacctgggaggcagaggcttcagtgagccgagatcgtgccactgcactcagcctgtgcgacagagactccgtctcagaaaaaaaaaaaaagaaaaaaaaaatgggtccaccttaatccaagttcaaggctgagctttcctctccccctttcctggaccaaacagataataggattctgaactataagtccatggaaattgatttgtatcttacagcacatacgtgtcagtagtggggtatctgacttcctactttgagcaagctctgggtttttattttcgtccctccccacaaagactgccaaacaacagtttaacttcatggttatatcttccagatcagtaaatgcctccaggacaaaaactgcttcaaaagctgaacttacctctctgggttttagcttcctcaatgttggcacaataattcttcactgtactattagcttttcaatgcttttaagatttttttttcacttcctcttctttttttaatttgtcttcagagggaaggttggaatcaagtatctaatcaggagcctatctccccttacctacccgaataaaatattaagagccatcccaggggagttcctcggatttttctccctgcccccactgggtaatagcaatcttaagctttacaattggaattgatcgccccagccaacagtgggacccgctttttattttcttgcccagtggcatgtggagcgaaatatggcctactgacggacgatctgatcgtgatttagagaaacttactgcgccccctggtggaagcattattcccttgggtcttaaaagctctaaatcagccagagcgcagagttgagattccaagaatgtgcatgtaaaattcctactccgtgattcctgtctgtcagagaaacactatatatactgttttctatatagagagagtacctgttgttcggcgacgtaacatgtctttctttctttctttttttttttttgagacagggtcttgctctgtcacccaggctggagtacagtggagccatcttggctcactgcaaactccacctcctgggttcaagcgattctcatgccttagcctcccaagtagatgggattacaggcaccaccaccacgcccggctaacttttgtattttttgtagagactgggtttcaccatgttggcctggcttgtctcgaactcctggcctcaagtgatctgccagcctcagcctcccaaagtgctgggattacaggcgtgaaacaccacgcccagcccgtaacagcattatgtgtaatagctccaaactggaaataacccaaatgcccatcagcagtaatatggattaaacagcaatgtaagaactattaccacaaaaggacatgaatgaatctcagccaggcatggtggttcgcgcctgtaatcccaacacttcaggaggccagaacgcaaggaatgctcaaggccagcctgggcaacatagtgagaccctgtctctataaaaaaaaaaatcaaaaattagctgggcatggtggcgtgtgcctatagtcccagagaggctgaggtgggaggattgcttgagtcagggatgtagaggttgcagtgagccaagattgtgccactgagattttttttttttttttttgagacactgtctttttttttttgagacggagttttgctctattgtccaggctggagtgcaacggcacaatctcagctcaccacaacctccgcctcctgggttcaagcaatgcttctgcctcagcctcccaagtagctgagattacaggcgcacaccaccacgcccagctaatttttttgtatttttagtagagacggggtttcaccatgttggtcaggctggtctcgaactcctgacctcatgatccacccgcctcggcctaccaaagtgctaggattacaggcatgagccaccatgcctggctgacgctgtcttaaaaaaaaaaaaaaaaagattagtcagggtgtagtggtgtgcctgtagtctcagctactcgagaagctgaggtgggagaattacttaagcctgggaggtcgaagctgcaatgagccatgattacacgactgcactcagcctggatgacaaagtaagaccctgtcttaaaaaaaaaaaaaatctcaaaaatgtaatactgtagacaaagcattgtgggggctgaaaaaaaaaaggaaaaaattaatattgaacaaaagaagccaaattcaaaataggacatattgtatgattccattgacatacagttacacagacacactaatctttagggctagaagcatgagatggctactgaggtgctagtgatgtctttttcttcatctgggtagtggttacacaggtttgtctattttgtaaagatcaatcaagctacaattattttgcatggtatacctgcatcaaaccatctcgtgtacccataaatatatacacctacgatgtacccacaaaaattaaaaaattgaaaaaaattagtcaagctatgaacccggaaggcggaggttgcagtgagccgagatcacgccattgcactccagcctgggcaacaagagggaaactccgtctcaaaaaaaaaaaaaaaaaaattagtcaagctacataagatctatgtgcttctctttatgtatatttcaattaaaagtttgaatttaaaaatagtactaataataaataggctagctgcatataattggaaaggcagcttatgaacccagcatcaatagctttcagttcttttaggattgtttaagaaaaggttacatcagctggccaggcgtggtagctcatgcctgtaatcccagcacttgaaagcctaggcgggcggaacacatgaggtcaggagttcgagaccaacctggccaacgtggtaaaactctgtctctacaaaaaatacaaaaattagctgggggcacctgtaatcccagctactcggaaagctgaggcaggagaatcacttgaacccaggaggtggaggttgcagtgagctgagatagtgccactgcactctagcctgggctggaaggaagaatttgttaaggagcgacaagagcaaaactccgtctcaaaataaataaataaataaatataaacaaataatgttgttacgaacattcttgtacagctttatttttttttttttgagacggagtctcgctctgtcacccaggctggagtgcagtggcgcgatcttggctcactgcaaactccgcctcccaggttcacgccattctcccacctcagcctctccagtagctgggattacaggcgtccgccaccatgcccggctaattttgtttttgtatttttagtagagatggggtttcaccatgttagccaggacggtctcgatctcctgacctcgtgatccgcccaccgtggcctcccaaagtgctggtattacaagcgtgaaccaatgctcctggcctgtttttttttgttttttttttttaagagacaggatcttgctatgttgcccaggctggtcttgaacccctgggctcaagtgattctcccacctcaccctctcaagtagctgggattacaggcatgaggcattgcactcagcttcttgtacagctttcttgtgtgtatatccaggagtggactttgctgggtcatagggtatgtgtattttcagctttagtgattatatttatatatatatatatatatatacatatgtatatatatacatatgtatatatatgtgtatatatatatatgtatatatgtgtatatatatatgtgtatatatatatgtatatatattttttttcctttttttttttttttttcttgagatggagcctcgctctgttgcccaggctggagtgcagtgatgtggctccagtggctcactggagcctcaaactcctgggctcaagtgatcctcccacctcagcctccctagtagctgggattacaggcatgcaccaccatgcccagctaatcttttttctttttctttttttcctttatttatttatttatttattgagaaggagtctcgctctgtcgcccaggctggagtgcagtggcgcgatctcggctcactgcaaactccgcctcccgggttcacgccattctcctgcctcagcctcccgagtagctgggactacaggcgctcgccaccacacccggctaattttttgtatttttagtagagacggggtttcaccgtgttagccaggatggtctccatgtcctgacctcgtgatccgcccgcctcggcctcccaaagtgctgggattacaggcgtgagccaccgcgcccggccccggctcctgctcctctaaatattagaggcaagcctcgaaccggagctccgggatgcatgccaatctccggttgcgcctgcgcgtcgggctcccgtggggtccacgcatttcctacccggcccccgcgaacaggcgtaaagctctttcttcagtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctgtgagtggtcgtttctttctctcctagggcggcaggttttgtaaagggcctgggagtagggggcggtgggggaagggactaggcggagagagggacatccccgggaaagccatgttgcgactcctggtggggagggcaacaggagactccggagaagacgttgcgcttctttggaaacttgtggaggccctggtgggggcacactggagccccgacgggcggcatccctgcggggctgtgtggcctcagcgttcctcggggctgacggtttccagagcatggcgccctgcctgcacgcgagactcaccgtcccggtcctctcccgagacgcctcagtccggaggagcggggccgaggcccgggcggccctacggctggcccgccgcccaccccgccccgtcccgtcccgttcgctgcagcaacaggctcggcggcccctgcggagtgcactgcggggctggctgtttcagttccaggcagccccgtgatgtttgggaggatcttgggtggcaggtacctaagactacaaatattcttgggaagaatttatcgaggagcggatccagaagggaaggaacttcaggggagtgggccttggccccgtccagtagcagccatcaaaaacctgcaactggaccgaagccgttcaggacagcttagcctaaaggggcatctaggtgggcattcttcctattatacgataccattgtgctggtcagatttcaagcaaagttaaagttaatagctgttggggccatggacgctggcctatgaactgcttcctgtgagttaaagatgctttgggacttgatttattcctacagaagaatcagaatgagttttagattgggttaatgcatggtgggcgaatagagcttcttttaatgggtatgttgggcttggtgcaagggtgggaaaattgagtggtgtctagctgtccagtcagggtttttgcattttgactggatgacgaggtaaaggttcggtaactcttctaagggactcacagcttctcatctgtctttgtcgtggcctgagccccactcttcctaagagcctttttaaagagtaagttgcttctccctcctgcctgaagccttttctttgagaatgctttcccacttccattaagctaagtgcctttcctcctcttgtggtttgttttttttttttttaagttgctttctgctctatcctgctgtctctttcagccacccctcctcccaacgctattgtctttctctctgatctgcccactccagtttccccagctctttcttcaggctgacatttttctcaatttagaaatgacactgttgatctaccatttatccagttatccttcctgactcagatgttctttctttgtttccctgcgtctttgttgacttccctcatcccattgtaaggggatgttttacacaggtttctccaaaaataaaaaggaagattctcattgtactgggggagtatcagacttgcctaggttttgggagttaaacgtagtgaggttcttcgtgttggaagattttcctcagagaaatagggttgccagtgctttcaagttgtgtcataagtgaggggttgcccatttaaacagagcgtgacatcttgtttctctttgaaaaactgtagagattgtgagcatcaccagccactaattcctgaatgccagtaatgagaaaccaactctctcctcctcatttctagctgcacagggcctcagatcacaattaatacgtactcccacagaattatccctttaagaaggggcttctattcttccagttcatttggagatatggcacttctcttgattatagtgtgcctagtcttctgacagctgatgttatacattgagtacattgaggtcaggaccactagctcatcttttctttttttttatttttttagacagagtctcactgttgtcggcccgggctggaatgcagtggcacgatcttggctcactgcaacctccgcctcccgggttccagcaattctcctgcttcagcctcccgggtagctgagattacaggtgcccaccaccacacctggctaatttttgtgtttttagtagagatggggtttcaccatgttggccaggctggtcttgaactcctgacctcaggagttcacccgcctcggcctcccaaagtgctgggattataggcgtgagccaccacgcccggcccctcatcttgtatgacttgcatcttgtcctgggaaaagaattttcttatttgtaaatttctatcccttccgaatgtgatgtcagaaatgaaagtcttggctgggtgcagtggcttacgcctataatcccaacactttgggaggttgaggcaggcagattgcttgaggtcaggagtttgagaccagcctggccaacatggtgaaacctcatctctactaaaactataaaaattagttaggtgtggtggcgcacacctgtagtcccagctacttgagaggctgaggcacaagaatcgcctgaacccaggcggcagaggttgaagtgagctgatatcacaccactgccctccagcctgagtgacacttttaagactctttcttaaaaaaaagaaagaggctgttgggcgcggtggctcatgcctgtaatcccagcactttgggagtccgaggcgggcagatcacaaggtcaggagattgagaccatcctggccaacatggcgaaaccccactctaccaaaaatacaaaaattagctgggcatggtggcgtgtgtctgtaatcccagctactcaggacgctgagggaagggaatcacttgaatccaggaggcagaggttgcagtgagccaagatcgcaccactgcactccagcctggcaacagcaagactccatctcaaaaaaaaaaaaaaaaaaaaagaagccgggcacggtggctcatgcctgtaatcccagcactttgggaggctgaggcgggcggatcacaaggtcaggagtttgagaccagcctggccaaggtggtgaaacccgtctctagtaaaaatacaaaaattagctgggcatggtggcgtgcacctgtagtcccagctactcaggaggctgaggcagaagaatcgcttgaacccaggagagatcacaccactgcactccagcccaggcgacagagcgagactccgtctcaaaaaaagagagaaagtctttaagcgttcttactaggaaagtaaaataatagtatagctgtagctgctgattggttttgaaactttctaggcaaaatctagaggcagggcgcggtggcttacacctgtaatcccagaactttggaaggccgaggtgggcggatcatgaggtcaggagttcgagaccagcttggccaacatggtgaaaccctgtctctactaagaatacaaaaattagctgggcgtggtggcgcatgccactcgggagcctgaggcaagagaatcgttggaacccgggaggcagaagctgcagtaggcagaagctgcagtgagccgagattgcaccactgcattctaacctgggcggcaaagcaagactctatctcaaaaaaaaaaaaaaaaaaaaaaatatatatatatatatatatatatatatatagagagagagagagagagagagagagagagagagagagagagaacaatgttaatgttaacttgacatttcttggtatcggagccttaagtttttgttattgcttttttttgttttaagagacagagcctccctctgtcccccaggctgaagtgcagtggtataaccttggtttactgcaccctcaacttcctaggctcaaatgattcccctacctcatccgccccaggggctacgtggaaccacaggcatgcatcactaagcctagctgatggtttttttgtttgtttgttttgttttttttaattttattttttttgagacagagtttcgctcttgttgcccaggctggagtgcaatggcgcaatctcggctcaccgcaacctccgcctcccaggttcaagcaattcttctgcctcagcctcccccgtagctgggattatggtcatgtaccaccacgcccggctaattttgtatttttagtagagacagggtttctccatgttgaggctggtctcgaactcctgacctcaggtgatccgtccacctcagtctcccaaagtgctgggattacaggcgtgagccactgcgccaggccttttttatttttattttttaacgttttgtagagatgggatctcactatgttgcccaagctggtctctaactcttggtctcaagagatccaccagccttggcctcccaaagtgctgggattataagcatgagctactgtgcccggcctcccttaagttcttaagagctcactgtcatgctgtcttgttctctcttcatgagattctccccccacacttcagtgtttccttcccagcccttttacccccaagactgtttgcctgccttatgtagctcacaagagccctgacagaacatctctcattcattccccgcaaaactgtttccagcctccttgctctgactttgcagcactcgccagcctggccctgccttccatttgacttccagtgtccgtatcaattcccatcagcagaaacaaaggagctgccgcactcaaccttgtttatccaattttattctgtgtggtgaagacgtggctgcctcctaaaggcgagcccacagaggcaaggctgccttctccattctgctctccaacgtgagattcgtgcctacctcagattacagtcattacagctcattgaatcacgccaggctatatttgtggcattgccgtctctgtgtgtcgtatgtgtcttttttacttgctgggcacatgctaagttatgcagtggtctattgtggctgctcactgaaggaccctgtcacattctagagcagggtttgttggtgtagcccgagttacggacagaaaccacagagacttaatctgtttgctgtctcatccccaggctgtttcttgtaaaatcctgatatgtcaaagctcatttggtccaacctcctcaatctatagaagagtaaccaaggtccacctgggctgactaagtgtccatgttcgtgtgacttgcaggcaagccaggtctttttactctcaagtcaagtctgactgtatctcagacatcgtcatgagtattagggatactatgagaaataaatcaattctgcccttggtttaagattgattgacgccaggtactgtgacacatgcctctattcccagatacttgggaggctaaggcaggaggatcacttgagccaggagtttgtgtccagcttgggcaacatagtgagaccttgtctcttaaaaaaaaaaaaaaacaagattgattgaatataagatcgagtttgttaacctccattaccaaagtccttgttaaaccctgcaagatgagaacaagataggttctatatacacgcttcttagaaccagataactcctggcactgtgcagttttccagttttccacttaaagatttacccttgattcagatttcaaattgagtcttttgagaccaagaagattttttcctatataattttattttgtgagaatggagaagaaccctaagatgggccttagagcaaacaagtttcttatgagtgatggtgctcaataaaagcttcaaggaacttcaggtacttgtagacatcttccataaatgtaaaattaattagttgattaaaaacctagttcaaaattcaaaagatataaaaaggcatatggaaggaagtggcctagtcacccactttttctccccgctgacctgcagtttcttttccattttgttacataaatgatagttttatttgacgcttctcagcagtgtaccttgctttgctttttgtccctagttaacttgaaattgtttaatatcagtatgtgaagagcttccttcttatggctaagtagaatttcattgtatggatttaccatagtttgctaaatacattttaataagtcccctagactttgaactctttccctctggagcagaccttggggcaaggatgtgggagcatgtagtttatttgggaggtgattctaggaaagagggaataaggaggaacttaggagggactatcatctgcttcttagcctcataagggttaagagaaatagcatcttaactagcacaggggtgggcttgtgagacacgtggagtgaacattctttcacctctttgggggttaaacttaagtctgattagacatatgatgaaatcatgtgttcctgatggtaatttatttgtaaagtaattcctcatgatggcctagaaaaggggcttcgtgtcccatgaggcagaagtggaggcaaatagaacggaagagacagccacccagtcccttgagccttctagagaagcagatggcaggggagaggaatagctcagcaccctatgccccccgctccaacatacacgcctgatttctatcttccctgcagccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggtgagggtccagacttgggagaaggggactcaggagcataaggaggaagaagcctcctcatcttaggtgatgagacagttgatagggttttccctactgccttccacctatggatgaatatggtcttcctgtgattagaaacccagggaggatgaagcagatgtttgataccagcatctttgttttctgccctgctgaggccattgtgtgtctggagaactatgtgttagccaaggccctgaagcttatatatctatttttcttttccacagactattccacctaaccccctaggccctcactgtcagaatttctcccttgctctagaactcaaaggggggcctacttaattagaaagtgtttggtattactttctaatactgggttagggcctgacttctatctttcttcctgccacaggattggcctccggacagctgtactcctaccctgcccggcgctggcggaaaaagcggcgagcccatccccctgaggatccacgactttccttcccatctattaagccaggtaaggcacatacttcctgagcagaggcgtggcctgctgcatggtgagagcctgctaatcactgtgatataccaggcccagtactagatcccaaatatactcaaatgaatatgatgtgattctttcctttaaggacctcagtctagaaggggagacaggtaaacagataagttatggtgccaagtgaactagggtgtcttaattcctgggcgtgcagagaacaaaagatagtgacagacctttggtaagccccagcattatgtggactcagagcagtctgctttcagcccttttgagccttgctttatcctgaccttgcttgcagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaaggtacaggattatccctgtggctaagggagctttgatggaaatcagcctcctcttcactgggggccacctagtttctagaactgaaacagaagctggagtccaggaagcaggcccctgcagttctgttcttacttcagtccctgattattgtcaggtactgactggcttctctgttgcttctaactatagactctcattcattcacttttatcacagaaggttattattatacacatatataattttcattaaaaaaattaaaataggccagatgcagtggctcatgcctgtaatcccagcactttgggaggccaaggcaggaggattgctcaagtccaggagttcgagaccagcctgggcaacaaagtgagaccccatctctacaaaaaaataataattaaaaaaaaatagccaggcatagcagcatgcgcctgttgtcccagctactagggaagctgaggtgggagaatcacttgagcctatgagttcgagactgcaatgagtcatgatcatgccactgcactccagcctgggcaacaaaaaaaaaaaattaaaaccagaaggtgcaagaatagtacaatgaaataccacatactctttacctagatttatcaattccacattttgccacatttgccttatctgtctttgctaaactatttgagaggaaacttcaaaaacttttcagtctaggcaacatagcaggaccttgtctctactaaaaataaaaataaaaaattagctgggcatggtggcacacgcctgcagtcccagctactcaggaggctgaggtgggaggattgcttgagcccaggagattgaagctgtagctctgcttatgcctctgcactccagcctgggtaacagagggagaccctgtctgggaagggagggaaacaaacttttatccctaagtgctttactcttttatcacaaaagtttgtgtcacagttttttggtccctgaggttacacagtgaagcacacttagtctctgccaacagagaagataagaatacatgtaaaaataacagctataaatatgccagcattgggttaagtgccttttcatgccctttctcctttagtctgtacaaccttatggggtaggtcctgtgttccccatttcacacagaggctgaaacaaagcagtttaaaaacttcccatgggtcgggcacggtagctcacgcctgtaatcccagcactttgggaggccgaggcaggcggatcttgaggtcaggagatcgagaccatcctggctaacatggtgaaaccccgtctctactaaaaatacaaaaaaaattagccaggcgtggtggtgggcacctgcagtcccagctactcaggcgcaaacccgggaggcagagcttgcagtgagccgagattgcgccactgcactccagcctaggtgacagaacgagactccatctcaaaaaaaaaaaaaaaacttcccatggccggccacggtggctgacgcctgtaatcccagcactttgggaggccgaggcagttggatcacctgaggtcgggagttcgagaccagcctgaccaagatgaagaaaccccgtctctactaaaaatccaaaattaatcaggtgtggtggcgcatgcctgtaattccacctacttgggaggctgaggcaggaggatcgcttgaacccaggagacggaggttgcggtaagccagtattgcgccattgcactccagcctgggcaacaagagcgaaactctgtctcaaaaaaaaaaaaaaaaaaaaaaagcttcccacaaggtcacacaaataagcaacaacattttaatttaaactaggaggcgagtgtcaggacagaaccaccaataatgtgctcccagggtggccaatcagaggcaggagagggcatggctgcttgtggcatcagggcaaccttttggaagcatgctatttgatttggccatgtggcatggtggggaaagcatttcaggctaaggaaataacgtgaagcacaggggaaagatatcccaaagtatggaagggagcaggagcaggattatagcatgcttgaaaggcgttggtgaggaatgaggctggtgtgggtgggaccacgtcacagaggaggttctgggtggccttggccagtctcatcataggggagcttttggatgcacatatttctacccatgctaaccctcctgtccactcagcggatcctagaaccagatgacttcctggatgacctcgatgatgaagactatgaagaagatactcccaagcgtcggggaaaggggaaatccaaggtgaggggccagcgtgctgcctgcatcttgggacagggtggcctagggaattccttattttatttcaagtgagattagcggccacttccaaaagagtctaactcctcaggcccagctaccaaaataagggtgtctctttgctcttcttggcagggtaagggtgtgggcagtgcccgtaagaagctggatgcttccatcctggaggaccgggataagccctatgcctgtgacagtgagtgcctcacaagtgggtgggtagaccttgccttggacccagctcctgctctggatatgagaggagggagggttgtgtttttgcccagagtattaaaacaaacctgggctcttgtcctgcctgctgactgcttccgtctgagacccctgggaggcctgggtccctgctatatgacgggtgggacctgcatgctctgggaaagatttctgccatcctctggggtagggttgcttgtgggggccacagcaggcagggttggcctctcaacagatggcctgcaggtctcctggcctcagttaagccagggccccaggggtctgacactgagtttttcaacgtctgttctctttttctttctgtctgccttgccccacttctgtccctccaccctgggagcaccatcgccgctggggtttctctctcgtttgctctgctttcctgctgctgctgctcctgtctcaagtgtatcaaggccttcttctcatgacttttctttctgtctttcagatagtttcaaacaaaagcatacctcgaaagcgccccagagaggtagctctctcaacttttcagacttgtggttttcctttccctttttccctcttcccttgttcctcctgcctttctcatttcctgggatgctagctttaaaatctctggaatggcatgggggtaggagcagtggaatttctgctgtgctctactcctcaaagtcctgaaggctgcctttaccactgcttgtttcccacaaacctgctcctagagctgctcggcccagtgcatggggtggcttcagaagcattatcaggagcccattacaatcagacccttccgctccctccccagaccaggcagctggtggtcagctcatgttccccactgccccaccacctcctcctgccatcctctctccccactcctttcctgctggcccccttgcccttcttggtattacttctcaagatgacaaaatgcctcatggggatctgctttccttgctgattggcaggcctggacagggcaattacatgggagtgtgcttgaatttctttggggaccaactgcccaactggcttcattgataggctatccccaagaaacccatcccctgcttgtttacccacattcaggggagatgggctccatggtgtgtggggtagcatgagcctcccacatttactgaggggtaaaaaagtttggagtcttatccacttttcccccttcctgccaccccaaagatataggaatatccttccctttcctgacctggagcgtcccagactgttagtatatcccagagcaactaactggtgatggggcaagggctaagccccccaaaagtcaacatggaagagcagtggtggccatggggttggagttcaggagggaaaagagccccagaagctagagagccccacggcctgatgctcctggctgaggggaagtggccgtcactcaaggcctgtcccagagtggagctgctaggggaagggatggttgccctctgcctcaggtggagcccccacagcttgcagggatggggacatggcactcttgtatcctaacacctttctctgcaatcttcttcccactcagtttgtggaaaacgttacaagaaccgaccaggcctcagttaccactatgcccactcccacttggctgaggaggagggcgaggacaaggaagactctcaaccacccactcctgtttcccagaggtctgaggagcagaaatgtaagctgaggtgtcagaagtggtgggcaagcagaagttggcctggttatgaaaaccactccttgcatgggtgttgagtggctcagggacccccatgggtgtcatcaaaactctttctctctgtagccaaaaagggtcctgatggattggccttgcccaacaactactgtgacttctgcctgggggactcaaagattaacaagaagacgggacaacccgaggagctggtgtcctgttctgactgtggccgctcaggtactgcttcccgtgaaggctgctgctttgcccagtccccaaggggctcttggcttgctggcctctagggctgtcataaccagcccacctcgcttttcctaaccaagagaagatgtagccacaggcaggagctcctctcttccccccgcatttccgactgtctgtctcactcacttcccccactacagggcatccatcttgcctccaatttacccccgtgatgatggcggcagtgaagacataccgctggcagtgcatcgagtgcaaatgttgcaatatctgcggcacctccgagaatgacgtgtgtatccccgccccctcctcagcatggctccttctgggcttttactgctgtttgcacagttccctctaaagtgagctttcttttaaaaagggagcaggatccctcccacatgccacacgcccctccctagcatctcagtcagaactctgatttgttgccagatatatattgagtgctgattttatgtcagacactgttctagtcactaaagatgctaaagacaaacaaggtccctgcctcatgagatttacattcttacaggaacaacaataagcaaggatgtaaatgagatttgtataatgtgccatgaaaaaaacgaaatcagtactgtggcagagaataattgcataagtgatttattttgatggtcaggtatggctcttctgggagggtgatgctggtgttgaaattttggtgataccaaggagccagtcaagatttggaggtagaggaatcccaggaaaggagcagccagcgccaaggccttatgttggacaagccagatgacagggcatgggagagtatggtgggcaatgagatgagagaggcaagcactgccagatctctggggcctcgggttttattctaggtacaacaggacactgttgaagggttttactcgggaagtgacatggttatttatgtatttatttatttactttttttttttgagatggagtcttgctctgtcgcccaggctggagtacagtggcacaatctcagctcactgcaacctctgcctcctgggttcaagtgattctcctgcctcagcctcccaagtagctgggattacagacacgtgccaccacacccggctaattttgtatttttagtagagatggggtttctccatgtttgccaggctggtatcgaactcctgacctccggtgatccgcctgcctcagcctcccaaagtgctgggattataggcgtgagccactgcacccagctatttatttattctttatgtatttatttatttattttgagacagagtctctctgtcatccaggctggagtgcagtgacgcgatcttagctcactaaaacctttcccttcaggctcaagcagtacaatcctcccacctcagcctcccgggtagctgggaccacagatgcacaccaccatgtctggctacttttttatatttttggtagagacagggtcttgccatattgctgagctggtctcaaactcctgagctcaagcagtcctcccaccttggcctctcaaagtgctgggattacaggcatgaacccaccatgtctggccttgtcttatattttattttatatttatttatttatttcaagatggagttttactcttgtcatccaggctggagtacaatggcgcaatctcggctcactgcaacctctgcctcccaggttcaagcaattctcctgtctcagcctcccaggtagctgggattacaggcgcccgccaccacgcctggctaatttttagtagagacggggtttcaccatgttggccaagctagttttcaactcctgacctcaggtgatccacctgcctcagcctcccaaaatgctggtattacaggtgtgagccaccgtgcttggcccttgtcttatattttaaaaagatgactttgggtgccgtgtggagggtagactgtagggacaaggatggaggctcatgcctgtaatcctaacacttgagaggctgaggcgggaggatcacttgagcccaggaattcaagaccagcctgagcaacatagggagatcctgtctccacaaaaaaaataaacacttagccaggtgtggtggcacacacgttagtcccagctacttggcaggctgaggtgggaggattgcttgaacccaggagtttgaggctgcagtgagccatgatcacaccaccgcactctagcctgggcaacaaagcaagaccttgtctcaaaaagaaatagtcactgggcacggcgtctcacacctgtaatccaagcactttgggaggctgaggtgggaggattgcttgagcctgggatttcaggaccagcctgggcaacgtaaggagatcttgtctctccaaaaacattgaaaaattagctaggtgtggtggtgtgtgcctatagtcccagctacttgagaggctgaggtaggaggatcacttgggcccaggaggtcaaggctgcagtgagccgtgattgcaccactgcactccagcctgagtgacagcaataccctgtctcaaaaaaatataccatagagcttgggctttagggaaaaaaaaaaaaaaaaaaaagtggaggtgatttgatcaattaggagctctgaaaggacccaagtgagaaatgacagtgactggatctgcggtggagaggggcagcatggtttcccacataagattctcacatctgttcttacctgctacctacccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggtaagttgcccagatcttttactcagaacaattactttattagttacttggaaaatactgagttctatgttctttatgttatcacttacatattcttccaaattagggagtaaagcaccttgccttggctcagtttagaatgccttcctaacatttcaacttaaagggtttagtgtttgcacattatcagctacatttacaacagaaaatcaacagcccagaagaaagcagatgctgagccgagatcaggcacccagaaggaatgatttattttcttccaaccagtccagaaaactcaagtggtagattatctgatgtgaaacttctgcagtcaactcttgaaatttgatagatttgagcatttatttcctatcccttccccttctgaactgggaagggacttgactttggagcctgaatgggtcagtctgcttctccgataacttactgtaataatggtccaaatttattaaagctattcactgaaaccagtggtggcaccaagaattggttgcatctccacaagtccccttccagctggatttctgtacataaacacctcctgtacagaaattgagtagcagctgggcgcggtggctcaagcctgtaatcccagcactttgggaggccgaggtgggcggatcacgaggtcaggacatggagaccatcctggctaacacggtgaaaccccgtctctactaaaaatacaaaaaaattagccggctgtggtggcgggcgcctgtagtcccagctactcaggaggctgaggcaggagaatggcgtgaacccgggaagcggagcttgcagtgaaccgagatcgcaccactgcactccagcctgggcgacagagcgagactccatctcaaagaaaaaaaaaaaaaagccaacagaaattcagtagcttactcagaacacaaatgcccaggagctgttactgtgcacaaaggatgtgggccagcattacaggcaagagaaagtgtttcattgtgtgatgtaagctgacttgtaacatatcggtcaaactgctgtcacccctctagagaatgaggcccctgacaatgtctaagagtcctttagcagctgtaggggagtactcagcttctgtcaggcccagtttatgaatctgctttggggagaagtcgcatgtttatgttttgttttgttttgtttttttaaaccatcaaacagatgatctatgttacagaatggctttcctattaaagttctgtgggacatcgaggtagtggagagctgcaggcccgagtgtcctcactgtagtgttaaggcagctgaggggcaacccctagaagtatcagatgttctaggtcagggtcagcaagctacaagctaaaacctatggaccacatccagccacagccagcttaaatagcttgcaagctgttttgttttcttttcttttctctttttctttttctttctttcttttttttttttttttttgagacagtgtcttgttctgttgcccatgttggagtggagtggcatgatctcagctcactgcaacctctgcttccccgggctcaggtaatctggtaatcctcccacctcagcctcctgagtacctgggactacaggcatgccaccacacccggctaatttttgtatttttagtagagacggggttttgccatggtgcccaggctggtctcgaactcctgggctcaagtgatccacccacctcagcttcccaaagtgctgggattacaggtgtgaaccactgcatctagcctgaagaaaatccccttaaaaatataaaaactggctgtgcactgtggctcgcatctgtaatcccagcactttgggatctcttgagcccaggggttcaagaccagcctgggcagcatggcaaaaccccatctttactaaaaatagagaaattagctgggcgtggtgctgtgcgcttgtaatctcagctactatagaggctgaggcaagagaattgcttgaatctgggaggcagaggttagagtaagctgagatcacactgctgtactccagcctgagcaacagagcggaaactcttgtctcagaaaaaaaaaaaataaagggagttaaaaaaaaaatgcatgagactgtatgtggctcacacaccctaaaatatttaacactctggctctttacagaaaactttgccaaccgtattgacctttgggttagaaaggacttacatttttgagtcacctgtttctgaagagctgataaaagccctagaataatgtccaaatgcgcataggtataattttgcttatcatttcaaggcattaaggactaattttattcaaaaaaaattagaagaattcagccatagtcaatattaataaacaaggaatgacccaattgtttttcatataagggacaattattttgtgttttttagtgaaactacacaagtcttaaaactgaggtgcttgacaaacttctgtcttcccaggccctcttcctactcccaaaacttctgatttaatagggccaagagggcctgggcatcagtattctgaagtcctctagatgattatttctttcatctccatagaggatgatatttcataatatttgaagacttagaggtttatcccagctcaggaaaccatggaactttcctgctgcagagcatccctcgtcctacctgtagctgatcctgctatagagatggggtatcaagagcagaggaattgcaagcaggtggggattgtgtgggacccatcctgaccccattttgcctctctgcaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagatttgaatcaagcagttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgagcggagggagcagcgaggctggagagcagctgggctgcgggtcaagacgtctgcgtttaattcgggactgaaggttagcagggaagggaacgatgccagatcttgagtttaagaacttgaatcttgtaaagtaccaaatctaataaaatactcgtcctaaatcattactggcccaagcatgcagtgtttccgtggccgacagactcgagccagcgctgtccatggtaaccagcttttgtgtggcttaaagcttgcatccattttctcctttcatcgttttcccaaaacaattccgtgagggctgttagccctgcttggtagacgaagaagccgatgcggtctagggtcacggccagggaggctttgggacgccaagtcagctcggcggtcaccacaccacctacagggctcgtcgggccctcggggtcggcggctgctggaggcgcccaggggagtcctgctggttcctggctccgcctcccgcccctccgcgctagaagccccgcccccagaggggctcgacgaaccgccacttccgcaacgtccaatgaaacttagccgggggagggacggggcgccactgaggaccaatctgcttgggccggggcggggctgcggcgggtgggtgcagaggggccgcaccgcggacttcgcagccgggagagagcccggcgcgggcggcgcgcacgggactctgctgtgcgcgcgcccgcccgcccgccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgggtgcggagcgggaggccgggcgggcgggcgcctggggccgccccgccgacatactccgggtcgagggggagtgaccggccagggcacggagtccggctgccggcctgcctgggtccgggcgttcgttcccgcgccctgggaccctcccaggccaccaccctccccgcggggacaccccgcccctccgctgcccgcagcctcctcaggcctcccgccctttgtcgctcgtgcacctgcgccctcggccctgccctctcgctcccctcaggactgaccgtcgcctagcctccctctcaggacccggcaccaaattagcctcgctccttcagacaccctctgtcccctttgtcgtctgtacacctgtcacctcaactctgtgtgcatccacccacctcccaccccccagcggcgtcatctgaatccagcccaagccgcctcccactccctcccgggggctcctcccccgcagccccgtagccccacacctgccccctcggccccagtcccaggccctcccccgtccgtatgcctttgttatctctgcagctgtcccctgcacttttcatccttcttcccgagtgaggccagaccccagcccagactcccctgtccttctgagtggagagacgccccctccccagctctgccctggcatcctggggacggggccagccggcttccactcggcctagccacttcctctttcagcgggtccagtctcacccggtgcctgcgcaagtcctcatctaatctcttttccctcctgcgctcctttcctagctcttccggcctcagattactctacccgctcaatctttcctccccgcacaggtgccccggagaggccatggagctgagcagcaagaagaagcttcacgccctgtccctggccgagaagatccaggtgctggaactcctggatgagtccaagatgtcccagtcggaggtggcccggcgcttccaggtttcccagccccagatctcgcgcatctgcaagaataaggagaagctgctggcggactggtgcagcggcacagccaaccgagagcgcaagcgcaagcgggagtccaagtacagcgggatcgacgaggctctgctctgctggtaccacattgcccgggccaaggcctgggacgtgacggggcccatgctgctccacaaagccaaggagctggccgatatcatgggccaggacttcgtgcccagcatcggctggctggtccgctggaaacgccgaaacaacgtcggctttggggcccgccatgttcttgcgccttcattcccccctgagccacctcccccggggctcacatcccaggctcagctgcctctttccctaaaagacttctctccagaggacgtgtttggctgtgctgaattgcccttgctgtatcgggcagtgcccggcagctttggtgcatgtgatcaagtacaggtgctgctgtgtgccaacagcaggggcaccgagaagcggcgggtactgctgggtgggctccaggctgccccgagatgcttctttgggatccgcagtgaggctctgcctgcctcctaccacccggacctgggcatcccctggttagagtggttggcacagtttgaccgggacatgggacagcagggccgacaggtggctttgctgctggctgcccgagtggtggaggagctggcaggcctgcctgggctctaccacgtgaagctcttgcctctggccgcctctagcaccacgcctcccctgcccagctcagtggtccgggcctttaaggcccattaccgacaccggctgttgggcaaactggctgccatccaaagcgagagggatggcacctcgctggccgaggccggggcaggcatcaccgtgctggacgccctgcacgtggcgtctgccgcctgggccaaggtgcctcctcagctcattttcagcagcttcattcaagaagggctggctcccggcaaaacgcccccgtcctcgcacaaaacctctgagatgccaccagtccccggcgggctgagcctggaggagttttcccgctttgtggacctggagggtgaggagccaaggtctggagtatgtaaggaggagataggcactgaagacgagaagggggacagagagggtgcctttgagcccctgcccaccaaagctgatgccctccgggccctgggcaccttgaggaggtggtttgaatgcaacagcacttctcctgagctattcgaaaaattctacgactgtgaggaggaggtggagcggctttgctgcctatgaaggcgccttcactgcttgccagagccccttcctctcttgtttcccatggaaacggcctcttcagaaggcagatcgggctgtctctttcctgtggaaatagaactgtcgtaaaggtgtagaagggagagaagttgggacaccaagtctgagcttggagtggcagtcgtccaaaccccaggaagagagctctaaagatggggcttcgggggtaggaatccaggatgcttagtttctagaccctgcttgaaagttctagagcctttgaaagggagttagtctagaggcagccacttagaaaggtggaatttgggctttttggacagactgcttccttgaactttgtgttaaaaacagttctgcttctgaaaataaagtttttaatcagaaaagaggccagggtgttattttcatgggagaagggtaaacattttccattcagatttggaaaattaattgctgatggtcactgcggtgcagctgtctgtccatgaccagtagggatcctccttttccagatattcagcagcaaggactctcagggtgtgggcactgcttgtgggctaccctcctgagagggaagctccaggacagacagatcccagctactgccccagataagctgcagctccaatagtttcgctctcagattgtgtgtgtttggggttgggcaggctacggacatgtcagggaaacagaaaggagccggaattggaatggaatagtcattcattctttcttttttttttttcatttgcttatttcacaacatcacttcagcaagacctcctatgtgaacaaggttgcaaagatgatgtctcttctggacagaaccttgcagccaatgacagtggagtgtgattaaggctgtgataacggctgtgcaaagtgcctggccccatagagctagggagactccagggggaggtgagctttgagctgcagtttgaagggcgtcccaggccaagggacagcgtgtgcagagtctgattggagtgaaggagcacagtgtgctgggggcgggggcaggcagttctgccagagcatagcatacttgcggaggtaggggcagagtacaaggagagacctggagagtaggaagggcctttagccaaccaggcttaggggtaggacaccatcagagggttttaggtaggcaggaacaagtcattcttggggttctagaataacggagtctgtgtagggtgtgtcaaagatgtgaaacctagaggcagagagcctctgactgatccaggtgagagaaggtgaagcgtgagccagatcctgggagtaggatgtaaagaaaatggtttaccagcagggcgcggtggctcacgcctgtaatcccagcactttgggaggccgaggtgggtggatgacctgaggtcaagagtttataagacctgcctggccaacatggtgaaaccccatttctactaaaaatataaaaactagccgggcgtggtggcacatgcctgtaattccagcttctcaggaggctgaggcaggagaatcgcttgaacccgggaggtggaggttgcagtgagccaggatggtgccactgcactccagcttgggcaacaagagtgaaactcactcaaaaaaaaaaaaaaaagaaaagaaaagaaaatggttttacctggaaaggatatgggctttggacgcagatagactctagctggtaaaaatacaagctgcaggccgggcacagtggctcatgcctgtaatcccagcactttgggaggccgaggctggtggatcactttaggtcaggagttcaagagcagcctggccaacatgatgaaactctgtctctactaaaaatacaaaaattaaccaggcgtggtggcacacacctgtaatcccagctacttggaagactgaggcagtagaatcgcttgaacccacgaggcggaggttgcagtgagcggagatcgcaccactgcactccagcctgggtgacagaatgagactccgtctcaaaaataaaaaaataaaataaaaatactgtctgggcacggtggctcacgcctgtaatcccagcattttgagaggccgaggcgggtggatcacctgaggtcaggagttcaagaccagcctggccaacatagtgaaaccccgtctctatcaaaaatacaaaaactagccaggtgtggtggcgagcgcctgtagtcccagctactcaggaggctaaggcaggagaatcgcttgaactgggaggtggaggttgcactgagccaagatagcgccactgcactccagcctgggcgacagagcgagactccctcttgaaaaaggaataaataaaataaaaatacgggctccaggccaaaatcctaagggtgacctttcaggcttcaccattggcagtcacaagacttttgcctggcagtcctcatggagggaagctgctctctcaccccagcttggtgcatcgcctgtgcattgcaggtttccggagagagttgcagtcaaggactccaggcccccagactgccctgttcctaagctcacctgcattcctagctgggcacctccatttggagacctgggctgaggcagtttccaacagcctttaccaagacctccttactgggagcaatgactgagatcctttctccgcttcgactcaatacctctcattccatcctttctccgctttgacgcagtacctctcattctatcctttctccgctttgactcagtacttctcatttcagcccttctcccctgcctccctacagcccacttcaggtcaggtctgtaaaaaggcaggagcttttattctttttattctgaaactccttgacgatgagactgttcctgtctgacccttgtcccgtgctgctctgtaaaatggaacgctggggagctggggcctgtttttgccccttgcttgtaggttttagtgaatgaaaagaagcttttgtgttactttcagcttgcttcgttgtcctaattgaccaactccacacctggcagctcgaactaacaactccctttcaaacacttatgaagccacctgcgggcctatcattttctaggctgagatcccaaatcatttagcctttcctcacagaagtctattttttctaccctgaattcatataaattgttcttttctgaaacctttccagttctgatgtatctcattttattttattttattattttattttattttattatttttgagatggagtctccttctgtcacctaggctggagtgcagtggcacgatcttggctcactgcaacctccgcctctcgggttcaagtgattctcctgccttagcctcctgagtagctgggattacaggtgtctgccaccatgcccagctaatttttgtatttttagtagagacagggtttcaccatgttggtcaggttggtctcaaacttctgacctcaggtgacccgcctgcctcggcctaccaaagtgctgggattacccaggcgtgagccactgcgcccggcctatttattgtttgtttgttttgaaatggagttttgcttttgttgcctaggctggagtgcaatggcacgatcttggctcatcacaacctctacctcctgggttcaagcaattctcctgcctcagcctcccgagtagctggaattacaggcacccgccaccacgccgggctaattttgtatttttagtggagacagggtttctccatgttggtcagactgatctcaaactcctgacctcaggtgatccgcccaccttggccttccaaagtgctgggaattacaagcgttagctactgcgcccagcccatatctctttttattttattttatttatttattttttgagacggagttttgctcttgttgcccaggctggagtgcagtggcgcgatcttggctcactgcaacctctgcccccaaattccagtgattctcctgcctcagcctccagagtagctgggattacaggcacgcgccaccacgcccagctaattttgtatttttagtagagatggcgtttctccatgttggtcaggctggtctcaaactcctgacctcaggtgatccacccacctcggcctcccaagtgctgggattacaggcgtgagccactgcgcctggccctatatctctttctaaatgttgaaatcaaaattacaggctgggcgtggtggctcacacctgtaatcccagcactttgggaggccgaggcgggcagatcacctgaggtcaggagttcgagaccagcctgaccaacatggagaaaaccccgtctctactgaaaatacaaaattagccgggcgtggtggcgcatgcctataatcccagctactcaggaggctgaggcaggagaatcacttgaacccgagaggtggtggttgtggtgagtcgagatcacgccattgcactccagcctaggcaacaagagcaaaactccatttaaaaaaataaaaaaatacacaatctctacaggtcttaccaaagcaacagagagcagatagattagctctctgtcctcaggtgtcccactcctgtcaaagtagcagaatataacacaatgctgtacagctggcctcttcccggagctttttaaaaagagccataattaatctcttccttccttgaatcgctatcatatggcagacatttcccaattgcaggtaacttcatctgctcgtgcaagcagtattcccgaatgcttagcttgtggctcaggccctgttctgggaccttaaagtcaatggtgaacaagacagagaggatcccgtctgtcagggcccttactttttttgttgttgtttgttttttgtcttgttttgttttgctgtgttttttcagacagagttttgctctcgttgcccaggctggagtgcagtggcgccatctcagctcaccacaacctccgcctcccgggttcaagtgattttcctgcctcagcctcctgagtagctgggattgcaggcgtgcgccaccacgcctggctagttttatattttcagtagagacagggtttctccaatgttgatcaggctggtctcgaactcccaacctcaggcgatcagcctgagtcggccttccaaagtgctgggattacaggcgtgagccaccatgcccagccaaggcccttactttttagaagagggagagcaagagcagacattaaacccatgagcacagtcatttcagacagcgaaaggtgtcaagatgaaaataaaataatgatgtcagagagagtgacagggtgcgtagtcaggaaaatgacctgtgagctgcgttgtgaatttctctgcaaagggaactgtgggtaccaatccaggtggttagaaacagcttcacagggttaagaaacagaaagcagtgcctgtggccgcaagtgagggaggccaaggaggggaggaggtcagagaggtggacaggggcctttcaccagggagtgtttaggttgcattctaagcaaaataggaagttggtttgccttttttttttttttttttttttttttttgcagggtgggttggggctgtgtggttcagataaaggaggaacaagatatgtttttttgttttgttttttgtttgagacgaagtctcactctgtctccagggctggagtgtagcggcgcaatctcagttcactgcaacttctgcctcctgggttcaagcgattctcctgcctcagcctcctgagtagctgggattacaagtgcccgccactacgcccagctattttgtgtgtgtgtgtgtatttttagtagagacagggtttcaccatgttggtcaggctggtctcaaactcctgacctcatgattcgtccatctggggctccaaaagtgctgggattacaggcgtgagcgatcgcgcccagccgcaagatatgtttcatgtgtgtgtttttggttttttgttttttctttaaagacagagtctcacttgggtgcccaggctggagtacagtggcacaatcatggcccactgccacctcaaattcctgagctcaagcaaccctcacttctcagtctcctgagtggctgggactacaaatatacaagtgtacaccaccatacctggctaattaaaaaattttttttttggtagagagggtgtctctccatcttggccaggctggtctcaaactcctggtctcaagcaatccctcagcctcccaaagtgctgggattacaggtgtgagccattgcgcccagcctatgtttttgttttgtttcgttttgttttgtttttgagacggagtttcactctgccacccagggtggagtgtagtggcctgatctcggctcactgcaacctccgcctccctggttcaagcgattatcttgcctcagcctcccgagtagctgggattacaggcgcacgccacctagcctggctaattttttgtatttttagtagagacggggtttcatcatgttggccaggctggtctcgaactcctgacctcaggtgatccacctgcctcacctcccaaagtgctgggattacaggcgtgagccaccacacctggcctatgttttatgtttttaaaaagtctcattctagttgctgcgtgaagaacagatcggcagatggggaacaaatgtggaaattcaggaccaagtaagttaggaagctcccacagttgcttggacatcctaagaggtgggatagaaaggaaagagaggcagcaaaggcagcatctactattcccaacagacctcatcttttatcaaggccaggcaatcctatccaattatgcaagtgttgccacatgcagagcaaggcaggggagggaaggacaaagacgttatgtgttatttcagtgtatttccaagcctctaatgaacaccctctatgttcagatggcacctaaggctcccaggcaacaaagataaggaagacacagtcctgttcctaaactgccctcaaactagagagagaaatagaaaattacctgtaatatacgtcagagaacaagacagacaggattgctcctcttaaggccctttaaacaaatcaatatttctaaagtgcttactactggccaggcactgttttatttatttatttgtttacttatttattttattattattatgtttttagatggtgttttccctcttgttgcccaggctggagcgcaatggcgcgatcttggctcactgcaacctctgcctcccaggttcaagtgattctcctgcctcagcctctctagtacctgggattacaggtgcacaccactacgcccagctaatttagtagagacggtgtttgaccatgttagccaggctggtctcaaactcctgacctcaggtgacccacctgcctccgcctcccagagtgctgggattacaggcatgagccacaacacctgacccagtccctttaaatatatacccagaaatggaatggctggatcatatggtagttctatgttgcattttttgaggaaattctacactgttttctgtaacaactgaaccaagtacgtccccaccaacagcgtgcaagggttcctttttctccacaccttcaccaacactcgttatcttttttttttttctttttttttgagacagagtctcgccctgtcgcccaggctggagtgcagtggtgcgatctcagctcactgcaagctccgcctcccaggttcacgccattctcctgcctcagcctcccgaggagctgggactacgggcgcccgccaccgcacctggctaattttttgtatttttagtagagatggggtttcactgtgttagccaggatggtctcgatctcctgccctcgtgatccgcccgcctcggcctccaaaagtgctgggattacaggtgtgagccaccgcgcccggccgctgatttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctacggcgcccgctaccgcgcccgctaccacgcccggctaattttttgtgtttttagtagagacggggtttcaccgtgttagccaggatggtctcgatctcctgacctcgtgatccgcccgcctcggcctcccaaagtgctcggattacaggcgtgagccaccgcgcccggccttttttttgtatttttaggagagacggggtttcaccgtgttaaccaggatggtcttgatctcctcaccttgtgatccgcctgcctcagcctcccaaagtgctgggattacaggcttgagccaccacgcccggcctatcttttcttttctaggccgatggaaggtgatattgtggttctgatttccatttctctgatgattggtgatgttgcacacttttttgtaaacttgttggccatttgtatgtcttctttcaaaaaatatctgtgtagttcctttgcctttttttttttttttttttgagacagagttttgctcttgttgcccaagctgtagtgcaatggtgatctcagctcaccgaaacctccacctcctgggtttaagtgattcttctgcctcagcctcccgtgtagctgggattacaggtacgtgccaccatgcccagctaattttttgtatttttagtagaaatggggtttcaccatgttagccaggctggtcttgaactcctgacctcaggtgatctgcctacctcggcctcccaaagtgctgggattacaggcgtgagccacctggccacccatttttaaattgagtgatttggtttttgctattgagttgtgtgagggaattttttattagttggacttaatctctggaaaacccgaagatcctgatttagaatgcgtcctgtttgaaaaatgtgtagttgccgggcgcggtggctcatgcctgcaatcccagcactttgggaggctgaggcaggtggattacctgaggtcaggagttcaagaccagcctgagcaacatggtgaaaccctgtctttactaaaaaatacaaaaattagccaggcatggtggcgggcgcctgtaatcccagccactcgggaggctgaggcaggagaattgcttgaacctgggaggcagagtttgcagtgagccaagatcgcaccattgcactccagcctgggtgacagagcaagactccttcttggaaaaaaaaagaaaagaaaaagaaaaatgtgtagttactcccacaagacacaaggggacactactagcatgatacattcgtttcctagaggccgacatcccagacctgaagggagtacagggagcaggcaggtcgttctgaattcatgggtccaagtattcctaagttttttccaccacaaaggaaaggggcagggtttgtttatcaattccctttactggtgggtggaggttttctggtctacctttcactgcatgggtagccccttccaggatccataggaatctactatgagccttggtttcagctgccccaccatatgtggactcaaggtctaatttgttccccgtggttccttaatctccaaggtcatggagttatcagcatttggcccaggggctgccccagttccaacaccctgatttacaccctttcttgttttgaagggatccttgggaaattcccttactttttgcaaagttagcaatggttttaaaactatgtttgtttgtttgtttattgagacagggtctccttctgtcgcccaggctggagagcagtggcaagaccatggctcactgcagtctcaaactcctggccttaagcaatcttcctgcctctgcagcgggataattaaggaatcagagagacccaggggttgaagaggatttatttaattatttaggtgcaccgacccagtcggattaacatccaaaggactgagccccgaacaaggagtccggttaccttttaagcatttagtgggatggggggagatttgtgcagggggaagcatattacagaaacgagaaacaaagacagttatttaagacatgcattacattatttctaacttttcaaggaacagcatgttttatgacttgagattatctgtttagtgaccttgcagctgcacagctagagaaacagagttcacaatgcctgggaaagggagagataaggctcactagccacagaaagacaggcagtcaatttttttttttttttttttgaggtggagtcttgctctgtggcccaggctggagtgcggtggcacgatctcggctcactgcaagctctgcctcccgggttcacgccattctcctgcctcagcctcccgagtagctgggactacaggcgcccgccaccaccacacccagctaattttttgtatttttagtagagatggggtttcaccgtgttagccaggatgttctctaactcctgacctcaggtgatctgcccacctcagcctcccaaagtgctgggattacaggcatgagccacggcgcccggcctgcttacacatttttaaatttcttttaattcttattccacctcagcttcccaaagttaaaaattatgtttattatcactgatagagaatctaattgctttccagtaggcggggactacataaattctggagcaccagcctgccacagggtaagtggggaagaccagcttgcttccttttatttattcattcactcatttgttcaacaactatttatttatttacttatttttgagacagtgtcttgctctgttgcccaggctggagtgcaatacgtcttcatggctcactgcagcctcaacctcccaggcacaagcgatcctcccatctcagcctcctgaggagctgaggccacagctgcatgccaccatacccaggtaagtttttgggattttttttggtgttttttttttttgtttttttttttgagacggagtctcactccgtcacccaggctggagtgcagtggcattatcctgactcactgcaacctccagttcccaggttcaagcgattctcctgcctcagcctcccaagtgactgagactacaggcatgcaccaccgtacctggctaatttttatatttttagtagagacggggtttcactctgttggccgggctggtctcaaactcctgacctcaggtgatccgcccacctcggcctcccaaagtgctgggattacagcatgagccactgcgcttggccatttttttgtatttttgcagagacgggggtctcgctatgttttccaggctggtctcaaacccctaggctcaagtgatcctcccatcctggcctcccaaagtgctgggatcacaggtgtgagccattgcacccagccaacaactatttactgagcacctctgtatgccagctagagttttgttttgttttgttttgttttgtttttttgagacggagtcttgctctgtcgcccaggctggagtgcagtggcgcaatctcggctcactgcaagctctgcctcccgggttcacgccattctcctgcctcagcctcccgagtagctgggactacaggtgcccgccaccatgcccggctaattttttgtatttttagtagagacagggtttcaccatgttagccaggatggtcttgatctcctgaccttgtgatctgcctgccttggcctcccaaagtgctgggattacaggcgtgagccaccacgcccggtctaccagctagagttttgacaagagctaacacaggggtctctgcttcccagacctcatagtttagaggagagacagatataacctaagggttacacgaatgagagtgtgtcattatagaatgatgaagggggacagtgtgagaacatgggccagtggttctcaaggcgttgctctcagcagcagcagcagcagcatctgggcaacatagtaagaccctatctctaacataatggaaggcaaatcttggacccgccccaagcctactgaaccagaaactcgagggtgggacccagcaatttgtattttcacaaactccccaggtgattccaaacaacaggcataagtcaaaggaatgtgatcaaggtttccataaggaagtgtggctgaactgagagctgaaggctgggtgggaggcacacaggcaggcagagggcatgtgcggctgggcacagtgtctcatgcctgtaatctcagcactgtgggaggccgaggcaagacgatcacttaagcccaggagttcaaaaacagcctgggcaacataatgagaccccatttttacaaaaaaaaaaaaaaattaaaaattaggctggatgcagtggctcatgcctgtaattccagcactttgggaggccgaggcaggtggatcacctgaggtcaggagtttcagaccatcctggccaacatggtgaaaccctgtctctactaaaaatacaaaaaattagccaggcttggtggtgggcacctgtaatcccagctattgaggaggctgagacaggagaattgcttgaaccagggaggtgggttacatgagccgagatcaagccactgcactccagcctgggcgacgagcaaaactctcaaaaataaataaataaataaataaaattaggctgggcatagtggctcatgcctgtaatcccagcactttgggaggccgaggcgggcggatcacctgaggtcaggagtttgagaccagcctgaccaacatggagaaatcccgtctctactaaaaatacaaaatgagccgggtatggtggcacatatctgtaatcccagctactcgggaggtgagacaggagaatcacttgaacccaggaggtggaagttgcggtgagccaagatcacaccattgcattccagcctgggcaacgagagtaaaactctgtctccaaaaaaataaataaataaataaataaaatataaataaaaattagctgggcaaggtggcacacacttgtaatcccagctacttgggaggctaaggtgggaggatacttgagcctgagaggttggggctgcagtgggctttgatcctgccactgcactacagcctgggcaacagagcgagactgtctcaaaaaacaaaaaagaagggcatgtgcaaacgtcttgtggtgggagggagcctgatgtgcttacggaaccaagagaaggtgcacgcctgcaagccttgcaggctgcgggagggagcttgccctggttctgcagaggactgggaagccactgaggagcagggagacttggggagaattgtactgccaaaagttaaagtacctgggccaggcgcggtggctcacgcctgtaatcccagcactttgggaggccgaggcaggcagatcatgagatcaggagttcaagactagcctggccaagatggtgaaaccccatctctactaaaaatacaaaaaattagccgggtgtgatggcgggtgcctgtaatcccagctactcgggaggctgaggcagagaattgcttaaacccgggaagcagacatcgcagtgacccgagatcttgccactgcactccagcctgggcgatagagcaagactctgtctcaaaaaaaaaaaaagttaaagtacatgttcagatctgagacaggaccagggctgtgctgttaggattggtaaagagggagtcgaggccagatgcagtagctcatgcctgtaaccccagcactttgggaggctgagacaggaggatcacttgagcccaggaattcgagaccagcctgggcagcatagtgagacccccatctctaaaaaattgggaaggagtagaaatctttcaaagggttaagaggagttagagactcttttggcatggcgggggtgaagagggagagctcctctgaggcatcggcctgggctgggagctgagggcagcagggcgggctggggaacttgaggtgcctttgggacatctaaggatgtgtgaccagagacagcagtgtgggcctggcactcaggagcctgagcaggctggagacaccagttaagtcacattcacagcatggacccccttggctcagctgtttcctgagtctggtcaaagttatttaagccagagtcatctcgtggttgtgtcatttccccctttccctgcgcatgtagctttccccaggctggagtgtggtggggaaagccacagggagtgtcactatacacataagttagtctcctggaatttcttcagctgtggtcattgctaaaaaaagaagtatgacgctggacaacaggagtccaatgggactttatttaacatgtttgctcaagttatcagctctttgcaagtgactgacagacaccacctcctttgtaacctcaaagcaggttcacagactatctcctggttcttagggatttcttctgtcgaaaagagttctcaaaaataacagcaacctgagataccatctgttaaatccttaagcaatttcgcatgccttatgagaccctgctgattaaaaacatctagttttgttttcttttttttgagacgaagtctcgctctgtcatccagcctggagtgcaatggcgcgattttggctcactgcaacctccgcctctctggttcgggtgattctcctgcctcagcctcccaagtaactgtgactacaggtgcgtgccaccatgcccggctaattttttgtatttttagtagagacggcgtttcactgtgttagccaggatggtctcgatctcctgacctcgtgatctgcccaccttggcctcccaaagtgctgagattacaggcatgagccacgaagcccggctaaattttgtgttttttgagatagagtctctctctgtcacctagtctggagtgcagtggggcaatctcagctcacttcaacctccaccacctgggttcaagagattctcctgcctcagcctccttagtagttgggattacaggcatgtgccaccacgcctggctaatttttgtgtttttagtagagatggggtttcaccatattggccaggctggtctcgaactcctgacttcaggtgatctgcccaccttggcatcccaaagtgctaggattacagatgagagccaccatgcctagccaacatctagatttttagaatctctctggccccttcctgccccatctttgtctttctgccctcccctccaatagtggcatctcctcctggggccactgtgcaggagtgagttatttgctcactaatcacaccatactaaaccctaaactcactccaggactgctctcccagcccagtgggtagcctttgccatggattggtggaaggaacttgggcctggaactccctggtcccacctgagtctggccactctctctggctgtaaaggtggagtttagaggacgggcactccaggctctttaggagactcctctagatagaaccagagagggagaatgggagcccatttaactaaagccaaaaaaaatagatttttttcattttactcccttgctgttttgttgttgttgttttgagtttaggagcagaggtttaataggcaaagggaaaaggagaacagctctctctcagacagaggggcacccaaatgggaattcccgctaactggtaatttgatgagaaatagcaaacaacagaggaccactctgacctgtcctcctgcctacttcctgcactgtttataggagcccacctcctcctcctcatgcgtcctgtttgcttccttccagccacgggctgcccagtggtgttctgacacctgctgtaccatcgctgcaatgtccagcctggaatccctggcgctgcggtggtgctggatgggctcagagatggtccgatcagaagggatcacagaggaaagctgggggtggtggctcacgcctgttaatctcagcactttgggaggctgaggcgggcggatcacttgaggtcaggagttccagaccaggctggccaacatggcaaaaccccgtctctactaaaagtacaaaaaaattagccgggcatggtggcatgcacctgtagtcccaggcaggaggatcacttgaacccaggaagcagaagttgcagtgagccgagatcgtgccaccgcaccccagcctgggtgacagagcaacacaccatctcaaaagaaaaaaaaagggatcacagaggaaactgaggcacaggaagggcagtgcctgcctcaaggcacctgggaaccggcctcaggtggaccttgtgttttccataggaggagcagagactgctagaaactaggagttcgagtctcttccaccatacacctttctcagcccgaaagggcagcacattcccacgatcaggagcccccagaacaccgattcttaaactttagcatgtgtagaaatccctgggagagcttttcacaacacagattcctgcgccccatcctcagagattctgatttggtaggtctggggtggggcctgagatgctgcatatctttttaaaaattattatcattattattatttgagacagagtcttgctccatcacccacgctggagtacagtggcgcaatcaaaactcactgcagcctcaacctcccaggttcaaacagtcctcccacctcagtctcccaagcagctctgtctacaggcacagtgccaccacacctggctaatgtttaaatttttggtagatacaaggtctcactatgttgcccaggctggtcttgaactcctagcctcaagtggtcctcctgcctcggcctcctaaagtgctgtaattacaggtgtgaaccactgtgtctggccagatgctgcatttctaataagctttgctccatggaccacacttggattaccactgacttagaaactcacagtaccttacccactgagtcaggatgaagcttgctaaactgttgcaacaagggcctaaactgttgcaacaaggacagagccaggtgcctcacgcctgtaatcccaacgctttgggaggccaaggcgggtggatcacataagaccaggagttcgaggccagcctggccaacatggtgaaaccctatctctactaaaaatacaaaaactagttgcagatggcctccagccatctgcagcacatgatctggtgaaggagagctctgatgagcacgtgacgtagtatggtcccggcaggtctagcccagggtggtgtggggggagttgaacttaggtgactcgcagaagacccccatgtgcccaggtggagcagggtagccatgtgcccaggtggagcagggtagctaagtaactggacactgcggctggaagctcagaggcatctaagcaaattgtatgatttacccgcggtgtgacctaggacaagttacataatgtctctgagccgaggctgcctctctatcaactgtgatcataacactgtgattgtttctacagggagcccccagtaaatggcaggaattcaggtcaccatgaggtggactcacgttgatctcagaccagatagggacattagtgggtacaaatggcccttgatgctcaattttgttgtcagttaaaagaaccctctcagccagtttttaattcccactgagcaagtgagatgggtaaagaaaacaacagtggctcacacctgtaactccagctctttgggaggccaaggtgggagggctatctgtgctcaggagttcaagacggcctgggcaacatagtgagacctcctctctacaaaaaaattaaaaattagccaggtgcggtggcacacacctgtagtcccagctactcagaagactagggtgggaagatcacttgagtccaggagttcaaggccacagtgagctataatggcaccactgcactccagcctgggcaacagagtgagactctgtatctaataaaagaaaaaatagagaaaaagaaaaagaaaacaagcaccattggctgggagtgggcaaagcagacagacccccagctcccagcatcctccactgcaggtgacctcgagaagggtcagagcaggaaaatgggggctgggaggttcaacagaaagctgtgtggcaagaccagggaagcaggtgtggcagctggcgtgaagagacaggtcaggagtgcagtcgcatcatttaacgagcatttattgcacacgtctgttcaagcaccaggctcaggctggaaaccatccaaagcgcaatccctgacctcaggcagctcacagtccagtggggaagccgagaagcaaattaatgactctgaagaagcgcaggcaagtgctatgatcaaggcatgtgtgtgggtagggtgtctgggaaccccaaagtcagcctcaggtggggaggtaagtcaaggaagggtgaggggactgggctcagcctgggtctcggaggagagcggggccagccccggggatggtagagtcaacctgccaggcactgtgcactgctggccaggcccggccaatgagagcacaacttgttcagggtccaggaagcaaccccaggagaacaaagcctcgtggggagggaggaacctggagggtggaaggagtttgggcttttcctgaaggtgatgagagccactgaaggattctgggggaggagacatagggttatcctgggtcatgggggagagagctttgaaaggcagggaggtgggaggccgcagggactctcagaagtggagtctcagagctccttaagaggtgaaggcagccgggcgcggtggctcacgcctgtaatcccagcactttgagaggccgacgcgggcggatcacaaagtcaggagatcaagaccatcctggctgacatggtgaaaccctgtctctactaaaaatacaaaaatttagctgggtgtggtggcgggcgcctatagtcccagctacttgggaggctgaggcaggagagttgcttgaacccggaaggtggaaaggcggaggttgcagtgagccgagatcacgccactgcattccagcctgggtgacagagaaagactccatctcaaaaaaaaaaaaaaaaaaaaaaagaggtgaaggcacaggacaggagctgggatgtcaccagcaccacttgccagctcacttgtgcctcatgctccctgtttcacagatgtgggaggcaaaggagtcaaggccagctacacagggaggctgcacaggccccctggcttccggctcccacaggtgtctgcccagcccagatctgcgcgggtgggaggcaccttggttaggaagggctgagcctcttgcactgatttgcaagctttcaacctggcctccaatctcaaactggcctccaggccgtgggcctgatggggagctgctggcattgccgcagggctcatccccaccagcggaggagatattcgtagctgaggaaggtgacagcattgacgggaaaggcgcgggcactgttgatggtgaccccccggaagaagactcccagtccttcctgccggatgctgctcaccatgcagtccagcatcccctggtacactctgcgtctcagtccatccatctgcatccgggacttgatcatgtctaagggcgtggctgccacccaggaagcaatgcctgcaaagccccctgccaccagcaccgtggctgagcctggggcagagagagcccagagcaggggtcagacccagaacagagcatcctccccagaccctagtttccttccccagtccccgctggaccctgcctgctacccacacctctgtcccccatcctctcacgccactttacttactgggattctggccttctggtgtgtactggcgacagagcccttcataggtgatgaagtagatccccaccgtgggggtgtccctcagcgtcagggcccaggctcctcggaacagcccccggggcccctcctcccggaagatggaggctgcacagtgcacgggcccctggtaccggggtggggggctccctggctgggcccttggctctgtctggttttgtagccggactttgatgaggtcaaaaggagccagacagtaggcctgttggtgatgaaacatgagggccccgggtggggctttgggctgggaactggccccttatattcacaagaggaaggaggcaggcagggggccacatcttccagtccctcaggaaccctgccggcacccagcctctcacgtgcatgtgtggctgggatggccaggatgtctgcatgcgaccgggacaggccacctcccttggcatcaggcccaagagtgagaggcactgcccctcatgcaacagtgaccaacttgcctggcctacagcaggcactcagaacaagcctggattctttttgcaggagcaggttggtttctggcctccctaaagccggcagtgagcatacctgtacggtgggcagggccaagtgaaggattcagcctgtgactgtgaaatagcaaagaaaccaccctttcccagggtgaaggaggtcccctcgtgagtgctgttctcctgcgcccacctctcagaggcccggaggggcacaaggccagcccctcctgcctccagagaggcaagactccttcccattagcatcccaccaaagaggcttctgagtgtgggaaggtgggtaatggggggacttggcaggtgctagggctcttagaatcggcagaagcagatgctacacagatttgggatggaattggggctggagtcctggtgagggtcagtgctggggggatgtagagggcgatgggggcaattaagatttgggtcagagatgccagtaggtcaagatagcttttggagtccaggtgagaatcggggtccatgtcaaggctagcctgtctctgagggatttatctgttttttgcttgtttgttttgtgacaggtacatgggctcagttcctcagccctggagatggctgatggcgacgggggctggcggtcgcctctggtggtgggtggtggtacttagggtgtggcaggccaagtcttcgcttgtttactttggtcccaggagtaagggtcgtaggttaggtaccatcccttgggagatggggccttgtgccaccctctagagcgtgctggcagggctgagctcagggcttcaggaggtgttctgagccctgagctcctgggggctgaggacagggctaggctgacaccaggtgacagacacccccacaggggtggtggagtgtcagatgccatttcagaaggtcagcttcggcgaagaccagggcaacgtctgtgcccgtcagaggctgtcagtccctgcctcttcttcccactccacactaaaacacatttttcctttaagactctgttaaactaaagccacaggtttcactgtaaacccaggctccatcagcggccctcacagtccccacttctgctttccaaagagctgggggggcagggtgacttagaagccgggcctggccacttagcttagggcttcggttctcttccttgtgtttgtgggatgtggctcgcggggctcaggaaacctataggtggcacctcgcacaagaaggggcagaagaaaagccggggcctccgggggtctcattaatcattaattcatttgaaggagcagcctgactttgtcctttgtccttgctctctgccccatgaagtgtgacaaggaactgggggcagctgcccaggagagggcgaccctggcttgcggctggggtgtcagtgggtgccgggcgcaccctctccctgcttatgctcacaggacccattcagcaccggttcccactggcggcagctggtccctcttccctccatccacccctctaaagcccaaagcccagatgacggcagtgcctgaatggttaatgccctgctgggctgggcctcaggtgaggctcccaggtcatgggcacccaagcactgcaggcaaagtgtagagccaggcagggccaggggagtgtcaggacctcatcaggacccggccagaggggctgggctcacagctctgcggggtgctggtggttctccagggtcaaaggtctccttggggagtgggctccccacagctctgaggctggcagacccctctggaggggggcaagccccgtcagctggagcgagtggcccaggctgcttctcccagcaccctcttggcactgcccaccagctgtctctgccttttgccccctctgttccccacagccctcccccagaggcctgcagcctggaaggccatagcacaggcctcttgttcccctccaagaggcctatgcctccacagctgtgggtcgccagggcagggtgggagaggacagatcgagatgaccatccctatgacacctgtgtgtgcccactcactgccccctcacctgcaggaaccccccggtgcagcccgctaggaagatgtgcatgtagctgggcggctgggcccgccgctcctggtgggaggtggccgtgagcaccagcagggtgttgctatagaccccaaacaggacagagttgaccacagctatgctggcaatggggaagctcattcccttgaagaagcccaggagctgcagagagacacagtggcagcggagtaggcaccgtggggcctcccctttgtcctctccacccctggcaaggcagcctctggctggaaactgctcccaagtcctgccacagggaagtggggacaggcagggatgggctgaggctgcgcctctggggtgctaagctaccacccaggccccccaaggatcccagacttggtcttctctcctccaggagcagaaccctgctggagagggaagctggtaccaacagccccagatgcctccccgaaaggggaaggaccccaaaggagtgggccactcacggactcatggcggtaaatcttgaccatgcaatcaacgatgccccggtaggtggtctgggtctgcagcctcacctgggtgggaggacagagcaggtagggtggcgggatgggcaggtgggccaacctttccctctgccccctcaagcgggatgccaaccagcaggagaggcaggaaaggcaagattagccaggcctgatctcagggcaccctgacatttgggtcaggtgagatctttcattcctctggcagctctcctaaactcacctttacagtgtcaaacgggtgtcccaggaccaagcccagagcgcctgtggtgacaagagggtgctatgagtgagggccctcgtgccaggcccaggaagcaagtctgtgccaagaggaaagaggggttcaggcaggaggaaggagagcagggccatctcagacacatgcagccaccttcctgccaagctctagagactccagctgcccctgccaccccctccacacaggcactgggccaggaaggcactgggacaagggactaagaccccaggccccacctgaggatgcacacccaagagggaagagccagccaaagacgtacgtgtcctcgctggagcccatacccgggtatcccaccgcctatgagccgcgggactctgggagaatcacccaggttcccacctctccgagagctttactcttctttcttcaactcataatgtcgtcgccgggatccagagcaggccctgctgccagctggccacgcagaactgcagggccctgatgggggtcatgcctgggcacctgcagaggagcttctcccctcccctccacctgcccactgcctagccctgccctccacagcagaggctggttctggagtttgggggaggtcgcacccccaggaggcaggttcagaacgtccctctctttctcctaagaggaatgccacccagaagctgggctgggaccacagcacaacaggcctcagggcccgggactgcggcccacagccaggtggggcagaggcccagaggggactcaggacagcaggtgaggtcaaaggtgaacttcctttgtaagcccaacagggtgggcctggagagcagggctcaaggtatagggtgctcacctggctctcccgccctctgcaggtgtcaggcagagtggccttggaaggcagaggcagcaccctcccacctgtgccttcctctcttcttcccatcggccactccccagaggactggggacagctggctctggggtgctccacggaacccagactttttttttttgacacagggtcttgctggtgttgtccaggctggagtgcagtggcatgatcatggctcattgcagcttcaacctcctgagcttaagggctccttccacctcagcctctggagtagttgggaccacaggcgtgcgccaccgcgcctggctaatttttgtatttttagtagagacggggtttcaccatgttggccagcctggtctcgaaatcttgacctcatgatccacctacctcagcctcccaaagtgctgggcttacaggcatgagccaccgcgcccagcctctcatttcttataaagacagggtcttcctatgttgcccaggctggtctcaaactcctggccccaagtgatcctcctacctcagcctcgcaaagtgctgggattacaggtgtgagccaccatgccctgattctttttttttttttttttttttttttgtggcagggtctcattctgtcacccaggctggagtgcagtggtgcagtcatagctcactgcagccttgaactcctgagctcaagcaatcctcctaagtagctgggactacaggtgtgagccaccatgcccagctaattattttgatttttttgtagagacaggggcctccctatgttgcccagactggtctcaaactcctgggctcaagtgatcctcccgccaggccggaactcagactttggtctctgctcctcccatgtcacccatcttcccgaggaagtgacctaccattgggtgtgatgtgacagaaggaagaaaaatgtctcaccagagatccagccagccacaaattcctccaccggcattgtctgggcttgcgggaactggtggctccagcagaggagacagagttgaattcccccctctccctcccctggcccacgctgataacctcccactaatgtttaaccctggcgggaaggtgagaattggcctggtgcccagacctccggcaactggcagaggagagcgagccagttccggtgaccctggccacctggaggagtcgtgcagagtacagtctcacgggccaggcgtgccgggaccacagaggccctgatccccgagcccggccaatgatcctcgctctgaggatggcaactgggttcctgccccatggtcgggcccctccagggctgccttagtcagcaagaggcaagcccctgcctgcccagccagcccagctccactcccattcatctccaccaaggggcatggccgcccccatgccacagagagaggccgggtgcggaggtagcgtggccaccagggggtaggcccagcccgcatttgccgctgcgtggcagggtggggaggagccactcccaggagtgactcaccaggcctggctgttctcttcagggttgtttacgactcccccgactcccccgtgtgagtcagaaacacagccttcctcggcttcctccttcccaggggaaagataggggttttgattatttaaagtgcgtgttgatctgcaatggcaccattctgctcagtcaaaaccaaaaccctttcaaggatctgtgagccacagggtgccgcccattctcctctgacctcacgtcctgccacccacccccttgctttctctgctgcagccacccgagcctccagactcttcttcagtcagccttctgtctccaggcctgtggactggctcttccctcttcctgggcactcttgccctggcacccctccagctggggctcaaatgtcaccacctgggtgaggtctgccccgcctccccagccggaggcactgctggctcttcctctctttctccatcacagttatcacgccaacatacgatgggaagaacttgtctgtctggacagggatctctgggtgttctgtgcacagcgggtggcacagggtgggctctcaataaatcctgagtgactgaatgaacggaaatgtcagccagcagcatcagcggcagcctggggctccagttccctcttcccatcaccaaacggccctgggaaacatcaaggcccagtgacacctgcaccctcccctccagatctccccgcagctcctagtctcccatgggggacgcccaaggcccagtccttctctcccttctcctctcactgtggccaaggcagaacccacccacccctgctgctttctcccgggtggacagattcgggaaacaggacctcctacctcctgcctctggagctgcctggggctccttgggccacccccaaagatcatcctaaaagaccatccccaaagactggcctctcgtggtggcttgggctgcagtcctggttctgcttcttattcctgaaactgcctttgcaaaaactataactgatacaggccaggcgcagtggctcacgcctgtaatcccagcactttgggaggccgaggcggaaggaccacctgaggtcaggagttcgagaccagcctgaccaacatagtgaaaccccatctctaccaaaaatacaaaaattagccgggtgtgatgacgggcgcctgtagtcccagctacttgggatgctgaggcaggagaatcgcttgaacccgagaggcagctgttgcagtgagccaagatcatgccactatactccagcctgggcaacagagcgagactccgtctcaaaaaaaaaaaacaaacaaacaaacaaaaaaaaaaccctcctgtctctcgtacagccagctctgcatgaattaaactctccttattgcaattcccctgtcttgacaaattggctctgtctaggcagagggtaaggtgaacccaatgggcggttacattatctctctcagtgatgttgagcaacctcttctgtgggccttggggtctattattgtttgccaaagtaggacagcagtcgggctaattgatgtctaagcctctcagctctaaaggctggaggccgcctcctccctcacttcagaatgggtctcattctcttttccaatctcaccgcctcaccccagtttgagaaagaccctcattcccacttccctacagccttgctgaagggaagcccacctaagcatggcgtcatcttgtgaatctctagctcacaacctccaaaatgttcttactgtctaacacgcctgccccatatctgtcatcctggggttcaaggcctcccccatggtgccacccacctgctatgctctcacacagcgggggtctttcctggggtcctaaccatgctcgtgcagttcccactacctggaatgcctttccttccccaccatcagcctcccggactctctcccagtgcccctccttgactagacccgggttctagcctccccaccaccaccgcagacactcccaggtgtcagtctttgacataaaacagagatgtgatactcacctcttagtgagttctaaggattaaagcactttaaaaagtggctggcacgtaaatggcaactgctaatacttatttccactctcaggacgcatgagaatgacacaggaaacaggggaaagggcctggcccagtgccccacacacagcaagtgagcagagacttttcctgcctgtagcatttcatagttcttaaggcaatgctgtcatcttctgtggttttatttatttttttggagacagagtctcactgttgtccaggctggaatacagtggcaggatggcgctatcagagctcactgtgagctcacactcctgggctccagcgatcctcccacctcaggctcctgaatggctaggaccacagatgtgtgccaccacacctggctaatttttgggttttttacagatggcgtctcactatgttccccaggctggtcttgaactcctggcctcaggcgatcctcctgcctcggcctcccaaagtgctgtggttttaaatgtgctgttctcctgggcttctttctctttcccctcttccttaactcaccaattaaaccacaacagacactttctgagggcagggccacgtctcccctcagtctccatcccctgacctagcacaagccccgcatccagtaagcattcaaaacaacactgaactcttctgctcctgcttcactccagctgggtcaagaggccatggagatacagtgtgtcctggtctgagggtcccagagctgagaaccaggaaggagatgcctgcccccactggacacccttccctgcagcccacatctgagcttcctcaagtccttaagtcacattggcaaggcaaatgtgatgtcatgggctcagctgtggggcagtgtggatcataggagggcaggcagagctggttcacataccaaagaaggctggactgggtcaggagctagagctgctttccaatcccagggaaccagggcaaagtgaacccactgccctctgttcctgatcaccaagcccactgctgtcacttgggacaacttctggttcctctggccccagaaggtgccccatggacttatttttctccctgagttccacatctcagatgcacacatgttgcattaccaggacatgtcagtgacatggccctgagggtaggtggtttcacacctgcctctttggggccccaagtctcctcccagcctgggaaaacctcaaggtctcccaggctgttgtgtaagatagtaagggctcatgtcactgctccctggaaaaacagagtgtctgtcctggttttctgatttagacatatatatataaattttttttttttttcagacggagtctcgccgtcgcccaggctagagtgcagtggtgtgatctcggctcactgcaggctccgccccctggggttcacaccattctcctgcctcagccttcccgcgtagctgggactacaggcgcccgccacctcgcccggctaattttttgtatttttagtagagacggggtttcatcgtgttagccaggatggtctggatctcctgacctcgtgatccgcccgcctcggcctcccaaagtgctgggattacaggcgtgagccaccgcgcccggccgacatagacatatattaataatcatttagagagtagggatagtccttgggggtcattcagttcaaccacctcattttacagatgaggaaaactgaggcccagaggagaagggacttgtccaggatgagtctgggccaggactcattctcctgaccactgccgagagcgccacggtacaggccgctgccagcgccgcatggatccctggcacgtgccaggaagtgtccatttcacaggcagggaactagcccgaagacccagcgtgggcaggccaacgcccctagcctgattctcgaatcttcgccaaaccctcttacaggccaacagtcggggcctttgtgaagggaaactcgctctgggtcactctggtggtggcggggctggtacgtgacgcggccaccccacgggcgtgatgagacacgcgaggctggcgtccgggcatgcgcgggccgcgcggggcggccctgggctcccattggctcccccgggtcgaagggggcggggcctcgggcgccgcgcttcctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgaggtgagagcacagcgacgtctggcccgggcctccgtccccggctgggcgtgcgccttgccctgcctgggcatccaggtcgacccccggttcttgaccgtagcaacccgcacccctcccaccagcgcccggtctgcactcttggcccctccaggcagcgccgctcaaccttgcggacccagcctgggatcccttaccgtactcaccgagagcttgaggagacctccagccccccatccctggctcccggtaactgctgtttctctttgcctttgcagatggacgggacagaaggcagtgccgggcagcccggccccgctgagcgatcccaccgaagcagcgtgtcctccgtgggagcccgaggtgggtcccacccgcatctcctcttccacaccctcctgggaccccagccctggagaagtagctctggcttgtcttctttttcattaaagataatttatgtatcgactaagaaataataaggtacattcagatgtggaaaactcacagaagtcagaggctctgtcactagtttactggccaggttgggtcctcgctctcatttgtaaaatgagcttgtttaacatagctgtgaaattcaaatgagattatatgaatgaaaagtgaaggctgatgtggttcatgcttgtaatcccagaactttgggaggccaaggtgggcagaccacatgtgcccaggagttcgagaccagcctgggcaacatagacaaaaaagaaagtgacacgttcactttctttgtgtcatttctttttttctttctttcctttctttctttctttgacagagtctccctctgtcgcccaggctggagtgcagtggtgcgatctcagctcactgcaagccccgccttcggggttcacgccattctcctgcctcagcctcccgagtagctaggactacaggcgcccgccaccacgcctggctaattttttgcatttttagtagagacggggtttcatcgtgttagccaggatggtctcgatctcctgacctcgtgatctgcctgcctcagcctctcaaagtgctgggattacaggcgtgagccaccacacccggctgtgtcctttctttctcccaaacagccttttgaaagcagggatcaggctgggcgtagtagctcacacctgtaatcccagcactttgggaggccgaggcgggtggatcacttgaagttgagaattccaagagcagcctgaccaacatggagaaacccctgtctctactaaaaatgcaaattagctgggcgtggtggcacatgcctgtaatcccagctactcaggaggctgaggcaggagaatgacttgaacctgagaggcggaggttgcggtgagctgagctcgcaccattgcactccagcctgggcaacgagggtgaaactccgtctcaaaaaaaaaaaaaaacagggatcatatcatgatcttcatttgatagggaggaaactgggccctagggaggttaagtcccaggcaggctgtggaagctctccaggtgattacatactgcagcttctggtgcctcagttcttgcctgagaagtagatctgaacctgagcctcctcgaagtgattttgtgatctctgagagtagctgctggagcataacagactgggggtccgaggagcaccttctcttgtgtagatgagaaaccgtgcccttcccttccacacactcttggagggaggagtattagctctacttttacagatgaggcaactgacaacttaaattgactccctgaagttggccagcgaccaggcaaggatgggaacccgagtatgtcggccccaaactccagtgttccttcaccatgcctgcagtctcagggatggggatttgaatctggttgctcttccaggtgtctccatttggctctggaacccacaagttgtcacaagggaactctcagctatttgggctgttcttccctagcctgcttcgtattgactcctgaggcttaaagagtcctcagacttaaagagtcccaaggaagctgagacctggaacttgctttaacctgggtgacctaaagaattatctcttcgcatcttagcctcagtcagagagagacttgcctaaggacagcagcgggttaccagctctcgctcctgccagccagccagactaactgccatagcctcaggatggtttcagcctctctatgctgtggtttcagcctctctgtgctgtagtttcacatctgtggcatgttcttgttcagggcagaagaacagttgaatccttggggcagctatggtggtgaggggcaggtttgcaatggccaggcttaatttgaatcttgggggattgcggtggggctggtctctgggcaggagttactgggtttctgggtggtttaagggtgtcaaggaagcactaatagatagcattcgtgatagggtcttttggggctgctggggctctgcctctggcgaggactctgtctcaggagcgtagccctggtcacccctgaggggtgtagggtgggggctccagccccagtgggtggtagagggtgcctggttggcctggcctggctgtgccaggcagaggcctcagctgagcctgcctggtctccatcacagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctgggtaaggcttggcagtgaggagcccaggctggagggttggaagggcactgaccagtacaggagggagggggcagtgtttggagccgctggggagccgctggccactgcccatggggaaaggtgggacttgggtttatcctgagctgtccacctgtctgagcacctagagccctgagaaggcccccgctcctggccctgctgtctgtctttctgctggtggtggaggagtggacacgcctgccccccaggtcgtgctgggactgggtggtccaggaacagtaccgcaggagggagggaggaagggggccttgtctgccgagcataacctttgccacaacctgggtggtgtttgggaaccatgatttcaccttgtcctcaggcctaggccagtcttgcagatggaagttgtagttagggtggcgagaccactgtgtggcaggagcaagacagacccaggcctgagtggcttcccggtcggcctctttgaactgttcctgttccttggggacagggaggagaagggacatggctcaggaagtaggcccctctgaccctgaggctcttagtgagggtgggaagagtagagacttgacttctctgggaggggggtcttcagcctccagccctgcctggctggcctcgtgaccacccacatcctgccctttcaagctgaaattgcaagatggagggacttaagggcggtggctctctagacactcagcccagggtccctcagtgaacagggtctctgagcctgctggttcgcacaggagggggccaagggagaggctgccccatgttgtttagtaaatcggtgccataggccgggcgagttttcttagcttacacattcccttcgttatagaggaatgcaggcaagaagagggtgaccagtcccattgagggagtgcgtaggacagcctggtttaggtccaaggggcccccagcagttatgtcttctcctgaggctgctggttgggggagagggaacatttggcacccctgctccccaccctcatccttctctccaccccctcccccctgccagtaggagcttcctgctcagctgctgctgggaggtgcccgcccaccctcttcctgctgccccggctcctcggccacctcatgcccagcctggtcacctctctttcacctccgggcctcgagtcaggactgtgggccccttggtttgtgtctgaaagctgggggtacagttctgcatgggttggcccctgccttacctcgggaagctcccagagcctgctgggcagcctgcctcctcctctcacctcctccgtctccactccctcctcaccacattccggctctcccacggccggaggccgtgaatgggctgctttgttgcccggcccacacaggaggatggtggcagaagaccccggcacaaagtcagcacccactctgttcccaggctgggttcagggaggctgaaaagccacttcagctgtgacttgggcccccccagaacccttttcccccggcccctgcacccctgatggggtgaaccggtgacagatgccccagggccgtgagtgccctgcaagggcagggaggggcgctgtcttctggagctgcccttcatgccggatgttttggcagggcttagccttctcaatgtcgttgtcactctgcgtggaacagggctccagggcccttccgtcccatttggatagcagcctccaggcaggaaggccccatctggaagtgtctgggactgcgggagttctgaagacaggaaggagtcttttgagctgctggggcttggggttaaggctggtcagggctgggctgtaggcagcaggaaggacatccttgtctccagggtgtccctaggccccatcttgtcagttactgtgcttgttccacaaggacgtgcaaagcctctctcaggccacgtggtattctagatgctgggaatacaggagggaagaccctggtggaacttaatttaacttaattttatttatttattttttttttgagacagagtctcactctgttgcccaggttggagtgcagtggtgcaatcccagctcactgcaacctccgcctcctgggttcaagcgattcttctgcctcagcctcccgagtagctgggattacaagcaagcgacaccacgcctggctaatttttgtatttttagtagagacggggttttcccacgttgagcaggctggtctcgaacttctgacctcaagtgatccacccgcctcagcctcccaaagtgctgggattacagacatgaaccatcacgcccggccaccattggaattttagagcctaaaggatggtaaaggggggtttaggaagcagagctctgttcctggtttagccagtagccccatgtggcctcaggcactgtgccttccccagcttcagtttccctgctgtaaagtgggtgatctccatgtcctccagccctttgagttcccagacagagagagcatgaggaccccatgaggggctcagtggccaagtgaggggagttaatggagccctttctggagggagtggggaggcaactattgggggtaaatggtgtttccctactggaggtggtgacagatgggtggggcccagggtctaggttgtaaaggagggctgtggggcctctgggaaatctggaccagaaatgttgggacgagaaagggctgcagaggctggatgcaggggtgggtggaagggctgtgggcaagggggcccgtgtggagctgtggctgctcttccaggtggaaggcccagatggcccaaagagcagagacaaggacccctggcctcaggccagcaggaggggcgattggccatcagtggggactgcctaagggtagagcagggagatgtggatcaggcagcgctcgggaagcttggagcaagcgctggctcctgcaccccggtgacggacatccccatacatctctggatgaacttggaagtggcctcacacctctcaaaggcagagaacccggtggccactgttttttggtgggtgctggtgtgtgagctgaaaggctttgtccctcctggcctgaggcattgagtcctgggtccagagcagtggtggcatggggcagcctggagtttgaggggctggactgctgcacttggtcattctgccaacccctggcgaggtcactgtgccccagggatacggcggtggacaattctgcagcccctgtgggtggcagcagcgaggaatgtcaggtagtgatcagcctgtgaaggcaaacagatgtggcaccattggggtgatggaaaattttgaggaggggctgccttaattaggggtccagggaaggtggcccttgaacttagacctgaatcagccagccacgggaggatctggggcaaaggagtccaggaaaagaagaacatcaagcgcagaggccctggcacaagcaagctggggatgatttaaggagatttaagaaggccaaggtggcaggagcagagtgggagaggcagtgagagaggagataaggtgggagggccaggcaggagctgggttgcgtgtgggccacggaggtgcagagcttgcaggatggaaggtcagctggagctcctcagaggtgtcagaggtgggcagtgatgacggggaggcccaggctctgccagtgggggggcaaggcagccccttgggcctctgggccccagttgtcaatttccagttctgcttcctgatggcactgagggttcctttgtgccccagcaccttccattggccagtctccagtttcagcttgccgtggggctgcagtgaacacttagtggctggctctgcctggagccagacccccgtcgcttgctgtgtgactgtggacaaggaacttggcctctctgaggctcatttgctctatgggtgaaatgggggatagggttattgcagagtaaatggctctggacccttggcacctgctcagttactattggttgcgactgtcgtcatgctgtgcggtgtgataggtggaagggcagccactggactggccggaggctgcatgggccactccccatctcgtcctgcagaggtgcagctgaaacccaagcaccagccctacaagctgggacgccagtggccggagctgctgctgcgcttcaccagtgccccagacgatgacgtggccatgggtcagtgctgctgcctgtctgtccttgcctcgggaccacctgagtctgcatctctggctcccagcccagccagggccctgccagcaaggagctgccctggctgaggggcagggcctgcatctcccccaggctccgtcagccacccctggcaggggaggaaggggtccctgagtgaagccccattgggggatgggctgggagccaccggggcacgttgggatgagctgcacactccaccctctgcacggccctccggttttctcagccctggtgggtgaggttggtggccagggcctgggccaatcgggagaggggagggctaagcagagtggggatgcccggcagtgacccagcctctctccccagatgagcctttcctgcagttccgaaggaacgtgttcttcccaaagcggcgggagctccaggtgaggcaggagccctggtggccccaccaggcctggccccttgtgcccagcctccctgtccctagacccctggacattcgcaccttgccccagcccaactgagcagctctccctgccccagcccagctgagcggctgtccctgccacacccccctgcagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgaggtgagggcctgtgtgacttgaggcgggggcgctgggtgggggagtttgtccttggaatggaacttacaagcagtcttcagtctcgcaaggtgggggcagggtcctggagtcaggaggcctcagccccgcaggctcactctggccctaggcagttgttccgcccctcagcctccttttcctcacctgtcctgggctggagcctcaggtgaagtgaagtctgggagaagaatctggagccctgcctcctgccggccagggtcagaggagctgggcttttggagtcacagccagggaccacccagatactgaccctttgtcaccagtaacaggccagcttagttccagacttctggggtgttccccaggcggtcggcaagctggctgtccacctcccagccctctccaggagccgagttctctgctgtgtaaattagcagggccttgggtggcgaggattgagtctgccctgccaaagcccaggccggtctctggtctccatggaggattatcccgaggtttagaaataattccagtgaaggggccggacgcggtggcccaggcctgtaatcccaacactttgggaggtcaaggcaggcaaatcgcttaaggtcaggagtatgagaccagcctggccaacatggtgaaaccccatctctactaaaaacacaataagtagccaggtgtggtggcacacacctgtaatcccagccgtttgggaggctgaggcaggagaatcacttgaacctgggaggtggaggttgcagtgagccaagggcatgtcactgcactccagtctgggtgacagagtgagactctgtcttaaaaaaaaaaaaaatgccgggtgcggtggctcacgcctgtaatcccaacactttgggaggccgaggcgggcagatcacctgaggtcaggagttcaagaccagcctcaacgtggagaaaccccgtctctactaaaaatacaaaattatctgggcaaggtggtgcatgcctgtaatcccagctactcgggaggctgaggcaggagaattgcttgaacttggcagatggaggttgcagtgagccgagatcaagccattgcactctagcctgggcaacaagagcgaaactccgtctcaaaaaagaaaaaaaaggactgagcgctccaactgcagcttatctgatggccggtccacagcccacagagtacccgctgcctgaggcggggaaccaactgtgggtatgccagggcctctcctccttcatgtggggcgggggagatgccctttcttttgtgagcctgtgctagttgtaggttggcgttttcacgtttttatctggcagaacaaagcattgagagcattaaaacccctgcaccagttttggttataaaagttccaccagttcagaaatcccaacgttcctgacttggtgacacagatgttgctctgaaaccctcctgctgcagtctgattctaggcaggtgggggctctttgttcggcctccagaccttccctcagcctctcacctctgctgtgagctgcagacctgggcccatctcctgggcctccttcactcgcctggctgccctgtgtgtctgtgtgccctcgcaggtgggggtcagggacctctgcagtgccgggcacactgcgggtgctcagggtggtgggttccttcccttctgggggtgaagaggggcctggtgactcctcgtgtctttcccttcggctcctatgagtttcctgggtggacacgtggtaaccaaccaggcaggaggcaggaagggttgggtgacaggaccaggccccatgggggcccttggtgcacatggggctgcagtgcagaggctgccggctcaggcaggactggtgggaagtgcaggaaggtggggcccgggttcctgttcctggatggagatgcaggcatctggagccgcaggatgagcctttggcttcagacggtgaccccgggtcagacgggcagagggacagccccaggtgggcctcatagggagccccatcacaatccttggcctgcacctggagagcttgtcaagttttagggccgggggagctcacctgggacaggtgggggtgtcaccatccccactctgcaaaggaagcaggcgcaggacaggaggtgcctctcaccagctgtacagctgctctcggcagaagcagacaggctggccctggagtctgcccttcggaggggggccgagaactgaaccccctctgtctggtgcctgggtctccccttgtgggctccttacccagcctctgacttggaagtagatgtgtgtctgcttcctccaggcagccttgcttccctcgccctcccccgtgagcctggcacctctggttgggccgctagcacctgtcttccttcctccacagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtaagagccacagccccgcggtcccccaccccctccgcaggctgttcttgggctttgctagcacagctgccagtgagcccacctctgctccagctgagctgtgtccccatgaagtggtgtcttgtcacgagcacctcaggccccaccgttccaagctgggcacctgtcctccccttcctcctgtcaggggctgggacaccttggatgggtcctctccttctacctggcacagtcacctcgtcactggcccggccgacctcgccttcagccagctgtctctgtcacgcaattgttgtctaacaaacagctctgtgcacctactgcacgcacgctccctgggcactggaggtccccctgagccagagacaccgtgcccctgcctgatgaagctgatgttctagtggagagagacgagaacacagaggttgaggagagcctgtcattgggcacaggcggcagccaggagaccagaggatggggtgtggcttgggccttgtggtcagaacaggtgagatggtcagatgcaggacgttctgagggcagagtgacaggatttgccagatggatgtgcagtggatgaagcgaaggagaggaggcagagaggactggcctaagcccctggcagatggcgttgtcctccgctgagctgggggcggcactgtggagtggtcagggaaagtttaggaatttggttttttgtttttgttttgagacagggtcttgctctgtcactcaggctggagtgcagtggcacaatcgtggctcactgcaggctcgacctcctgggctcaagcaagcctcctgagtcgctgggaccacaggtgtgcagcaccatgcccgggtaatttttctttcttttttttttttttttttgagatggagtatcgctcttgttgccaggctggagtgcaatgccatgatctcggctcactgcaacctctgcctcccaggttcaagcgattttcctgcctcagcctcccaagtagctgggactacaggtctgcaccactatgcacggctaatttttgtatttttagtagagatagggtttcaccatgttggccaggctgatcttgaactcctcacctcaggtgatccgcctgcctcagcctcccaaagtgctgggagccaccacgcctggcctaatttttgtattttttgtagagacggggttttgcctgttggccaggctggtctggaaccctggggtcaagtgatgctcccgcctcagcctcccacagcactgggatcatacgcatgagccaccgtgcctggctgggagcttgctttggacatgttgattttgagatacttgttagacgccccactggcgacttcgagtgggcatctggtgtctagtgcagtctgaactggagctcgtatttggcgaatcctatgcatatggatggcacctgaagcctggagagatgctgggaggcaagtgtgggccaggtgagaaggggccctgggccccccagcaaggcaggagggctctacccgcagcagctcctagcgcatgccccgcttgtcctcctggcagctggcgatggatgtgggctccagcctggtgggcgagcgtgagcagggatggagacagtgagtgtgaccagctgtcacaactctgctgtaaaatggggtcaagcaacgggtcttgtagtggttttgagggggaggtgacagcccatgtgtgctgaccggcaggtggccctctcctggctgctttggtttcctcagtgaaatcggagggctggccatcagctgagcttgggggacagaagtcttccggaggaggctggagcaggacggccccaggaattcaaggtggcccatgctggtctccagccccatcccatcgcgtggagagagcggggtttaacttgggctctggctcagtgggtggtgagggcaagggtgagcctgagggacaggagaaggcaaggctgcaggagggacaggtggcagctcttctcaatgtttttttttttttttttttttgagatggagtctcgctctgttgcccaggctggagtgcagtggcacgatcttggctcactgcgagctccgcctcccaggttcacgccattttcctgcctcagcctccggagtagctgggattacaggtgcccaccaccatgcccggctaattttttttgtatttttagtagagatggggtttcaccctgttagccaggatggtctcaatctcctgacctcatgacccgcctgcctcggcctcccaaagtgctgagatcacaggcatgagccaccgcgcccagcctcttctcagttttgagccctggagccactcccctcacctcctcgtgcttcccagcaggtccctgctgctgaaaggtctccgcctggacagtggtcagcaggctctcctggccacctccagcagccctggcccccagaccaagtgccaaacccacgactggctttgctccacacctggggccacgcgcttccctccgcctgcagtgcccacccttctctgtgccatcaggcccttctccctccggtcgcacactgccagctcagatgctgccacccctacgaagcctccccttcatcccacctctgtttctcccttccctggggcgggtttcagtcacccaaacagcagaagttcctcagagcccaggttggggcctcgagcagcctccctcagcatttctggtgctggccggaggctgaccccagtcccctccccaggtgtgccttcttccacggtgaggttgacaagccggcccaaggctttttgcaccggggtgggcgcaagccagtttctgtggccatcagtctggaaggcgtgcacgtcatcgatagcagagagaaggtactgcccccagctcctccagggtggagaggatgggagggggctcctgactcaggtcttcctggttcctctgggcctgtgggggcctgggggcaaggtggatggactgtctgggagggaccctgcctccgttggatgtcctcgtagcccctgagggtgatcctgggtcctcttgcccaacatgctaggctgtggggtggccggggcaggggaggccgcagctgggacttcactgctgagtggagggagggcagcagggcccgctgctctgcctggctgatggctggagaacagcctgatgctccagaagaccccgcgacgggagccctcttgggctgaccgtgtcctcttctttctgcgtttggtggccagccctgggtagagagccgcgtcagcagccagccctgtggggcagattacctgtccctggacagaaatttgctcctaagccagcagaagagttttggctggcttctggttgtcccggaagaaggaccccagcccctgctgccatctgtgtcctgggaggcagggcccagctcagcctcatgctagatgccacgcccgacctcatagaagagactccgcttccccacctgcctcctcccccacgtgcctcccccgctgtcaggggcttggcctgctggtgggactgttgtgggagaggggatctcagcttccctggaccacagcccctggcaggctctgatgaaagctgaggctctctccttacagaaacacatgaacaaatgtagactcagccttggagaggcacacaccctggccaggtgtctgagtgggatggggtggggagcagacctctgcccaggggtcaagcctggctctgtgtctcctgctggccagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggtagcgcgggtggtgcctgcacacgggtggggaggctgggcccaggtgccctgggtcccagacaattagaggcaccaggctggcgggcaaggaggtgagaagctgccttgggcctgaggatgaaagcggcctgggcacaaggggtgccttgagtcctgctgacccagagctgccctgggaggtcaggaggcctggtctgcagactccacgccggtggtggtggcagctgtggggttcgggcagctgtttgttgagggcttgctgagtgctttgagaccagcctgcaccctcccctcctgtccccaagaccagtgctgttgtgaccctattcacagtcacctgcggtgggcgtggaaacgttgggcctctccaagcctgtgtttgattttccccttcattcgtcgtgttttactcagcaccgagcacctcttctaccccagcctccctccccagcctccctccccagcctccctcccctgcctccctcccctgcctccctcccctgcttccctccccagcctccctcccctgcccctccctctcccacttgggtcacatcagacgcccctccctcccacagggccctttcaggactgttcccaccccttcctcctttcatctcgggtctctctggatccttcattccacacctctccggcttccttttggtgcccttcacccctcccttggcagccagaccccacccctgcgcctcccatgctgggggctgcttctagccccatcggcctctgctttgccacaggagggccccctcccccttctcagcttaactacatgctcctggaagcttctttccgcccccaccagccacctcctcccccagcttcccctgctgctccccattttcctggcccccctcgagggcactcctctccctgcctcatggctttgaactccaagatattctcacctttatgttcaaagttcacaattttctttttttttttttttttttgagacggagactggtttatgctttttgtttcctaagaaattttgcctaacccaagaccacaaagattttctcatgttttcttgtagaagttgtataaatttaagcctcccagccatcccaaagtcaatattttacatcaggtgtgatatacaggtcaatgttcatgttcgtgtttacagattctcaattgtttcggtgtcgtttgttgaaaagacattgaattggccgggcatggtggatcacgcctgtaatcccagcactttgggaagccaaggtgggcggatctctttaggctcagagctcaagaccagcctggccaacaaggtgaaacccccatctctactaaaaatacaaaaaattggccgggtgtggtggcacacgcccgtaatcccagctactacttgggagactgaggcacgagaatcacttgaactggggaggcagagattgtggtaagccgagatggtgccactgcactccagcctaggcaacagagtgagactctgtctcaaaaaaaaaaaaaagaaagacattgaattgccctgacatctttgttgaaaatcaattggctgtacatgtgtgggtctgtttctggattccctcttctaaaccactgatatatgtgtgtctttcactgataatcacactatatattgatttttgaacctttataataagtcttgaaatcaggtagtctgataaccagaactttgttctttttaaaatggtttccatagaagttttagaatcagcttgttgatttgtagcatgctccgctatccaccccccaaaaaaaggctacctaggatttttattgagatcgcattgattacttcggaggtcattgacctcttaagtcttccagtccatttatttctgtatctccatttatttgtctctgatttctttcattaacattttatagttttcagcatacaaaacttctgcatcttttgttagatttatccatttctttttttttttcttttggtgctactgtaaatggcactgtttttaatttcaatttccaattgatcatttccttatatagaaatataattgtttttgttttttttgaaacactcttgctctgtcaccgaggctggggtgcagtggcgcaatcatagctcactgcatccttgacctctgggctcaagctatcatcccaagccacaggtgtgcaccaccatgccaggctaactttattttatatttgtagagacaaggtctcactatgttgcccaggctaatcttgaactcctgggctcaagtgattctcccaccttggcctcccaaagtgctgggattacaggcatgagcccctgtgtctgccttttttctttttttctttttttttgagatggagtctcactctgtcgcccaggctggagtgcaatggcgcgatttcagctcactgcaacctccgcctcctaggttcaagcgattctctcacctcagcctcctgagtagctgggattacaggagcctgccatcacacccagctaatttttgtatttttagtagagatgggttttcaccatgttggccaggctggtctcaaactcctgacctcaggtgatccacccgcctcggcctcccaaagtgttgggattacaggcgtgagccacggcacctggcctggcctgggactttctatgtggacagtcgtgtggtctgtgagttgggacagctgggtctcactttccaatctgtgtgcctcttgcttgccttgcctgacagtgcttctgacccccagtgtaggatggataggtgtgcgcaggcgtccctgacgcacctggcctgagagagaacattgtctttcactgaataagtgggattttgctgtgggttcttcagagatgcgcttcatcaggttgaggaagttcctttctgacgctggcttgctgagttttatcttggacagatgttcagcagagcttcctcttttggctgcatttgaacggcaggcttcctgagcctcagaggcatgttgctgtgcaggagtttttgttctaggaaacttagtaggcttccctgttatggttgcactcaggactctgtccccaccggctgccgtcccctcgccagcccactgccctttggctggtggagtccacttggtgaggagaggagtgtgggtggactgagctgagggcagggagcgtggagagcccaccaggcctctgctcttccttctgggccgagcagcggtgcccacctgcccagcccagagggattgtagctgccctgtggagaggcaggagccaggccagtctccgcagggccactccagcatctgacccagccccaccagtcaggagcacaggtggccattcctgtctacttggcctcatcttatcccaggcctgcagcagtgcttggcacgtgggaggcactcaggaaatacctgtgtcctaaggggtgccacccttttaacaccctctgcgactccctcaaacccctgaaggccctgtccttggtgcccagctgtgcccgctggcacccggctgctgcatcttttctgtcagtgtgcctcatgcttcacacctgttgagtaggagtcacttttgaagaacgtgctggcagggagccgcccgcccctgccctggtgacatcgcgccccttcctcctggctgcaggttttcctcccagccagcaccacccgcctccccgccccgcttccccactcttcgtcctctctgcagcagctggctccctaccccctccctccccacctgcttctgcccatggagtcagccttcctgggctgtgccttctgaccagaatgttctttctttcccacctgaactcccagatctggagacccctcctcatccaccaggactcaccttcacagtcacccaagtgggacacctcccctgcctccctgctccctccctcctgagtgatgtgtgtcccctcccctgcttccccaaccagagagcagagctcatttcaggctcagcaacaggcatggaagggggccctggccaggcctcacactgccccctcctccccaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggtgagcagcccttctgtgcatgtgcacacacaaacacgcatgcgcgtgcacacaccggggggagttcctgaggacagggcattgcagagcagctccagacccagtgtgagctggcctccatctcaggacacagctgtgagcaggccgagcccgggccttggccatagtgcctttcctgtcccttctcactgctgcgtcacagacgttctgcagcattgtccaggatgtgatccgggaaacgactcaacatctgttactgaagtgttgggtaggtggggcgcggtggctcacgcctgtaatcccagcactttgggaggccaaggcaggaggatcacctgaggtcaggagttcaagaacaggctggccaacatggtgaaaccctgtctctactaaaaatacaaaaaaagtagcgaggtgtatggcaggcgcctgtaatcccagctactcgggaggctgaggcaggaaaaacgcttgaacccagcaggcagaggttgcagtgagccgagattgcatcattgcattccagcctgggagacagagcaagactccgtctcaaaaataaataaataaataaataaagcgttgggtaaatcactgctgtgaccacatcttggggtgttgagtgcagctggtaaaaatacagtacccaggccgggtgcagtgtctcacacctgtaatcccagtactttgggagaccaagacaaagaggatcacttgagcccaggagctcaagaccagcctggacaacagagtgagaccctgtctctacaaaatatacttaaacttagctgagcacggtggtatatgcctgtagtctcaccttcttgggaggctgatgaggcaggagtatctctgagcccaggagttggaggtttgcagtgagctacgattgtaccactgcactccagcctgggtgacaacgatgagaccctatatatatatattttttttaattaattaattagttaactatttttgagacggagtctcactctgtcgcccaggctggagtacagtggcatgatctcggctcactgcaacctccgcctccccagttctagtgattctcctgcctcaacctcccgagtagctgggactacaggtgtgtgccaccacacccggctaatttttttttttttttttgagacagagtctcactctgtcgcccaggctggagtgcagtgggcgcgatcttggctcactgcaagctccacctcctgggttcacgccattctcctgcctcagcctcctaagtagctggaactacaggcgcccaccaccacgcccggctacttttttgtatttgtagtagagacggggtttcaccgtgttagccaggatggtctcgatctcctgaccttgtggtccatccgccttggcctcccaaagtgctgggattacaggtgtgagccactgcacccggccctaattttttgtttttagtagagatggggtttcaccgtgttagccaggatggtctcaatttcctgtcctcgtgatccacctgccttggcctcccaaagtgctgggattacaggcgtgaaacatcacaccaagcccgagaccctgtttttaaaaaggaataccctggccgggcgcagtggctcacgcctgtaatcctagcacattgggagaccaaggcgggtggatcacctgaggtcgggagttcgagaccagtctgaccaacatggagaaaactcttctctactaaaaatacaaaattagctggatgtggtggtggtcgcctgtagtcccagctacttgggaggctgaaagcaggagaatcgcttgtacccaggaggtggaggttgcagtgagccaaaatcacgccactgcactccagcctgggcaacaagaacgaaactccgtctcaaataaataaataaataaataaataataaaaaggaataccctaaatgcatcttgtgtcagatcctggaagagaggacatttgtggaaaaactattgaagtccaaaagaattttagttaacagatactgtgtcagtgttcattccttagctctgatgtggtgacagaacatgctgtcatcgggagaagttgtggcggtattctggaactctctacacctttacagctttcctagaaatctagaattattccatgataaaaagttttttaatgcagtaacaaagatctacatttatttatttatttatttatttatttatttatttatttagagacagagtctcgctctgtcacccaggctggagtgcaatggtgtgatcttggctcactgcaacctccgcaccctgggttcaagcgattctcctgcctcagcctccctagtagctgggattacaggggtgagctaccacgcccaactaagttttgtatatttagtagagacggggtttcgccatgttggccaggctggtctcaaactcctgacctcaagtgatctgctcaccttggactaccaaagtgctgggattacagtgtgagccaccgcacccggccagagatctacattttacatggcaagatgttcacaaaataatattcagtaaaaagaaatggccaggcgtggtggctcacgcctgtaatcccagcactttgggaggccaaggtgggcagatcacgaggtcaggagatcgagaccatcctggctaacaggtgaaaccctgtctctactaaaaatacaaaaagaaaaaaaattagccagacgtggtggtgggtgcctgtagtcccagctactcgggagaatggcgtgaacctgggaggcggagcttgcagtgagcggagatcgcgccactgcactccagcctgggcgacagagcgagactctgtctcaaaaaaaaaaaaaaaaggaaatgagtaacaggacagcatgtgtgcagccatgcgcatgaggagggcgggcccagctgtggccgtcagcggctgtagctttgactttttctttgtacttcttggagcacgtaaatctgttacaatgaacatgtcatttttatagtcttgtaatttttagaataattgttttttcttttttttttttttggagacggagtttcactcttgttgcccaggctggagtgaaatggtgcgatatcggctcaccgcaacctccacctcccgggttcaagcgattctcctgcctcaggctcccaagtatctgggattacaggcttgcaccaccacgcccagctaattttgtatttttagtagagacggagtttctccatgttggtcaggctggtctccaactcccgacctcaggtgatccgcccgccttggcctcccaaagtgctgggattacagtcgtgagccaccgcgcccagccctagaataagttttataatcagaaaaagcaaactttttctacaatgtaatttggaccactgtgtggcattccttggcatggttttagcacgctcattttgacccagtcctctgcttgtgggcattacagttttcagcgttcagctcttctaaacagcacacctacaggaaagtccttccttagaatctgaaatgtttcctcaggatactttcctagaaatggccttgctaatgtaaaagtgtgcagatttttttttttaaataggatttcactctagtgcctagactggagtgcaatggcctagtcaaggctcactgcagcctcaacctcccgtgctcaagcagtccttctgcagtctcctgagtaggtgggactaaggtcatgagccaccactcctggctaatttttaaattctttgtcaaggcagcgtctcactatgttgcccaggctggtctcaaaactcctgggatcaaatgatcctcccacctcagcctcccaaagtgctgggattacagatgtgagcaccgtgcctggccgatatgctgattttgaagaggcttttcatacctgccaccttccagagaagttgtgcccaggtgtaccctccccagcagagaagatggtgtctgcctcccatgccctcacccacaatgggtgtaatcattccgagccaaagggaacttgtctgggctggtgtttgaacacaatgagattggaaatttttttttttttgagacagtcttgctctgttgcccaggctggagtgcaatggcatgatctcagctcactgcaacctctgcctcccgggttcaagtgattctccctgcctcagcctcgcaagtagctgggattgcaggcgcccaccaccatgcccgatcaatttttgtatctttagtagagacagggtttcgccatgttggccaggctggtctcgaactcctgacctcaggtgatctgtccgcctcagcctcctgaagtgctaggattacaggaataagccaccgtgcccggccgattgcaaatttttacgtgcttgatcatatttagatttccttcctgaattactgatgatttcttttgctcatttttcttctgttgcttgactttttaaaattaacaatctggccaggtgagatggctgtaatcccaacactttgggaggccgaggcaggcagattgcttgagtccaggagtccaagaccagcctgcgcaacatagcaagaccgcatctctatttaaaagattagcagggcatggtggctcacgcctgaagtcccagctagttgggaggctgagatgggaggatcacctgagcccagagggttacggcttcagtgagttaggatcacaacactgcagtccagcctgggtgacagagtgagaccctgtcgcaaaaaaaaaaaaagaaaaagaaaaatttattaacgtcttggctaggctcacacctgtaatctcagtactttgggagacagaggcaggaggctcacctgaggccaggagttcgagatcagcctgggcaatcgagcaagaccctgtctctacacaaactaaaaaaaccttagccatggctcacacctgtagtcccagctattggggatgctgaagtgggaggatcacctaggcttaggaggtaaggctgcagtgagccgtgattgtaacactgcactccagcctgagcaacacagcttgtctcaaaaaaaaaaccacaaaggcgggacatggtggctcacacctgtaatcccagcactttgggaggtcaaggcaggtggatcacgaagtcaggagtttgagactagcctggccaacgtggtgaaacctgtctctaccaaaaatacaaaaattagccaggcacagtggcccacgcctgtaatcccagcacttttggaggccaagatgggtggatcatgaggtcaagagatcgagaccatcctggccagcatggtgaaaccccgtctctactaaaaatacaaaaattagtgtgcgtggtggcgcacacctgtagtcccagctactcaggaggctgaggcaggagaattgcttgaacccaggaggtggaggttgcagtgagccaagatcgtgccattgcactgcggcctgggtgacagagcaagactccatctcaaaacaaaacaaaaggccgggcgcagtggctcacgcctgtaatcccagcactttgggaggccgaggcaggcagatcacgaggtcaggagatcgagaccatcttggctaacacggtgaaaccccgtctctactaaaaatacaaaaaattagctgggcgccgtggcgggcgcctgtagtcccagcttctcaggaggctgaggtaggagaatggtgtgaacctgggaggcagagcttgcagtgagccgagatagtgccactgcactccagcctgggcgacagagcgagactccgtctcaaaacaaacaaaaaaaaacaaacccaaaaaaaaccaaaaactaacatcttacagcaatatggtacttttgttttaattaatgacccggtattgccattattagccaaagtgcctaccttagtcagatttccatagtgttttccagacatccctctgtgccaggatcccaccaggaccccacactgcatttagttgtcacgtctccccaggcttctcttggctatgaaggaccctccttgtctgtgatgaccttaggtcggcagtgttagggagcgctgcttggggtatactgtagcatgctgagcggggctgaggctcggatgaggggagctcagtctgaccaggctctggaaggagccgtcgcgctggagccagaacctggcttcctgggcctgagccccctcacacagggacagcgcctctgctcagtgtgccctcccattccctcgcaggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggacaaagcagtattttactcattctttgaatgttctcattcttttgtatcatgtgacttattaaaatcagtttctaacaaactctggggcagctcatgatatgaaataatgagggtgtgtccgtgacagtccaagagttgattacaggctgcatgtttggttttcatgaaacgtacgtcaaggtgtgcagccctcaggccagccaggttgatgcccacggagcacccgagtgaagctgtctcatcttggcggcttgtactcccagccccacgttgcccaggaggggctctggggttcctgtggggaccaaggtgggtaactgcagatgctcatgcccttcctgagggcacctcatgctccaggcctggcaggaggccgtttgtttcccacagatcctgctgtcaacacctacctgggagggaagggacagtagcagacccctggaggactctgagccctgcagcagccacccaggacctgggcctgcaggatgagcgccactgggggattggggttcacaatgtttccagagatgggaggagtaagccacctgtccctgtggcagcgtagtcctgggaacagggccgtctccttgggtgtccatgacagtgagtggcaccttgtcctctgtgtgatcatctttgcctggcaaggcagcacaatgccatgaccatgggcacctgtgacctttcgtgggaataacagtgcccaggccaggcacagtggcttgctactgtaatcccagcactttgggaggccaaggcgggagggtcacttgagcctagcctgggcaacatggcgaaaccccattgctacaaaaacaaaaaaaattagccaggcatggtggcacaagcctgtcgtgcccagctgcttgggaagctgagactagaggatcgcctgggcccaggaggtcgaggatacagcgagctgtgttcacaccactgtgcactccagcctgggcaacagagcaagaccctgtctcgaaaaaaaaaaaaaaattccgaaaaaacaactcacttcggccaggtgcagtggctcacgcctgtaaacccagcactttgggaggccaaggcgggcggataacctgaggtcgggagtttgagaccagcctgaccaacgtggagaagccctgtctctactaaaaatacaatattagctaggcatggtggcgcatgcgtgtaatcccagctactggggaggctgaggcaggagaatcgcttgaacccgggaggcggaggttgcagtgagccgagatcgtgccattgcactccagcctgggtgacagagcaaaactctgtctcaaaaaaaaaaaaaaagtaaactgattgtctcacagttctgggggctacaagtccaaaatccaggtttcagctcagcagggccgtgctccctctgcaacccataggagaggccttccttgcctgctcctagcttctggtgccttgctggccgttcaggcattcattggcttgcggctgcacagccagtctctgcctatgtggtcatctggcatcttccttagtgtctgtgtcttcacatggctgtgttcttacaaagacaccagtcagattagactaggggcccaccctactccaccatgagctcatcttaactaataacacctgcaatgatcctgttcccacatcatgtcacattctgatgcactgagggttaggacttcgacatatccttttgggggaacacgatttaacccttaccactaccctacagatgattgtcttggacttctttggggttctttaatgccggaacagctgttattttcaaatcctagctacgcttgggttgcacggggcagcaggagtgactttgccacctgccagcctggcacgcacagcctggctcagccagcacctggatccagaggcctgaagacctgaagaggctctgcccagactgcccctgaggacagtgcagtgggacgaggtcttcacagtccccagtccccagactctccctaactcttcagaatgcaggaagcagaggtgaccagaacagtcaacacatgcgatcctactgtcccttctgaggctggggtttccaggtcattctccacttacagcagcagctggggcattcctgcgggcttcccaacccggggctagctggacacaggaggctccagccacaaccagagcccagcaagaggcttgcgcagacccacagctgaggcttcatgtggccagcccccagccaagtggcagtgcatggagagacacacgggaggccagaggtgctgctgggactcagaaaagccacagcgaccaaggcgacccaggacgctgtcatgctcagtctgaaaaaacagtggtgcaaggggcacagataaagctgggaaggagagggctggggtggatgtgccaggggcctctgacacttgtcagggagcaggagttccaactgctccccgcacacagggttgcaggattagcaacagagttacccatggagacatcagctcagagtccaggcagcttttcagatgacaccggggataagaacataaagaccaggaaaatgggtcactttgcacacacatgatgccccaacagatgtgcaggccaccacccaacacaaagacagacaatagactgggagggggagcagtgatcaaacaaggcttcctggaggagggggcctgacaggctcagtaggatacaggtaaatgcagcaaagagagagggcatgggatggagcagggacagtcaaccaaagcctgtgactttgagcctaagggacactgacagtgctgacccaaaggaggtgcaggcctcgggacagattctcatcgctcattcttctcctttgtgcagaggacttttagagctacctggcatttttctccctgtccaaatccaccccacatttcaaagaaagtaggcagactacccaacttcacccagaatgggggtgcagggctgggcctgggtctgaggacttcagttttaagcagcaagtccagtgccgtgtggtggcccggctcctctcgcccccactgggcggacagcgtgggtggggcggagcctactcccatctgcaggttgctggttcggctgcggccagcagggggcagctgagctcaccctttcctcctgccgggctgcagggacagtgacagtgagcagcactgcccgcccaggcaacctggaaccagggtcgtgccccacgacagaatctcgggggccttgggtctggcgctgcgggctcacccgctctcagagtgggagtcctggctcctgactgccctgaccttcttcctgccactgggcccatgatgggggtccccaactttcaagaacacagggtaaggggtttgtttccctggtggtgggcgggggcattcctcagcttcgtgatgggtcctgagttttccaaaggtcaggatccatgtcctggaaacggattctgctgtagatgtgtgcttttctgtgaaatgacagcttagtaaaaatacttaaactggggctatttggagacatctaagaggtggagtgagcacaacctggcactagtcgcctccctcctgaggcagttgactgtccggcctctgcccctgggcccttcctccttcccagctgccctgagccctcttccagcacctcctgtccccacctcacacactaagtcttcctgctatttttaactatttgacataatttgcaaaagagagaataatagtcccagctcttcccaaggacttctttgtccggtgcccatctgaccttggcactttgttgtgggggtggcagtgaccctgacaagttctcccagccagcgagagcacaggcctcccatacagtatcgtcaaggtcagcagcctcccgggcaggggggttctactccccgcagaagccctggcaccatggccaacttgctcacagagggcactcagtcagaccaaggtgggttggggcagaaaaggctccttcagagattcaaggacagtcacaactggtgctgtgatggggccaccgggacaagcacagtgcaggccattcccatcagcagggacccaagaggaagtggtaggctctggcagtgggggcggctggcggtcctgaagacagagggctttgcaaacctaggggtggaggtagtgggatgtcagcacctgggctccctgctcagaggagctggcgccaggattcccagtgggtgggcttggggaggaggctggaaaggttagcacaggcgaaagtgtggggcctaggaaagctgggctcgcttatttggccaaggagggtggggagggttggaggaggtctaggggccgctggaggtgcagggcagcccggggaggcagggctatggggcccagccacgcattccacaggccttctctctgcgggaacaggagtgaggacacaggcgctcagcgtggcagggtgggaacaggaaggtctcgtgagctctgtgacaggatggggctacaggagacagaggtagcagtgagctggtgaagaggcaggaggaggcaaggaggacagggtgttctagggtgccagctcaggcaaggctccaaggagtgggtgagtgctcaggaggacgggggaccaaggcctggggtaaggggcaggtgcccaggcactctagcatggcacggaacaggggacagtcccaggacatccggatgcagggggctgacaccgcaaagttctttcctgtaaagcacagcccgaggcctggggcttggccctgggcagaggaagccccccttagatctgccttggcagtagtgaggaaagggcgtgcacagaccccacgcagcccgaggtgacgggtcaaatgcaagagtgagaagccccctcctgagggtcctcccctgcctcgccttcctggtgggcggcctgctttccagcacatgtggtggaccagcccacattaggtcaaagtgttaaaaatagccggagggctcagtatgtttgggggtggggggggaatgggaggtgctgagggagggcccaggacagttgggaaggaggaagggcccgtggggctggggttgggacagtcggctcctgtaggtgcagcagccctggggcatgctcacctcacctcacctcagctttgtaaaccagggccatgggagaccccctccctctgatgccctctccctcaaatgcctttgccaacgtgtggctgagagtgcaccccagttccccttggccaccccaggcagtcccagtccactgagagcagccgctgtccttcttccctctcctgcctcctgacctgggaccccacagagctgggcctgtcatcacatttatggggctgcagctgacctgggaactcccttcctcagtcagtccacaaatatttacccagagcctcagggtgctcagtgacctttacaaaacaaagtgcagagtcacgtgccagggcacagcaatcccgggcaaaacagaccgaaacccctccctcgaggagatcaagttggggcggcgctttagagttgtggtcaggaggctggctgagtggtgaccttagggcagaggcctgaaggagcagtggaagtggactaggcagcaactaggtgaagagtgttccaggaaacactacactgtcagaatcaagagatgttagggccgagaggagcctcaaaatgggggaagcaaggctgggaggggtggcctaccctggtcacatgagaggtgggggcagagcaggccggagcctcacaggaagaggccggttagagttgggggtggggcccagcttgtgtttcctgcactggctgcgaggcgtgaaaggcgggctcccggccagcacacagtgacagtgcagtttccagacccaggccctgagctgaggggcctcagggctcagaaagggcctaggcctcagatctctggtgagcggggagcccaaaatggccctggaggccacagctccagaactagacccgtggagaatggagggctggggccctgcacattctcaagcagtagtagcaacactgtcattgtcctgcccttggtataagcctgaagaaccaccctttcttacccggcttctgctccccttttccaggggctcctgtgggaaatcccgggtacttcctgggactggtctgtctatatgtttggaaaccacagagctgacctggcttcagaacaagatgtggggctccaggcacccgggagaccagtgaccctgattggcaatagccgcaagaaagggcttggagacaggggccaggcgcggtggctacccctgtaatcgcagcactttgggaggtcaaggcaggtggatcacttgaggtcaggagttggagaccagcctggccaatgtggtaaaaccctgtctctactaaaaatacaaaaaaaaaaaaaaaaaattagccaatgtggtggtgtaagcctatagtcccagctactcgggaggctgaggcaggaaaatcacttgaacccaggagggagggtgcagtgagcagagatcacaccactgcactccagcctgggcaacagagtgagactccatcaaaaaaaaaaagaaaagaaagaaagggcttggagacagggccctaaccctggaatccagatgttgccaaagcagccccctcctgttcctctgtctgcctgggaagaagcaggagttggccacccacacaggcagggcgggcccttcaccacccagctccaccccggaatccaagggcctctgtttgctgctgttttctggaacaacttgttttgatctagagaaatctgctgacaccggccttcctgctctcaccctccagctgggcagaggtatttttagacttatttgtagaggaagagagcagaacccaggcccaatgtgtaccctccttactgtgggcacagctttggccccttaaggcaggacagagatatccatgtggttgtctaccctcagctcatctctccttaaatacattcctttcccgagaaaaacgagctgtgtggaacttggaggccagcaaagcttctacataaggaccctctgaaacagtgcccttttgtccttgaaaacccagggtggcaaaggcagctccagatacaagggcacaaaggagacttggttccctttgtgacagggaagcctatgctttacagaatcctatgttttgtatgtcagtaattgtccctacttaaaaaaaaatctatatatatatatgtattagaaagggtctcactcttgttggccagcctggagtgcagtggcacaatcatagctcactgcagcctcaaaatcctaggctcaagggatcctgctgcctcagtctccccagtagctgagactacaggcagtcatgtgcacctggcttttttttttttttttctttcattttttgtagagacagggtcttgctgtgtttcccaggctggtctcgaactcctggcctctaggcaatcctcccaccatggccttcaaaagcgaatggatcccactcttttttgaaaaataaaatctaccatagtttgtttctgggatttgggaatgatgtgtgtgaattagagagatttcgagacctgaaatagagaaaagcaagttaagacatcaactggggcccagaaacagcactacagcggggacgacccacctctcagatgcctggtgagataaagaaaggtctggctgactccactgcccagtactgtgaagcagcagtgaagactcctccattggtttcataagctgcccagctttctagaacattttgacagacaattccctctttccacacggttctttcaggccaaatcaccccaccccaacccacccctggagatacagtcaggaagagactgatggggcagatcctggaggaggccgcactgccggaatcttcccctggcagagaaacagggctaagcaggcgccagggagcaagcctgggcttgccacatcaccaccttctgtgctgaaggtcagatgacacacagtcaccagttttccgagaagcacagggaggggtgcatgtcaggcccagccctgcctgctgataccacctcacagacgcaggcgaaatgtcttcaccagcttcttctcggttgccaagggggcctgctttcaaggggttgttttgtatggggtgtgggtgttaaccagggagaggttcctggcaggagttcctgtcagatgccattttccattctggttacttgaaccggggtcctttttcatcctctacctcaggggccagagcttcctcatcaccctgcaccccctagcaagggaggtgcccgctacacggtccaaagtcctctccagacattcgggccctgcccgccttgctggagggctcaggagttcaccaggtttgcttccagaagagccaggctggggatgcctgcttgcaaatgcagcaaataaaaaataaataaataaataaaaatcacctttctccccacccccacccaaatgtaaaatgagccgacagcctgtccctcggctatgtcagatactgctttccgcacaatatcttggttttacattattttgcaacggcctcttcccacttaatccatcctgaacacacttcttgaatgttctaccccggcagggatgcgcattctcaggaaacacgtcccctcgccaggcccctgggaagagtcaaaaccacgatgcctgcccctgaagcgcccgcgcggctccacggggctccatgttgtcacccactagctcctggacgctatcagcccgcagcagggtttcctggccagagaaaccgcctgttggggtgcggagcgttccacgtcccctcgcagcaccccgctggccttctgggccgccccgcccccaacccgcgcccgggcgctgacgtcatcggccgagcccgactcggaaccaccgcccgaaagtcacgcgcgcctcccggcgggacgtgccctctgcagagatccctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccctcctgccctgctatcccctccctcatcctctggggccctgggaatacagcaggggacgtggggccacaggcagctgataacttagccccctcagccactcctgtgggagcgggagggggacagcttggcggctctgcacccaaagctgtggggcctacctggagtgtccccacccctcagggcatactccccactgccctcttcttcccaggatcaactcaccgctaccctcctctccacatctgaggaccagcgtggctcttccagggagggcttggggagatgaggtccaaggggagaggccagaaatcctgaggcctgggctggagatgggtgggcggacagggcccaacgaaccggcccttgtgcaggaaggccaacagctgggaccacaaggtgccgggtgggacagggaagtcagcctgtgctctccaggcacctgggacccaggagatccccccggctcagcaccagcagaggcagctgctgtgatcctgggcaggcagtgtcctcctccctcagtctctgccccctcccatccccaagagggaggccaggggctcacagtccatttcatgggccatgatactgatgctgtctgcagttggggcagcttgcctgaccacaaggctctccagggagcccctgccaatcactataataatctcctttaacgagtcaggccccataaggaacagccagaagcaggagagaggtatgcagagctggcctatggaggcttgccatctcttctgaccccacagagcccactcagaataccacgccctagtgggtcttcccagcccaaactcaagtcacaggatggcacaggtcctctagggagagctgggctcccatggggtggagggagccccaaacctcaacaaggctgaggggatgcagtatgcagggccagggaagggagccaggagacagaggggccgaaagccagtcagctttggtggagagaacccttcatgaggagccctggcttgggcctcctggtcaaggagtgtttgcagcaatctgtagtcccttagcccctggcaagttctggtgccagaaaatcccctccggagctggtgtctctctcattcaaggggtgagaagaggcagcgtgaagccgaggtcttggccggccatgcctgggtggtgaggccacaagtccacccctgcaactgcaagggcagcagggaggagctgcaggatctgctgtccttggatgtgatcagcctgccactggggaccaacaggcctagactcatacatgagccaaggcacagagcccaggactgaagacagagaggagccaccacacggcaaaagagcatggacatctgagtgccacctagcctgtgtgagactccgtttctctatctctaaaatggagtccgccaggcgcagtagctcatgcttgtagtcccagttactcaggaggctgaggtgggaggatcacataagcccaagaggttgaggctgcagtgagctatgactgcaccactgcactccagcctgggtgacagagtgagaccgtgtctcaaaaacaaaaacaaataaataaaatggagtcactgatagctacctcacagggttgttgagaaaattcgggataacatttactgcttgccacagggaaggtattaaaaagttacaggtgggcacggtggctcatgcctgtaatcccagcactttgggaggtcgaggtgggcggatcacttgaggtcaggagttagagaccagcctggccaacatggtgaaactccgtctctactaaaaatacaaaaattagccaggtgtggtggggtgcgcctgtaatcccagctgctactcgggaggcggaggcacaagaatcacttgaacccaggaggcggaggttgagatcgtaccactgcactccagccttggtgacagagcgagactctgtctcaaaaaaaaaaaaacaatacctgatactgaaatttaggtctcacaattctggaggctgggaaatccaaaatcaaggtacaggcatctggggagggccttcttgttgcatcctcacatggtggaagagcagaagatggcaaacccactcccacaagctctttttattttatgttttgagatggagtctcactctgtcaccaggctggaatgcagtggcactatctcagctcactgcagcttccgcctcccaagttccgcctcccaaattcttctgcctcagccttccaagtagccgggactacaggcgtgcaccaccatgcccagctatttttgtatttttagcagagacggggtttcaccatgttggccaggatggtctcaatctcttgacctcgtgatctgcccgcctcagcctcccgaagttctgggattacaggcatgagccaccatgcccagccacaagctctttttataagggccccagtccatttgtgaaggaggaaccctcatgacccaatcccctctcagaggccccctttccagtatgtcatcttggtgattaggtttcaatgtggcttttggagggaacaccacatgcaaaccatagcaggtggcttgtccccttctgtctggggaagagaagaaaaaagcacaccttccttagagtttcacccattgaaaagcagcacctcactctggacctgagctgaggccggagtagccgtggaaggaggacattcttgtcctgggtccccaaagtgctcttaactcaccctgcatcaggcaccagccacagggccctgggaaaccactccagggtgctatgtcagggcagagaaaggggacctgaagtcaaagagacttgtggggatcaccccatgacccatcccctgccctgaggcaggaccttgctgccagagacagaatggggcccctccattcaaggggggctgttctctgggcatgccatgtggggcatggcctcagtcacatctatagaagtgagatcacagggacaaggtggcctaggaggaaggggtgtgaggcccgctcccttccagcaccacactcactgccagagtctaaatctgcctcctgctggagtaggactgagacagagggactggtcaccctatctagcctgaacagctgagcccagggacccccatgaagcaggaaggaactggacaaaggagccagccaatctcctaattgacaaaggggccaatccgttgccagactgctcctggtggggctccacagacaacagcagccttgctgttgactccgcccccatcttccctcctcctgctgacacctcttcaggttcccacccccacccttcttttagggcaggcctggtctcaaagatctccacctactatgctccaggagccatggtttcagcacctcccccattcagaggcccctgggggcctgtctatgggagacactgtgatgcaggctgcttggccacttcaaaagcccttctctagggatcaggacatagctaccctcagccagcgcagtccgcatcacctcaatgatctgagtgatggtatcaaacccagtactgcactgaggaagccctccatgtttttctgcagggccagagaaaggggggtcaatagggcccagcaggggcctcatccctccagaggacaagaagggcagcccctcccgggccctcactccctcagcccaaaagggcaaagaccagagtctgacccgcccacccacctcccagatgtctccctgtcttctcatcaaggcgggtgatgttatacgcatctgggagccccgcagaaagcagcgcagattggatggagggctctgcagaagataaggattataagctaattctcctgaggcctcaaccccgccagctgaggagctgactcctcaaagtctgcagagggtcagtgtacctagctggccaatccacctcaatgctcccaaagtacacatgtctcttctcaaggtctttccccaacaccccccaaccacaagcccagatgtgaaggtagcttttttttttttttgagacggagtctcgctctgtcacccaggctggagtgcggtggcacggtctcagctcactgcaaccttcgcctcccaggttcacgacattctcctacctcagcctcccaagtagctgggactacaggcgcccaccaccacaaccggctaattgtttatatttttagtagaaagggggtttcaccatgttagccaggatgctcttgatcttctgaccttctgatccgcccgcctcggcctcccaaagtgctgggattacaggcgtgagctaccgtgcccagccagctttttctatttatttatttatttattgagacagagtctcactctgtcgcccaggccgaagtgcaatggtgcgatcgctgctcaaggcaacctccatctcccaggttcaagcaattctcgcgcctcagcctcccgagttgctgggattacaggtatgtgccaccacgcccaagctaatttttgtatttttagtagagacggggcttcaccatgttggccaggctggtctcaaactcctgacctcaagtgatctgcccgcttcagcctcccaaagtgctgggattacaggcgtgagccaccatgcctggccaattttttatttttttaaatagagatggagattctgtccctctccctctcccgtctccctctcccgtctccctctcccgtctccctctccctctcccgtctccctctccctctcccgtctccctctccctctccctctccctctcctttccacggtctccctctcatgccgggccaaagccggactgtactgctgccatctcggctcgctgcagcctccctgcctgattctcctgcctcagcctgccgagtgcctgcgattgcaggtgcgtgccaccacacctgactggttttcatgtttttttggtggggacggggtttcgctgtgttggccggagtggtctccagctcctagccgcgagtgatccgccagcctcggcctcccgaggtgccaggattgcagacggagtctcgttaactcagtgctcaatggtgcccaggctggagtgcagtggcgtgatctcggctcgatacggcctccacctcccagccgcctgccttggcccctcaaagtgcagagattgcagcctctgcccggccgccaccccatctgggaagtgaggagcatctctgcctggccgcccatcgtctgggatgtgaggagcccctctgcctggctgcccagtctggaaagtgaggagcatctctgcccggccgccatcccacctgggaagtgaggagcgcctcttcccggccgccatcccatctaggaagtgaggagcgtctctgcccggccgcccatcgtctgagatgtggggagcgcctctgccctgccgcccggtctgggatgtgaggagcgcctgggccgggcagcgaccccgtctgggaggtgaggagcgtctctgcccggccgccccgtctgagaagtgaggagcccctccacctggctgccaccccgtctgggaagtgaggagcgtctccgcccggcagccaccccgtccgggaaggaggtgggggtcagcccccgccaggccagccgccccgtccgggtgggaggtggggggctcagccccctgcccggccagctgccccatccgggaggtgaggggcgcctctgcccggccgccccgactgggaagtgaggagcccctctgcccggccagctgccccgtccgggagggaggtggggggggtcagccccccgcccggccagccgccccgtccgggagggaggtgggggggtcagcccccaacctggccagctgccccgtccgggagggaggtggggggctcagccccccgcccagccagccgcaccatccgggaggtgaggggcgcctctgcccggccgccccgactgggaagtgaggagcccctctgcccggccagccgccccgttcgggagggaggtgggggggtcagccccccgcccggccagccgccccgtctgggagggaggtggggggctcagccccctgcctggccagccgccccatccgggaggtgaggggcgcctctgcccggccgccccgactgggaagtgaggagcccctctgcccggccagccgccccgttcgggagggaggtgggggggtcagccccccgcccggccagccgccccgtccgggagggaggtggggggctcagccccccgcctggccagccgccccgtccgggaggtgaggggcgcctctgcccggccgccccgactgggaagtgaggagcccctctgcccggccaccaccccgtctgggaggtgtacccaacagctcattgagaacgggccatgatgacgatggtggttttgtggaatagaaaagggggcaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccgctccctaatctcaagtacccaaggacacaaacactctgcctaggaaaaccagagacctttgttcacttgtttgtctgctgaccttccctccactagtgtcctatgaccctgccaaatccccctctgcgagaaacacccaagaatgatcaataaaaaaaaaaaatagagatggagtctcactacatgacccaggctgatcttgaactcctgggctcaagtgatcctccatcctcagcctcccaaagtgctgggattacaggtgtgagacaccctccccagcctttttctttttttttcattatagattcagggggtccatgtgcaggtttgttttacagatatattgcataatgctggggttttggcttctggtgaacccagcacccaaatagtgaacatggtacccaatatgtagtttttcaacccttgcccctcccgctctgttcccactcttggagtccacagtgtctgtcatttccatctttatggccatgtatacctattgtttagctcccacttactatataagtgagaacatgtggtatttgagtttgtttctgcattaactcaggataatgaactccagctgcatccacttgctgcaaaggacgtgatttcattctttatggaagagccccacccctacaccccatggtccgctgcgtccgactggtggaagcaggatctgtggtgagatacctcagcacaagcatatgcaggcctgtggtagacgccggaagtagggccctttgtctccaagaatgggcagactctcaacaggtgaaagaaaaacagtactccaggtaggggccaagcagaagcaacaggtcaaagaaaggcctggaagtggaaaagccctgggttcagtttgctaagagcccaggagactagctggatacaaggccggaagaagggtggggctctgatgcaccagcttctccaatcttcctggctccagggaggagatgcatttgaacaatcctgaaaaacttttggatcccaagtctgactcaacattgtgacttgcttactccgtgtcactcttctagatgcttttgaaatatattatcataacaatgagtaagttctatttccattctcagaaaagaaaactgattcaagattgtgtaacttgctgcttctggttggtgagatttaaaaaaaaaaaaaagattatgtaacttgttcaaagtcatatggattacaaactatagcgcagggacttaatttcagtctggctccaaaatctgaactattaacaatatttaaaagtctgctgggtgggtgcggtggctcatgcctgtaatcccaatcctttggaaggctgaggtgggtgaatcacttgaggtcaggagttcgagaccagcctggccaacatggtgaaacccgtctctactaaaaattcaaaaattagccgggcgtggtggcatgcacctgtaattccagctactcaggaggttgaggcaggagaatcgcttgaacccaggaagcggaggttgcagtgagccaagatcatgccactgcactccagcctggaccacagagtgagactctgtctaaaaaaaaaaaaaaaaaaaaaagtctgtcttgaccaggcgcagtagttcctgcttgtaatcctggcactttgggaggccaaggaggttggatcgcttgaatctaggagttggagaccagcctgggcaacgtggcaaaaccgcatctctacaaaaaatacacacacacacactagccaggagtggtggcgcatgcctatagtcccaactacttgggaggttgaggtgagaggatcgcttgagcccaggaggcagaggttgcagtgagctgatattgtgccattgcactccaggctgggttaaaaagcctctctggggctgggtgcggtggttcatgcctgtaattccagcactttgggaggccgaggtgggcggatcacgaggtcaggagttcgagaccagcctggctaacatggcaaaagcttgtctctactaaaaatacaaaaattagccaggcatagtggcgtgagcctgtaatcccagcgtctcgggaggctgaggcaggagaatcactggaacctgggaggcggaggttgcagtgagccaagatcacaccaccacactccagcccagagtcttgctctgggcaacagagcaaggctcccggggggcgtggtggggagcgtctccgggacagtgttttcccagctttcccgttttggctttctgcagacacactcatcactgtgttatgtgacagtccatacatttctcgaaatctttcaagtcaataattatttttacccagcattacagaattgaaaagttaggctcagaaagggcaaattctgatttgggcttcagacctagattttttcctacaataaatgatgtaactattctgccttaagaatcttctagcatttctctttccaacacgacagccagggctggactagccccgagagttgcaacggaagatgggctacatacaaagcgggatgtaatcctgggccgccccaacatgccccgcatgagccaaaccgaacggctggctccttgtagttggggccacctacttgggacctccccttccctgtttgcgacctctacaccctggccacacttggagcaccgccgcacagtctgtgggcgacccctcgccacctctattgctcggcactccaaccctgtctatgtttaagcagagatgtccagagagcagccgctctcaacatctaccgtatcccaccgtctagcaggaagcccgctctctgtccaactccgcgggaccgactagagtacgacgaggaccgactagagcacagtgaggaccgtccagagcgccccctcggagagccccagggcttccaggacggcgcccgcgcatgcgcggacgccgacgggcgtggcgaggggcgtggcgaggaggtggggctgctgacctcagtctcctctgtcctcaagtcgcctacgtgcgcgcccgggagctgcacactcttgaagtgaccggcctggagacggttgcccagagcaaggtaaagataatgatgtatccctgatcatccttaccccagccactacttgcctttcctcctgtggcttccccagacaacactcttgactctccctttcctttgaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggaggtgagtggggctacaggggccccaaactggtgtccaggggcaattcacgacacttagacttacttggtttgccctgcacggtgtgttacttttttttttcttttttctttagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaaaattagccgggcgtggtggcgggcgcctatagtcccagctactccggaggctgaggcaggagaatggcgtgaacccaggaggcagagcttgcaatgagccgagatcgcaccactgaactgcagcctgggcaacagagagagactccgtctcaaaaaaaaaaaaaaaaaaatgggggagatcaggtgacattgggcctgtgttcccacataccagcaatctgccctagctgagtggtggctgtccctttggaaggctctacagtttgccaccatctccacacctccctcttccagggccagccaccatttatcatcaggcttgcgctgttgtttctcttaaagaaaagtgaattctctttttgttcctatgtctctatcaaaagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgtcattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataagtgaaaaaattgtccgtgcttcaaaatcttttacagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgtttatccatggtgttgctgagaattttgatatcattgaagaacttttagacatggtacctatggcagatccaaccactgaaagtgacttatttttgtatgttgaaaaaagtcggctgggcacagtggctcatgccggtaatcccagcattttgggaggccgaggcaggcggatctcaaggtcaggagatcaagaccatcctggctaacacggtgaaaccccatctctactaaaaaaaaatacaaaaaaattagccaggcgtggtggcgggcgcctatagtctcagctactcaggaggctgaggcaggagaatggcatgaacccaggaggcggagcttgcagtgagccgagatcacgccactgcactgggtgacagagcaagactctgtcttgaaaaaagaaaaagaaaaaaaagtttcaaaaagtttaatgttgactggtcaaaattagtaagtgtgaccacagatggtgcccctgcaatggtctgtgataacactggacttgttgcaaaacttaaatccaagttcaaaatgtttcaaaaagatacagaactgaaatccattcactgcattagtcatcagaaattgttttgtactaaaaagttaaaactagctgggtgtggtggctcacgcctgtaatcccaccactttgggaggccgaagcgggcagatcacctgaggtcaggagtttaagaccagcctgtacaacatggcgaaaccccatctctactaaaaaatacaaaaattagccaggcgttgtggcgggcgcctgtaatcccagctactcgggaggctgaggcagggagaattgcttgaacctgggaggaggaggttgcaatgagccgatatcacgccactgcactccagcctggtcgaaagagcgagactccctctcaaaaaagaaagaaagaaagaaaccccgtgtctattaaaaatacaaaaattagccaggcgtggtggcatgcatctgtagtcccagctactcaagaggttgaggcaggagaatcacttgaacccaggaggcagaggttgcaatgagccaagatagcgccactgcactccagcctgggtgaaagagcgagactgtctcaaaaaaaaaaaaaaaaaaaaaaattcctccctattcaaattattgtgtgtttttttttctttgctgattggacccagactgataatggtcctgtttcttatctgtcctgggattcccctgaaagaagatttggatttggggcaacaaagaggacagatgttcacatacacaggactttgcctttccctgggtcagcaaggcacctaatggagaacaagtgtccctggcccaataacaggcatacaggctgttaccatgttaattcacattggtttttttggggggggggggtttttgtttttttttttttgagacagtcttgctctgtctccaggctggaatacagtggcgtgatctcgacttactgcaacctccgactccctggttcaagcgattctcctgcctcagcctcctgagtagctgggactagaggcacgcaccaccatgcccagctaatttttgtatttttagtagagatggggttccaccatgctggccaggatggtctcgatctcctgaccttgtgacccgcccaccttgggctcccaaagtgcttggaattacaggcgtgagccactgcgcccggctatgttgatcttaactaatcaccattgtgcctcaatttttagttaatgatagcagaaaaaagatgggccaattcaacaaatatttgtggagaatgtaccatgggcaaggctcctctctgagggcaagtcatttctgtcacttgtttattccgtgaccttgacctggtcatcttaccctctgagttttgccttcatccataaaatgaggctagtatcacatgtattatctattgctgcataaaagttacctcaaagtgtagtagcttaaaccaacaaatatttattatatctctggtttctgtaagtcaagaacctgggagtagtttagctgggaggtttcagctcagggtcttatttttgttttgttttgctttctttgagacggagtctcgctcttgtttctcaggctggagtgcaatggtgcaaacttggctcactgcaacctctgcctcccaggttcaagtggttctcccgcctcagcctcccgagtagctgggattacaggcgtgtgccaccatgccagctaattttttgtatttttagtagagacagggtttcacaatattggccaggctggtctcgaactcctgacctcaggtgatccacctgcctcggcctcccaaagtgctgggattacaggcatgagccaccgtgtctggcccagggtctcttaagagattgcaatcatttgaaaactttgagttaacttgtacgcagcaatagataacttacacatgtggtcgtagcctcatcactggggttagaggatccacatgagaaagagctcattcacacagctgttggcaaaaggcctcagctcctggcaacatggaagctgcctttccctggaacaagtgatcagagaaagagagagagcacactgatcggcactgtatctatataacctagtcttggaagcgatacatcaacacttctctcatattctattggccactgtattagccatgtctttgattttctttattctgatgctttgacatctggagccttgctgaccccactggagggaccacctcttccaagagttcttagggatagagaacaactcacctgagagtgtgcttttcaaatgcaaaccaaccagtccagagcgcgcacccccccaccatctcctttatcatgctttcccacttcaggctgccggtcactaccctaatcaccccagggcgcggtaccagactaaagggacagcccctatgccccagagcctgaaattgaccaatcctgaaactagcagtcctaaaactgttatcctgtcctgcccaccccttccctcagaaaccacaagaaaggctcttgcaggtcaaagcgcagtagctcatgcctgtaatcccagcattttgggaggctgaggtgggcagatcacgaggtcaggagactgagaccatactggccaacatggtgaaacctcgtctctactaaaatacaaaaacttagccgggcgttgtggctcacacctgtagtcccagctaatcgggaggctgaggcaggggaattgcttgaacccgggaggcggaggttgcagtgagccaagatcgcgccactgcactccagcctgggtgacagtgcaagactgcatctcaaaaaaaaaaaaaaaaaaagaaagaaaaaaagaaaggttcttgcacagctcccgtcttcccctctttcccctctgactcttgacgaacaccctcctccaccatggtatgcatgccccttccttttgagaaatgcaacaagctctccagtggtcatctcctgatctgttggccttactggccctcaaatttcctattcatgcattacatatttatttatttactttgagacagggtctccctctgtcgcccaggctggaatgcagtggtgccatctaggttcactgcaacctccacctcctgggttcaagcatttctcccacctcagcctcctgggtagctgggattacaggcgcacaccaccacacccagaccatttctgtgtttttagtagaaatggggtttcgccatgttggtgttggccgggctggtcttgaactcctgacctcaagcgatcttcccacctcagcctcccaaagtgctgggattacaggtgtgagccacccaccatgcctggcctattcatgcattacattttagaaccatcacacagaatcacacatcaactcggatacagcgtggaaggggactacacaaggatgtcaatatcaggaggtggagaatcactggagctagaagctgcccaccacaccacctatttcccgtgggaaaaataaaataagataaatatatgtaaaagaccctcctagtacagtaatccaaacatgcagttaaaagaagtctgaggccaggcgcggtggctcacgcctgtaatcccaccactttgggaggccaaggcgggcagatcacctgaggtcaggagttcaagaccagcctggtcaacatggtgcaaccctgtctatactaaaaatacaaaaattatctgggcgtgatggcagctgcctgtaatcccagcactttgagaggcagaggctggtggatcacttaaggtcaagagttcgagaccagcctggccagcatcaaaatcctgtctgtacaaaaattaccaaatagctactagggaggctaaggcatgagaattgcttgaacctaggaggcagagtttgcagtgagccaagattgcgccactgcactccagcctgggcgacagagtgagactctgccaaaaaaaaaaaaaagtaatttagcaatgttgcaagttgtaagatcaatacaaaaatcaatattatttctatatactgtcaatgaaacactggaaattgaaaatcttaaaacataatacagccaaatgtggtggctcatggctataatcctgtactttgggaggctgctgttggaggattgtttgaggctgggagttcaagctcagcctgggaaacatagtgagacccttgtctctaccaaaaagaaaaagaaaaagaaaaaaattataattctgtctctcaacaaaatcataattttttttttaatttggccaggtttggtggcgggcatctgtagtcccagctcctgagctgaggctgaggtaggaggatcgcttgagcccaggagtttgaggctgcagtgagctatgataatgccactgcactcttgcctgggggacaagactgagaccttctctctctctcaaaaaaacacacacaaaaaaacatatatatatatatatagccacttacaatatcatttaaaaatgaaatacttaggaatgaatttgaaaagcagttgacctgttctctgaaaattacaaagcattactgagagattaccagatagagatttaccatctcaatattgagctgagatataccaaactcaatattgttaatatgatgattcttccaaaataaactattcaatgcaataccagtcaaaatcccagtaggctttttaatacaagttaacaagctcattccaaaattcttgtggtaatgcaaaggacctagaatagtcaagacaatgttgaaaataataaaactggaaaagttaaactacgtgacttatataaccaagacttaatataaaattacagaaattagccaggcgtggtggctcacgcctgtaatcccagcactttaggaggccgaggtgggcggatcacctgaggtcaggagttcaagaccagcctggccaacatggtgaaaccccgtctctactaaaaatacaaaaattagccgggcatggtggttggcgcctgtaatcccagctactcgggagactgaagcaggagaatcacttgaacccaggaggcggaggttgcagtgagccgagatcacgccgttgcactccaccctgggggacaagaatgagacttcgtctcaaaaaaaaaaaaaaaaattatctgggcatggtggtgggcacctgtaatctcagctacttgggaggctgaggcaggagaatcgcttgaatccaggaggcagaaattgcactgagccgagatcatgccattgcactccagcctgggcaacaagagtgaaactctgtctggaaaaaaaaaaaattacagaaatttgggtgggcatggtggctcacgcctgtaatcacggcattttgagaggccgaggtgggcagatcacctgaggtcaggagttagaaacagaccagcttggccaacatggcgaaagaccatctgtactaaaaatgcaaaaattaggccaggcacagtggctcaggcctgtaatcccagcattttgggaggccaaggcaggcggatcatgaggtcaagagatcgagaccatactggccaacatgatgaaaccctgtctctactaaaaatacaaaaaattagctgggcgtggtggcgcacacctgtagtcccagctactcgggaggctggggcaggaaaatcacttgaacctgggaggtgaaggctgcagtgagctgagatcatgccactgcactccagcctggcaacagagtgagactcttgtctcaaaaaaaataataaaaattaaaaaaaaataaaaatgcaaaaattagttgggcatggtggcaagcacctgtaatcccagctactcaggaggctgaggtgggagagtcgctggaacccaggaggcagaggctgcagtgagccaagatcacaccactgcactccagcctaggtgacagagtgagactcagtctcaaaaaaaataaaattacagaaattggctgggcacggtggctcatgcctgtaatcccagcactttgggaggtcgaagtgggaagatcacttgaggccaggagtttgagaccagtctgggcaacatagcgacacccggtctctaaaataagtaaataaataaaattacagcaatcaagatagtgtggtattggcacaaattagacaaaggccgaggcaggcggatcactcaagaccagcctggccaacatggtgaaaccccgtctctactaaaaatccaaaaaaaaaattagccaggtgtggtggtgggcaccctgtagtcccaactactcgggaggctgaggcacgagaataacttaaattcaggaggcagaggttgcaatgtgccgagatcacgccactgcactccagcctgggtgacagagtaagactgaaaaaaaaaaaaaaaaaaaagaaaaaaaaaacccaaaagagaaataagccatgtggtggctcacgcctgtaatcacagcactttgggaggctaaggcgggaggattgtttcagtccaggaatttgagacctgcctggtcaactagtgagactccatctctacaaaaaataaaagttagctgggtgtggtggcatgcacctgtagtcccagctacctgggaacttgggaggctgaggcgggagtatcacttgagcccaagagtttgaggctgcagtgagccaagatcacaccattgcactccagcctgcatgacaaggtaagaccctgttttgttttgttttgttttaaaaaagatagacaaacagattaacagaacaaaacagaaagtctacaaatatatccatacatatatgattaattaatatttgacaaaagtcaaaggcaatttagtggacaaaggacagtgttttctttttttgagatggagtttcgctcttgttgcccaggctggagtgcaatggcgcgatctcagctcacagcaagctccacctcccggattcaagtgattctcctgcctcagcctccctagtagttgggattacagctgcccgccaccacacccagctaattttttctatttttagtagagacagggtctctccatgttgttcaggctggtctcaaactcccaacctcaggtgatctgcccgcctcgggcaacagagcgagactctgtctcaaaaaaaaaaagtttaggcatggtggtggcacacgtgtagtcccagctacttggaaggctgagatgggaggatcacttgagcctgggaggtggaggctgcagcaagctatgattgtgacactgcactgcagcctggacgacagagtgagaccctgtatcaaaaaaaggaaaagagaaagaacttctgttcttcaaaaaaaacatttttaagagaatgaagacggccaggcgtggtggctcacgcctgtaatccagcactctgggaggccaaggtgggtggatcatgaggtcaggagttcaagaccagcctggccaagatggtgaaaccccgtttctcctaaaaatacaaaaattagccaggcgctgtggcaggcacctgtaatcccagctactcacgaggctgaaacaggagaatcgcttgaacccaggcagcagaggttgcggtgagccgagatcatgccactgcactccagcctgggtgatagagtgagactctgtctcaaaaaaaaaaaaaaagaatgaagacaagccacagactgaagaaaatatttgcaaatcaaatatctgatcaagaacttgtgtctataatatataaagaactctcaaagctctttgtgaactcaccatggctatatcttgagaatttgtcactttggactgggcacggtggctcacgcctataatcccagcactttgggaggctgaggagggcagatcacgaggtcaggagttcaagaccagcctgaccaacatggtgaaaccccatctctactaaaaaatatttaaaaattagccaggtgtcatggcgtgcgcctgtaatcccagctattcaggaggctgaggcagaagaatcgcttgaacccaggaggcggacgttgcagtgagccaagatcgtgccactgcactccagcctgggcgacagatcgagattccctctcaaaaaaaaaaaaagaatttatcactttgagtggagctactagcttctggcagtagctagaatcagagctcaggaactatgcccttcctgaagttatggaatcactgatcctaaaaggttttttttctctctctttttttttttttttgagacggagttttgctcttgttgcccaggctggagtgcaatggcgcgatctcggatcaccgccacctccgcctcccgggttcaagcgattctcctgcctcagcctcccgagttgtcgggattacaggcatgcgccaccacgcccggctaactttgtatttttagtagagacagggtctctccatgttgttcaggctggtctcaaactcccgacctcagatgatctgcccgcctcggcctcccagagcactgggattacaggcatgggccaccacgcccggtgatcctaaaagtttaaataggacttgtccttcagggtcacaagtgctgtgctctgatctctgccagcagaggtgatgggcttagcttatatcccagctgttccttcaaaccctggaggatgtgttgccatccccatcaaagactcctttctgttccaagtgctttttcatttagctggagcggtggtagccaggccagcagtggactctataccaataccttcactccggccaaagcccgagtctaggaggaaatctggagaaggaactgcttccaaccctgacgctctgggccctgtgaaatgaccttgaccatctctcataggtaataactgcctctcactgcaagtcaaccctgtacaaccagccagatatttgtggacaacacttcacagctcaaaacaaggtgaacctaactcctcagcaaaccacagatgctcctgaaagtctccaaggccagaagaaaacccctaaacatataccacactgtggcaactgtagcctagaaggtaacgaatgaagaacacagcaaatatctgagagttgctgcctgaagacacaggacaatgacctcagaaggatggggatgggctggaaaacctctggtctctaccctccttacagctgtgatttgcttctccctaggaaggtcctgcttccatgcttctccccataccccactcacttgagtgtctcacacgggatggtaactagatgtaacacttgccaaggggtcattatcacctactaaatacaaatagatgtctagcttgtctgtccacagagaggtgaatgatgagagaattcaatctcctggaatcaaaagaactttttggtgtgtattctacaaattaaaaactcaatgaccagccgggcatggtgactcacgcctgtaatcctagcactttgggaggctgaggcaggcagattgcctgagctcaagagttcgaaggccgggtgcggtggctcacgcctgtaatcccagcactgtgggaggcctagacgggtggatcacctgagatcaggagtttgagaccagcctgatcaacacggagaaaccctgtctctagtaaaaatacaaaaattagccaggcgtggtgatgcatgcctgtaatcccagctactctggaggctgaggcaggagaatcgcttgaacctgggaggtggaggttgctgtgagccgagatcgtgccactgcactccagcctgggcaacaagagcgagactccatctcaaaaaaaaaaaaaaaagttcgagaccaccctgggcaatatggtgaaaccccgtatccactaaaatacaaaaaattagccaggtgtggtggcgcatgcctgtaatcccagctactcgggaggctgaagcaggagaattgcttgaacccaggaggcggaggttgcagtgagctgagatcgtgccactgcactgcagcctgggcaacagagtgagactctgtctcaaaaaaaaaaaaaaaaaaaaaacctggatgactaaatgagatatcactgcacacctatttgaacaaataaaattaaaacaatgacaataccaaatactggcaagcaggcaaagaaactaaatctctcatactttgttggtggaaacataaaatagttccgccactctggaaaacagttcagcagtttcttaaaaacctagacatataataataattattattattattttgagacggagtctcgctttgttgcctaggcttgagtgcaatggcgccaccttggctcactgcagcctctgactcctgggttcaaacaattctcctgcctcagcctcctgagtagctgggattacaggtaattacagataatttttttggtatttttagtagagacagggttccaccatgttgtccaggctggtctcaaactcctgacctcaggtgatccaccctcctcgccctcccaaagtgctggaattacaggcgtgagccatcatgcccggccaacatataattattatacaacccagccactgcactcttgggcatttattctagagaaacaaaaacttatccccactcaaaagcatgtacgtgaatgttcttagcagtttattttataatggtcaatatctggaaacaatccaaatgtccttccatgagttaatggttaaaataactgtggtgcacccataccatggaatactgttcagcaataaaatggaatgaaatgacctgaatggatctcaggagaattatgctgcatgaaaaacacccatctcaggccgggtgtggtgcttgcagtgagctgagataacgccactgcactccagcctgggcaacagagagagactccatctcaaaaaaaaaaaaagaaagaaagaaagaaaaacactcatctcaaaaggtgacctgctctgtgattccatttgtatacctcatgaaatgataaaagtgtagaaatagagaacagatgagtagttgtcaggggttaaggaggagatagtatgataggattatggtggtgattacacagatctacgtgagataattacataatattacacccagccgactacattttttaaaaatcttttttagaggccgggcacagtggctcacacttgtaatcccagcactctggaaggccaaggcaggcggatcacctgaggtcagaagttcatgaccagcctggccatggtgaacaagtacacatgcacttgtaaaatttaaatctaaataagattcctcggccagacacggtggctcacgcctgtaatcccagcactttgggaggccgaggagggcagatcccttgaggtcaggagttcaagaccagcctggccaacatggtgaaaccctgtctccactaaaaatacaaaaattagccggacatggtggcaggcacctgtaatctcagctacttgggaggctgaggcaggagaatcgcttgaacccgagaggcagaggttgcagtgagccgaaattgtgccattgcactccagcctgggcaacagagcgagactccgttgtaaaaaaaaaaaaaaaaaaaaaaaatctaaagatttctgggatgtaccaatacaaatttcctggttttgaaaatatactatagttatgtaagatgttcccattggaggaaactgggtaaaggttaccagcctctctattatttttggaacttccagtgaatatgataatttcattccacgttcacattgaatgacagctcaagctcagctgacctgaaccggtttctcctgcagtgcctgtccacctgcaggcagggcctcctgatcacacccacctgtggtccacagcgccctctgcagctctcccaccactggaagcctcctggtccctagagggaggccagcttgaggaagccctgatttcatagactcatcttgcagcctcatctcctccccatgcctttatgagctgacagtttgaggggttttttgtttggttggtttttggtttggttttgtcttgttttgttttgttttgagatggggtctcacccaggctgcagtgcagtggtgctatcacagctcactgtagcctttacctcccaggctcaagcaatccctcctgcctcagcctcctgagtagctgggactacagacatgtgccaggatgtctgactaaaaaaaaaattttttttttccagacagagtttcactcttgttgcccaggctggagcacaatggcgtgatcttggctcactgcaacctctgcctcctgggttcaagcgattctcctgcctcagcctccggagacgctggaattacaggcacctgccaccatgcccagctaatttttgttatttttagtagagatggggttttgccatgttggccaggctggtcttgaactcctgacctcaggtaatccaacctcctcggcctcccaaagtgctaggattacaggcatgagccaccgcacccggctgactaaattttttaaaaatattttttagaggccgggcgtggtggctcacgcctgtaatcccagcactttcggaggccgaggtgggtggatcatgagatcaggagatcgagaccattctggccaacatggtgaaaccccatctctactaaaaatataaaaattagctggacgtggtggcacgtgcctgtaatcccagctacttgggaggctgaggcagaagaattgcttgaaccagagagtctgaggttgcagtgagccgagatcacaccactgcactccagcctggcgacagagtgagactctgtctcaaaaaaatatatatatattttttagaggccgggcgcagtggctcacacctgtaatcccagcactctggaaggccgaggtgggcaaatcacctgaggtcagaagttcatgaccagcctggccatggtgaaaccctgtctctactaaaaacacaaaaaattagccaggtgtggtggtgcagtggtgcgcgcctgtaatcccagctactcgggaggctgaggcaggagaatcgcttgaacccgggaggcggaggttgcagcgagccgagattgcaccattgcgctccagcctgagcaacaagagtgaaactccgtctcaaaaatatgtgtatatatatatatatatatatttcttagagatggggtctccctatgttgcctaggctggtctcttaactcctggactcaaacgatcgatcctcccacctctgcttcccaaagtgctgagattaaaggtgtgagccactgtgcctggcaaataagctgacattttgcttgacacctcctgagccaaggacacagacacccgagagatgtccacaggctgcagaggtccagctcctgtgaccaggcagcagcctcagtggaagagcacatgttcctgggccctaccacaggctgatgtggagagtccctctgattgaaaatgcccaactcaggccactcctgcccgggggtgactgtctcgcaataagatacagggccagaaggatccaggaacacaggaagagttcggcagggctcaacaggagaacagaaaagaactaaaagcagagacaccatgcaaacatgaggcacacacgcaacaggagacagagcaaactgcaggaaaaaagaagggccctgttagccacacaccggcctgtgggctacaagccctccagttacagagcatgggaaataaggccaggtcatgcctgtcctcacctttgagttagggccgagctgggcagagaatctgattgcccttccctccctcttcagttcctgcagatcacttggttcttttgtgttttttgctttttgttttttttttttttaagacggagtctcactctgttgcccaggctggactgcactggctcgatctcagctcactgcaatctctgcctcctgagttcaagcgattctcctgcctcagcctcccgagaagttgggattacaagtgtgtgccaccatacttggctaatttttgtatttttagtagagacagggtttcaccatgttggccaggctggtctcaaattcctgaccccaagtgatccacccacctcagcctcccaaagtgctggattacaggcatgagccaccgtacctggctggctttgggttcttgaagggaaaagaaaaagccccatggcagaccggacctgactgacgggcaggaaatcttaattccagacctgctttcacctcctcactgccggacctggagccagggctggctgtctcagggcctctgcctaccattgccaggaactctctgttgccagtctgtatttggagaggctgaagggatgaaggtcctacctcactctggagccctccccacagggccccagcttgcacctcgtgcaccagctccttagggggcagtgtgcacccctggaaggactcccaaggtctgggacttgcgactcaggacagaccattccctgcagatcattcatctgccaatttaagaaatgggagagagacggaggcccgtctgcctcccctgccagctcctgctgattgctggtggctgcctcctgagttctggggtccctctcttgacagtggtaagagtgccaggaacggagcgcgtttgctgcacaccatttgccattggtgcatcgagcacactcccagctccaggattatgggaagacctttttggggtacagacttcccctccctgcaacaaagaggagctcttccatggcccccaccctgaggggcacaggaggtccacggcctggaaacttcctatttcctggggctggcccagggcttctagtctggccttccataaggcatgggccaggatgctggccctgggggcctctcagctcagccccacgtgcccctctgtggactctcagtctcacgtttgtcagggttctgccatttagaaatgatcagcccacctctagaccaagtgcctgcctggaatgtcctgtccaacttatccaccagctcatccttccgggcctaattaaggccccactccatctctgaagccaccccatgctcatgactctccctgacgcaggttcccgacacaccgggtgactcagctgcagtgtttttcacagtccgtgatgcgtcacagctatttataggtgtgcttaactccctgtgaggaagcacttcaacccccaaacgcaagttccagaaatatgctcataaagataaagatagagaaaagctctggaaaaatacacagtgctgttgcttcaggcagagtccgtgtgtgtgtgtgtgtgtgtgtgtgtgtgtgtgtgtgtgtgctttcactttttgcctcatacatctcattgtttataaaatttatcaatattacaaagttgtaaacaaggttatttaaaaacaacaaattggctgggcacggtggctcacgcctgtaatcccagcactttgggaggccgaggcaggcggatcacctgaggtcaggagtttgagaccaacctggccaacatagtgaaactccatctctactaaaaatacaaaaaattagccgggcatggtagcaggcgcctgtaatcccagctactcgggaggctgaagcaggagaatcgcctgaatctgggaggcggaggttggagtgagttgagatcatgccattgcactccagcttaggcaacaagagcgaaactctgtctcaaaaaaaaaaaaaattataaatttctacacaaagtcttgcacattcctttaatttattcataggtattttatagtttgtgttgccatgttagcagttacaaagtggctgggcacagtggctcacacctgtaatcccagcacttggggaggccgaggcgggtggatcacaaggtcagcagttcgagaccatcctggccaacatggtgaaatcccatctcttctaaaatacaaaaaattagccgggtgtggtggtgcacacctgtagtcccagctacttaggaggctgaggcaggggaattgcttgaacccaggaggcggaggttgcagtgagccgagattgcatcactgcactccagcatggtgacaaagcaagactgtttcaaaaaacaaaaaccaaaaaaccaaaaaacaaaaagagtgaggtccccctgagtcacatagcaagaccccatctctacacaaaatatttaaaaattagccaggcatggtggttcgtgcctgtggtctcagttacttgggaggctgaggcagaaggattgcttgagctcaggaggttgaggcttcagtgagccaggatggtgtcactgcattccagcctgggagagacagcgagaccctgtttttgttgttgtttttttcttttttaaagaaaataaacaccaaaacaataaaaagagtgaggtaggtaggactcatgtcccaaaatagttctccctttttagttttttaatttttaatttttaaagaaagtttcattctgttgcccaggctgggggggtggggtagtggcataatcgtagctcactgtaacctgaaactcctgtgttcaagggatcctcctgcctcatgctcctgagtagctaggactacaggcccacgtcaccatgcccagctaatttttatttttattttttgagatggagtctcactctgtcgcccaggctggagtgcaatggcgtgatctccactcattgcaacctccgtctcccaggttcaagtgattctcctgcctcagcttcccgagtagctgggattacaggcgcctgccaccacgcctggctaatttttgtatttttagtagagatggggtttcaccatgttggccaggctggtcttgaacttctgacctcaggcaatctgcctgcctcggcctcccaaagtgctgggattacaggtgtgagccaccgcgcccggccaattttttttaaatgtcttggcaagatggagtcttcctatgctgcctaggctgttcttgaaccattaaaatgatgtatttcaattatgtatatactatttatacatatattaggatatatctacatgtgtgtgatatgaatatatatacacattcacaagcacattataaatgtttgtatgtgtatatatacatacatagtcatgtactgaataatgacatgtccatcaatgatggaccacatatgtgacagtggtcccatatactaccattttttttgttttgttttttgtttttgtgagacagggtctggttctgtcacctggggtggagtggaatggggcatctctgctcagtgcaacctctgcctcccgagctcaagcaatcctcccacctcagcctccccattagctgggaccacaggtgcatgccaccacacctggctaattattgtatttttagtagagacagggttttgccatgttggccaggctagtctcaaactcctgacctcaagtgatctgcccacctcggcctcccaaagtgctgggattacaggtgtgagccaccgtgactggccagtagtcaactttacaacaggcctaggatgggaggtgattgtccaaccaactttaactttactgtttgaattttaaaagaaaatacccatgtacttgggtattatttgtttgtttgtttttgagacggagtctgcctctgtcactcaggcgagagtgcagtggtgtgatctcggctcactgcaagatctctgcctcctgggttcaagcgattctccttcctcagcctcccaagtagctggaattacaggcgcccaccaccacacctggctaatttttgtatttttagtggagacagggtttcactgtgttggccgggctggtcttgaactcctgacctcaggtgatccaccccccctcagcctcccaaagtgctaggattgcaggtgtgagcaaccacacccagctgtacttgggtattattaaaaaaataataagtcacaggatggagccaggaagcctgaggcaggtgaacctatgaggcaaatgtcacgtgcaacaaagtgtaattggctctggcagccaaaaccaattggacatcttggtgagacagtctccaaatgtgtcacaggatataatttccaaagttataaacatgactgtctttaatgtatgtaccaaaggttacttcaggtgttaagaaactataatggtggaaacactagttcaaagggaactggagagactgaaatactcagaggcactgaaaaagcaatgctggaataagattgctgagttacatccaaaagtacctgctgcgctgcagggtaataagcccattatcttgggtcatcttttctacctgacagaagctagctatatcttatcaatctactcatcagagcccagcctcatcaatggtgaataagtcagagaggtgccatgcctagagaatcccaaaggtcatcctatggccaccttttcggactggtcttcattttgccttttcaaattttttttttttttttgagatggagtctcgctctgttgcccaggctggagtgcagtggcgtgatctcagctcactgcaagctccgcctcccgggttcacaccattctcctgcctcagcctcccgaatagctgggactacaggcgccagccaccatgcccagctaatttttttgtatttttagtagagacgggctttcactgttagccaggatggtctcgatctccttaccttgtgatccatccgcctcggcctcccaaagtgctgggattacagacatgagccaccgcgcccggcccacgcccggctattttttttgtatttttagtagagacgggtttcaccatgttagccaggatggtctcgatctcctgagctcgtgatccacccgccacagcctcccaaagtgctgggattacaggcgtgagccaacgcgcccggccaatatgtttttcttaatggaggagtatccgcagggcgcggtggctcatgcctgtaatcccagcactttgggaggccaaggcaggtggatcacgaggtcaggagatcgagatcctggccaacatggtgaaatcccatctctactaaaaatacaaaaattagctgggcgtggtggcacatgcctgtactcccagctacttgggaggctgcggcaggagaatcgcttgaacccaggaggcggaggttgcagtgagccgagatcgcgcctctgcactccagcctgggcgacagagcaagactccgtctcaaaaaaacaaaaacaacaacaagaaaaagaggtgtgttatttaaccttttcttagaagcttctctgctgcccccaatctttctcagcaatcctaagccttgctccagttactggttagagctgggccaatagtggtctgaccacacgtggtggcagcattctgagctctgaggagacaacctgggctcttgtcttgaggcctaaactgggcctgagagagcaggaacaaatctgccctctccctaagctcagggagtccacagcgggaccctcacacccagtctaaggagaccactgggcagagctgagatcttaaggacaagctggagttccctcagttttgggaaaggagttctggggtgagcgaggaacatcaggagaagctggaacagagaggggcagccaagtcctgaagggcctgctgtaacccaagagagaggcctggctttatccagcaaggccagggtgcggtcggagcaaaggttgttttattaaaagcttcctatggctggagcccaggagttcgaggttacagtgagctatgatcacactactgcactccggcctgggcaacagagccagaccctgtgtttaaaaaaaatcctaaaaagccacaaaacttcctgaatgcagacaatgtaggggttcaaggagctagggagtacagcggagacagtgtttgaacaggcccaggcctgggcaggtggctgccttggatgcccgaagggaaaaacagaacaaaatcaggaggaattggagcctaagtgagggagcagaggatgaagggcgagaagggggcatggggctgacaaagccggggtggcagcccgtcccaccccactcagtgtgggttcccgcggtctgttcggcgcagccacagggtcctcccaccaccctcgcggcccttcgccagcccagataccgttttcccgactttggaacggagaccacaacacccgccccggaactactgaaggctcaagttaggtcaacccggcaggaaaccggttcccaaatcccaaggcggacccaggcccgcggttccctccctcaaggctggaacagcgcgcagtggccaccgccgccgggtctccagcccccaggagcgcggcctcctcccggactctctccgatgcggtcctgccctggggacacggcaggaagaagggacctggctgggggacgtggccccggcgcgggggcaggggaggcagcgcgggactcccagcggcccctgcgcgggtgcccacccgccgtcacgtgacacgccgggcgctgagtcaccgggaagcatctggctgggcggccgggattggccaatctgcgggaccgtctggagcggaagggcggtggtagctggccctgcttctccctccccaggatctctgcactggccttacgaactggggagtccaaggggttccaggacgggaaggggagtttgagaccagcctgggcaacctggccagacccggtctctattaaaaatacgcaaaacacacacaccacacaccccaccccacacagcccacacaccccacacggccagcagccctttctgtcaccgactccgttcccctggccagtgagctctccgtccccttttcctcccttttcgcacacgtgcctttcctgcctgctcccacctggtgcctgaggcgtctctgcgcctcagcactggctgttcggtttgcactacggagggcagtgtaggtttgaaaaggaaagtttcattatatagaacactaccaaggcagggcgcggtggctcacgcctgcaatcccagcactttgggagaccgaggcgggtggatcacttggggacagtagttcaagaccagcctggccaacatggtgaaaccctgtctctactaaaaatacaaaaattagctgggagtggtgacacttgcctgtagtcccagctacttgggaggctgaggcaggagaatcgcttgaacccaggaggcagaggttgcagtgagccgagatccggccactgcactccagcctgggagacagagtgaggcaagactccatctcaaaaaaaataataataataattaataaaaaaataaaaataattaaaagaaaaagaaaaagcactacagaagagtgcagaggggcgcctcagctagaggacttagggattttccttaggggcatttatggaccttaaagagggagcttaagggtaacttggaccacactagccacataggtcatgataaatgattacatttgtagacattttggtgcctaatgccagtcagcaagggttgttgcacaatgagtttggacaggcatgcatttgcagagatgtatagaaattctaattacttggaaattttgttggaccggagctaggaaccaaatggtatagggaagtctcattacttctgaattcctcagataaagagttttgcctctgcctgggctgctcgatggccaccaggtgacctttgctctcctcaggggctgctgtgggtccagagctggaaggagaatgggccgcatcctttcctccttccctccccgcagcagcaggggctctggctgcgggggcgggctgagctccgtccggggtgatgcgaagggggtcatgccgagggggtgactcccagcttgcactgcgtcccacagtcgcgcctcgcctcgcctcccggagcccgagtcttccaagggcgctggcagctgcgtcagctcccgctgcccgccccaagcgtccagagctaggagggagttacggggcgaggcccagggcttttcagggccgggggtcgtgcggccaggcgcgggtggactaggccagcggccactgaggggcagagaggtctggggttctaagtttagcccactccgcgaatgtggattgctttgtttggatgtgattccctttccaggtgactgtaggttacccccacactgccctggcatggaagagatttaggctgtcctaggccttcacccttccctaagacgagaatccagaggaggagccatttaacagctccctggcttctctcacttacagggagctcactactactactaaaaacattttgaagttaacacccccttatgcctggctcattcgtgcattcaacagatgtttactgagcacagactgtgtgttggagactggccactggtttacataacgagctgtgataaaacaaagtcccaagcctcttggttgatgttctcaggcttttttgaggtgtgaatcacttctccctggaagccctcctagctatgccaccctggcttaagactgacttttgtgctctagtggcccctcagggattccccacatcagcactgactaaatgtccacttccatgagctagaggaaggtggcgcctcttatttggcctggagcagggagctagggctcctgcagcctccagatcccttactgggcgtcagctcaagggtgggaaggccgggggcctgcaccccctgggaaagatgtgggcatttgtttcaaggcaggtggtggtggctgaagtctggaggcagggagaacggctgcgtatttcaaacttgtaagcaaaggacaggggacctattactgggaaatttcccacatgtgccagggggaaggaacaaccctctccctgtggaaggtggggggagcgagctcacctcccagagagacaactctgtcactctggcgcctctgcccgcccttgttcttccctccatctgaaatcttcccctcttctcaaagctggtgtattctcatcctttaactctccactcaaatgtcactttccttgtcaacccttgtcaaaattggtcccctcctctgttccctttattccatcacctatattttctcagaacatgtacagtgctcattcactaggattgttacccgaatcctctgctagaatgtaagctccaggaaggtggaattcttgcctttttcctgccttatttttactagctgtaccttgcataaagggtgtttgttgagtgaatgaagttctgtcctagatcaagttaggaattgaagctagaagtcaggaaaactaggtctttctctgctactaatattttttttatttttcttttctttttcgtgtttgtttttggttttcgtttgtttggtttttgttttgaggtggagtctcaatctgtcacccaggctggagtacagtggcgccatcttggctcactgaaacctctgcctcctgggttcaagcaattctcctgcctcagcctcctgagtggttgggattacaggcatgcaccaccatgcccggctaattttgtatttttagtagagtcgggatttctccatgtttgtcaggctggtctcgaactcctgacctcaggtgatctgctcgcctctgcctcccaaagtgctgggattacaggagtgagccaccacacccagcctccctttaactctttatatcaatcatttacacaaagaattggagtcagcttgtcaacatacaatgagattgagagagagaggtaaaaatcaagcagagatggccaggcacggtggctcacacctgtaatcccagcactttgggagaccgaagtgggcggatcctgacttgaggtcaggagttcaagaacagcctggccaacatggcaaaatcccatctctactaaaaatacaaaaattagccaggcgaggtggcgtgcatctgtaatcccagctacttgggaggctgaggcaggagaatcgcttaaacccaggaggcggaggttgcagtgagccgagatcgtgccactgcactccagcctgggcaacagtgtgagactctgtctcaaaaaataataataataaaaataaaaataagccgggcgtggtggctcacacctgtaatcccagcactttgggaggctgaggcaggtggatcacaaggtcaggagattgagactatcctggctaacacggtgaaaccccgtctctattaaaaatacaaaaaattagccgggcgtggtggccggtgcctgtagtcccagctacttgggaggctgaggcaggagaatagcatgaacccgggaggcggagcttgcagtgagctgagattgcgccaccgcactccagcctgggcgacagagcaagattccgtctcaaaaataaataaataaataaatatgaaataaaataagaatcaagcagagaaaattcatgcatacctaaaagataagaccaaggaaaaaggccagagtcctgtacgactgccagagttgtgcctcagttattgctttgagcttctgtgagccaaagagaaaggaagaggaacaaaggtagttgcatgattcttcttgcctctagggaaaaagcatcccagttcctcagagaaaggaaattttttgctggcagttaatatctaaggaatttctcatacaggtctccatatagggatgtggtggctgatgagaacagactgcagctttcctaactaagggcattgttcactgagcatccaaatcagcagcatcagcagagagtgggatgccaaggaatgactcagcaagggcagctctgcaaggctacagaagagctttgtgggggctctggccagacccaggggcgatggctaaaaccaaagaggaatggatgtactgaattcccatcagagaagtgtggctcccggctttctggtttacattttttttaatcgaatgacttcaacatcatctataaaatattcttttttaaaaaaaaaaaaagcctgtaatcccagcactttgggaggctgaggcaggtggatcacctgaggtcaggagttccagaccagcctgacgaacatggagaaaacctgtctctactaaaaatacaaaacttagctgggtgtggtggtgcatgcctgtaatcccagctacttgggaggctgaggcaggagaattgcttgaacccaggaggtggaggttgtggtgagctgagattgcaccatggcaccccagcctgggcaacaagagcgaaactccatctcaaaaaaaaaaaaaaagaaaaagaaaaagaaaaagcagcctgggcaacattgtaaaaccccatttctacacaaaatacaaaaaaaaattgccaggcttggtggtggcgtgcgcctgtagtcccaactatttgagaggctgtggtaagtgggaggatcacttcaccctggaaggctgaggctgcagtgagccatgattgtgctactaccctccagcctgagtgacagaccaagaccctgtctcaaaaaaaaaaaagaaaggggaacccaggttggatcaagcctctagatctaatcacttgtttataggaaatgcagagggaacagaagactatgtcataccacaccacagggatatgatgggcaaaatccagaatgtggaaaattccaaaggcaaaccacccagattcttcagcaaataaatttcagggggaaaaaaggtggggagaggaaacctatagagtatgctagaatcttaagagacatggaaatccaaggaaatgtgcagattccacttaggtcctgattgaacaaaccaactctcaaaaaatattgaggcaaactgtgtatttgaagattaatactaaaaaaaagttttctgtttgttttgttttgttttcaggcagtccttgaaccagaataggttcagagaggctccccggttaatttttttaggtgtgaaaatgctaataggattttgattatataaaaattgttttgcaaattgaaaaaataataaaaataggccggccgcagtggctgacgcctgtaatcccggcactttgggaggccaaggcgggtggatcacgaggtcaggagatcgagaccatcctggctaacacgttgaaaccccagtctctactaaaaaaaaaaaaaaaagaaaaaataattagccgggcgtgatggcgggcgcctgtagtcccagctactcgtgaggctgggacaggagaatggcgtgaacacgggaggcggagcttgcagtgagccgagatcatgccactgcactccagcctggaggacagagcgagactccttctcaaaaaaagaaaaaaaagaaaataaaaatagttatggtttgtttcaaaatactccaggtaatgggggttacaaagaaagaagaaacactttcttccaccctcttactgcctggcctgagagcttacatatcattttcaagatagcagtacatcgtgaagatgtgacaaggcaaagggaaaacggttttaagcttctgggggctacaaaaccgtgggatggtaaatatatggggaaaactagtggaagatcactctgaatttagtaagatttgtttgtgcagtttcatctcagtgccgactgtcctttttttttttttttttttttttttttttgagacggagtcttgctctctcgcccaggctggagtgcagtggcatgatctcggctcactgcaagctccgcctcctgggttcacaccattctcctgcctcagcctcccgagtagctgggactacaggcacccgccaccacacccggctaattgtgtgtgtgtgtgtgtgtgtgtgtgtgtgtgtgtgtgtgtgtgtgtagtagaaacggggtttcactgtgttagccaagacggtcttgatctcctggcctcgtgatccgcgcgcctcggcctcccaaagtgctgggactacaggcgtgagccacagtgcctggcctgactttctgtcttcatgaccataaaccttcctggaagaggatatttatggcagtcctcatttctaggagtttttgcttgtagtcagataaggaaagttccagaaaggctctctctgcatctgtccgatctcaaatgcctcagttcagaattatccttataccaaagtagcatttggtggggctgagatattctgatccccttcaagggattgggagtttagatggaagggaagtggcaggagttagtaactgttggagctgggtatgaataacatggggattcattaaactattctttttttctctctctctttttgagacagagttttgctcttgttgcccaggctggagtgcagtggcactatctcggctcaccacaacctccgcctcccgggttcaagcgattctcctacctcagcctcctgagtagctgggattgcaagcatgcgccaccatgccaggctaatttagtatttttagtagagatggggtttctccatgttggtcaggctggtctcgaactcccgacctcaggtgatccacccgcctcagcctcccaaagttctgggattacaggcgtgagccaccgcgcctggccctaaactattctttttactttttattttattttttgagaatttttttgagacggaatcttgctctgtcacccaggctggagtgcagtggcgtgatcttggctcactgcaaactccgactcctgggttcaagtgagtctcctgcctcagcctcccaagtagctgggattacaggcatgcaccactaggcctggctgatttttgcatttttagtagagatggggtttcaccatgttgaccaggttagctcgaacttctgacctcgtgattcgactgcctcatcctcccaaagtgctgggattacagatgtgagccaccacgcctggcctttacttttttatgtttgaaattttccataacaaaacatctttaagtattggaaatactgacaaacggtgagccaacttttcccaaatacaaaattataacaaaattaccctgcactgtcaccaccgtttcataagaaaaaagtctttataacatcaaagatacaagaagggcttgtgaacccaaaatatctgagacaggtctcaaccaatttagaaggtttattttgccagccgggcacggtggctaacacctgtaatcccagcactttgagaggctgaggagggtggatcttgaggtcaggagtttgagaccagcctgcccaacatagtgaaaccctgtctctactaaaaatacaaaaaattagctgggcatgatggcgggcgcctgtaatcccagctacttgggagactgaggcaggagaattgcttgaacctgtgaggtggaggttgcagtgaggcgggatcgtgccactgcactctagcccgggcgacagtgcaagactccgtctcaaaaaacaaaaaaaaagagaaagtttattttgccaaggttaaggacacacccatgacacagcctcgggaggtagataagagacaaagagttgcactcttttcttttgagtttctgattagcctttcacctaatacgcaatttacatttgagaggagggcagaggagtagtcacttttgctttagtctggtttagtgaaatcagaggtcaggggaagcaatccgatatgcattagtctcacgtgagcctcggagggatgattttgagttctgtctgtcctttgtccacaaggaatttccttgtgggcaaattgtgagggaggcatgtagctttttttttaataaatctttgtagctatcttatttagggataaaattggaagcaggtttgcctgacatagttcccagcttgacttttcccttggcttagtgattttgggattccaagatttattttcctttcacaggcttaatctctgaataaaggaccctcttaaaatgggatgtagttagttttctggaaaagtcacagccgacgctcccagggactgtttctggttcacgggccctaggttcaaacaacccttcccaaaccttgtttgtttcaaaggttgagatcaaagctagtgggtagccagtgaggctgtgcttgttcactctgtgactcggacaagctggcacctgtcttctctgggctgctttctctcaaagactaagagtgtttagtgcagaaaggccctcagagatctgggttaacctcttatttatttatttttattttttgttttgttttgttgtttttgagatggagtctcactctgtcgcccaggctggagtgcaatggcacgatcttggctcactgcaacctctgcctcccgggttcaagcgattctcctgcctcagcctcccaagtagctgggattacaggcgtatgtcaccaaacccagctaatttttgtgttttgagtagagacagggtttcgccatgttggccaggctggtctcgaactcctgacctcagatgatctgcccacctcggcctcccaaagtgttgggattacaggcgtgagctaccatgcccagccggttaacttcttatttttacagatgagagaactgagacaaagagaggaagagtgacttgctggaggtaacagggtgccacttaaatggcacagcctagggtagaacccagggctgctggtgcctcgtccagggtttgctccactcaacgttttacctgctatgaactgacccatgttgttttcgtcattctagtcagtacctagaaagacagctgtgtggactagctgctggaccaccaggctttaagtcttgacattgctatttactggctgtgcaaccttgagcaagtttacttaacttctctgggcctccatttcctcatctgtaaaatgggtaggtgctgtaatcatgacagttatcttccgtgaaaattcagtgaatgcatgtgccgcagtgcctgccatgtagaaaggactcagtgcagcatagctgcattttcacctcctatatggatggtaagttccacagatttattacggaaagcaggctggcctttaacttagggtcatggaatgtcagagctggaaggggcctcttgagttaactagagaggcgtccttttacaggagaaaatgagtccctgggggcctgcgtgacctgctgaaggtcccaggggcttttggtgacagaacaggaatcaaactccaaaggggtcctctgtcctggggctctgggcttgttgaacaagtcagctgccccatcctccaatttatagagccattagcccaagggagtgtcagtgttggtcaagtaaagacacgtggaagtgcacggagctctacagtttactaacagcatttgcaaagttggagccttactccagcctagaaggtggtgagtgctggaatgaatattccatttcacagaaagaaaccaaggcccccagggatgagttggtaaccaaagccatgggtagaggcacagaaattccttgactactctggaaaatgagggagttcaccttcaagagaagaaagttaggtcagtataaaatggctgacagcctcttctgccttcagaaaagtacttcaactgcaaagtcaactactaacttccaaggaggtcaggaaggaaagcagttgctatggcaacatctttggcagctattttcatccttctctggttcagaacagcttccagcaggttcctgtgggagggatgggggagaaagggaaaggctagctccagcccagcaactgtcctcagccaatctcccaccagatttcggtggcaagaggaaggtggcagccaatgaagaggctcggagcttgcatcatcctcctgaccagggtggaataaccaggaggcaggcgcacgtgaccgtttccatggtgacctcccttagcaaccctgactggtcctgtttatgaacgctggaaaattccaaccagcctctgtcctgatttttttacctactctgcctccgcctgctccaatgcaggggtgaagtcactgccaacgtttaaccctttccccacgtgggcctggctccagtcagatcgagggtctgggagggctgcagggatctctcagtcgccaatggttgcagacaatccagtaagccacagctgttacttgctgcactgaaccctgcctgcgctgagtaccgaaagcaggagggaaggtagccacatctcttgagcccggcgctgtcctaagctcctgacatccccacaggcctgagaaaggggcaccacaaacaggaaccaggctgagactgagcctgtggaccctggtagcaagggcgccctctctctaagaagccctctgtcatgctaccgatgttgcagaacacctggggcggagtagggagtgccaaagcgcaggggatgagtgcacagcagggagacttctatggtctgcaggtgagctgaaggcaggcccctgaggaggtggacatttaggctgaatggaggacagggaggtagcaggacctgctgtctccaggacccctaagtttctaggccagagctgacggctggtgggtgcagtcagccaggctccagggaaggctgctccaggcagggctgagtcttcacggttcagcttttagaactggccaggttggaattctggctgggggcagacagggagggcaaaccacaaacacttctgcctgatctggctggggaatccacagagaccaccagctgggactggggtgagcctctcagagcccctagcaccagcccaaggctgcatgggctgactgtgtgggcggatgctgcctaagtcatgtgcagagccgtcctgagctgaggcagaactataagacatgaactctgttttcaagacaggtgacaatgacaaacagcaataaaagccacacaccatagctcaggataacaagggctgagatgcgtttggacaatgagaagaaaataaaaattaaaaaaaacagctgattcaccaaatgaagggcacagtcccaggcgtgctggtgacgtcactgggcagggaaggctgcaggaatctgcagcatggactgactgttcaggttcaaggggtcttgacctggctcctgaagttggggggctcccactgccaggagagtggccacgactgtggggagcagtggagggaggtcagtgcaagtagggaaagtagggatcttgctgccacaaacagtgggggtgggggtggggggggcaggaacagaggaggctggactgcatgaggtttatggccttggctcagggtggggcagtaggtgataaagagcccagagagaggaaaagtgaccctttgtgacctgggccctggtctctgttgacatcttgggcctcagctgcagtctttgcttgagcagaagagtcatggaaatttccacccagattcctttcccagcactcagtccccagctccacattcttctaggccctgctgggctgagttccgcttgtgggggctgcaggcttgaagaggccgaggacagcctccaggtcacggggacagccacagaaggccggtggagtggacgcatcagaatttcaggcatgtggggcattgagctgccatgaaataccagagccatcccccgtgcctgacaggtcccagacgccccagggtccctgctcctgggagggcaaagaggaggagtaacagcctcctccgtcacagcagtactcgagtcacatcagctcatcaccaatgtgcctcccccagagtaagggcagcaggggcggaagaagcccaggggcacctaaatattgtgggttcagcacttctgctctccagaaatgatccaggtccactgttttctcagggggagtattttatatgtctatctctagaagcttccaaggggaaaaagtgacttcaaggggaaagaggagctgggaagaccttggcagctccttccccttgcccggccttcctttccctactctgggctccaggctccaccccacctcctgttaggccttcctgaacagcagcagcagctgggaatgcaaaatgacatccctatgttgtccctgccctttgtccagggtgagagggacccttcctcggtggagttgacacagacctgcctctctctcatgtctgtactgggagtgagcctgaggcctccctgccaaccggactggaaactctggaatcccctttgtcccctttgatcctcagaggagcgagggagccctgttaacaaacacatagtcatccgagaaaatgtaggctgccttgggacagagactactgatggggtggtgataagtggcgactttggatacagtggccagaggggtcctgtgcaaggagtgccctgtggtcagggtgacgaggagtctgccttctgaagagctgtagaggagcattcccagaagacgagccaaagacagcaaagaccaggaatctggaagggccggggcactaagagacaggagggagggggccctcattgcaggcacaggcagcttcaggccactctttcacagcttttcctttctcttgtcccatggccacccccccactcccaatccaggccccatgacctctggcctgggctatggcactgggcctcagtgccctcccctctgctgcctctcccagctctgccatcctgcccagagcagccagacaatgcctccggaagccagggcctctcccagctcagaagccatccttctgccctaagagccatgtccatggccctctccaggtgtccacgccagcccagacctcactgcagtcttctcttgctttcctgccaacagccacacccagcacccacctggccagtcatttcctcctccccgcacaagcattaccaatttggggtgtgcaggtgcagggcctctgtttacctattctgtctgggatattccccaccccctgcccctcataaaagtctattaaatcctacacatcctttttgttgttgttgttgagatggaggctcactgtcgcccaggctggagggcagtggcgcaatctcggctcatggcaacctccgcctcccgggttcaagcgattctcctgcctgcctcagcctcccgagtagctgggattacaggcgcctaccaccatgcccggctaatttttgtattttagtagagacgaggtttcaccatgttggtcaggctggtctcgaattcctgacctcaaatgacctgcccacctcggcctcccaaagtgctggggttacaggcgtgagccaccacgcccagcctggcttctggaattttctagccagaacacagtctctcctgggccctgttcctgttgtatcacttcctgtactaatctgttcccctcatggctagaccgaatgcagcctgaccccttggataagcttccaggagaaagcccacaggatgggcagccagggcgtgagtgtccctacagctaactcagggagatgtccgggccccagaggccatctgcctgcatctctaaaaagtgctgtgggaatgtaacttttctgagtcttagattcttcaattgtagcatgaggggctacttagaattatggattttcaggattggaagaaaaatctcaagttttcttgaccagcttcttcgcaatgcagggatactgcggaaccctaggaaggtcacccagcttccagaggatacctgtgggaatgggaacttgctacctagaggtttattccactcaaacactgggtggctctgatccactattaccagttcaggagaaggccctgtcattctgcgggcttctgttttaatccggcattgttgagaaacacaccccgacaaagtgcctgaaaccttgtggccgctacccccttgtcccaggagatgtgtgtctgtgggatgtgggccacacttgcatgaggaagaatgaatatacgtgtgtgtgtgtgtgtgtgtgtgtgagcatgctcatggaggatgtttaatcagcttcatgctgggtgtgccaggccaatacaaacatctgccagggacctgaagcatgactgaaaagatcagggacacaagaacgcggctgcgactccctgagagcttcattgttccttcaggccacttgggaaggttcactcagcaggcgtctcccgcggtgactcatcatggggcaaggacagcaagggctgagccgggctcactaccctgcactgggcagggggcgggtaggaggtagaggggtgaatgctccatcagagctgcatggaaaccacaggtggcctctgggttttctcccctgtctctgtggatggcagttggttcagaagttctgaacagacctccagagcaaagcagttcccagtttcccacgcagtacagctagctcagtcccattccactccatcctgatgggcattcgaatttacgtcaagtctaaatccgttctgttcctgtggaatgatctgttcctgtggaatgatctgttcctgtgggagcttttcagtattctggttgtgtgtgtgtgtgtgtgtgtgtgtgttataaattccaaaaaagatactattccaatgtattcattgagtcattactcagtagacacacatggagcttctactgtgtgccaggctctagtgatctggcaaatgacagctctttgcctcagtttcctcatccgtctaaggggaaagcaacaccacctcccccacagggctgttgtgaggcacagcactcaatacacgttacagaaaataaagatgcacatggagtggatagacggttctacagacgcagcccccaggaaggcatgggggacagcccagttgtgcccctcgatgtcaatctgtcctcctacagcccacagtgctacagctgggctgccacagccaggcctttcgggaggatccaccaataggcttcagggcccagggccaagtacattacgcagcaaatagaccaaggaaggaactaggagcctggaactctcaggcagggggtggggaattgctttcttaagacactttctcctaagaaagaacaacaacaacaaaaaagacactttctcctttattcccctccccgaaagaggattctatctaacaaggaatgcttgctagaagtagaggtgggtacatttagaagatgttttcttgtctcaggaagagagaatctgtttcccctaccctcctgccctggtgattcagggctgtgatggaagaggccccagctgcctcttccgcatatcattttgggaaggtcaatgacacagccacttctagtttctgtaactcattcttgctggaattgccctcagctctctgtgaagtgacaggcctgtctgctgggtttcaagggataattttacatgttctacagggtaaattattagctgtccaaaaccccctagaaaacaatgctctgtcttccatatcatagagctctgagctgcatcatctctgtaggttttttcctgctgtgggggcggtcacagtaggtgagggagcctaagtttgtgcagcagctacggaaggtcacattgttccagaaatcggctctgggaaggtgggcagccaggggatgggattgggaactgcaaattcctaaaatctttagaaaacaagaaagtttgggctgggtgtggtggttcatgcctgtaatcccagcacttttggaggcagagacaggcggatcacttaaggtcaggagtttcagaccagcctagccaacatggtaaaaccctgtctctactaaaaatatgaaaactagccgggcatggtggcaggcacttgcaatcccagctacttgggaggctgaagcaggagaatcacctgaacccggaaggcagaggttacagtaagctgagatcccgtcactgcactctagcctgggtgacaagagcaaaaaactgtctcaaggaaaaaaaaaaaaacaaaaaccaagaaagttgttttcttgggactgtctttgcccttcatttctgacctgcatttctagagagctctagaaatgcagaattaaagaaaaaattacaggattagataaaatcaaaggaggcctgggaggaatccaggtgccatgaagactcagccactgcggcctctgggctccagggccgtagatgacggatctctcagaagcttgtctcttgactaagcctgactggacttgccaatcagggaaggggtggagtggattctggcattctctggaggtttccggcctggcctgagtcaggaggattaaggtagggccttgctgactgtatgcttggaggctggatgcaaaatttttgcccttttagtccttttcagcaccccgccttctcgaaggtacagccaggaggcctaagatctttcctttttctttttttttcagacagtcttgctctgttgccaggctggagtgcagtggcaccatctcagctcactgcaacctctgcctctcgggttcaagcgattctcttgcctcagtctcccgagtagctgggactacaggtgccctccaccacaccccagctaatttttgtatttttagtagagatggggtttcaccatgttggccagggtggtctcgatctcttgacctggtgatccgcctgcctcagcctcccaaagtgttgggattacaggcatgagccaccacgcccggctccagcctaaagtctttcatgtcctctccccaaccctttgtttactgtattttatagaatcagcatcatggcttcttgcatggaatcctctcattttacatatctcagttgctactgggaagttatttgggttggtgcctgaggtcacagggctgtttgtcagtggagtaattgccagaaaccagaaccaagggcattctatttttagcctgggcttttttgaggggagcatgagatgactggctaaaacaaatttgccctcttatatttgtgtccttaggcccaaatgaagtctaggtttgagactaaagtgaaagggaacaaacatgatattaaaggactagtggagggggcagcttccatcagacattatgaaattaaaaggagcacagacgcagtccagagaaaaggtgcttgaaaaaattcagtgttatgttaaaaagatccttagttccaagagtgctgagaaggccacataatcaaatatattattaatctcctcactaaagtacatggcaattttaggctgtctttttttattatttcattttttagagtttttttttttttttttttttttaaagacgttgtcttgctctgtcgcccaggctggagtgcagtgacacgatctcggctcaccacaaccgctgcctcccgggttcaagtgattcttgtgccttagcctcctgagtagctgggattacaggcgcacgccaccacacctggctgatttttgcatttttagtagagacggggtgttaccaagttggacaggctggtctggaactcctgacctcatgtgatccaaccgccttggcccctttatgggttttcacatttgtggattcaaacaactgtgaatcaaaaatatttttaaaggccgggcatggtgggtcacacctgtaatcccagcactttgggaggccaagggaggcagatcatctgaggtcaggagttcgagaccagcctgaccaacatggtgaaaccctgtctctactaaaaatacaaaaaaaattagccgggcgtggtggtgcgtacctgtaatcccagctactcggcaggctgagggaggagaatcgcttgaacctgggaggtggagcttgcagtgagccgagatcgcgccattgcactccagcctgggctacaagagtgaaactccatctcaaaaaaaaaaaaaaaaaaaagaaaaatttttaaaaattgaatctgtattgaacatatacagacttcgtttcttgttattactccctcattaatacaatataaaaattatttacgttgtattaggtattataagcaaactagagatgatttaagggatatgggaggatatctgtaggttacataaggaacttgagcatcttcagattttagcatccgaggagaggttttagaaccaaggccccatggataccaagggatgactgtacaacattctggcggctgggcacagtggctcaagcctgtaatcccagcactttgggaggccgaggcgggcggatcacgaggtcaggagatccagaccatcctggttaacacggtgaaaccctgtctctgctaaaactacaaaaaattagtcgggcgtggtggcgggcgcctgtagtaccagctactcgggaggctgaggcaagtgaattgcttgaaccagggaggcggaggttacggtgagccgagatcccgccactgcactccagcctcagcgatagagtgagacttcgtctcaaaaaaaaaaaaaaagaaacattctgtaatctgtcaaggtaatggaaattaatgcagtgacactgacaataatttaaagcattttagggctcttaacgttcatctcactcgctctagagtgaaggagagagcagagagtacagagcaggtcctaggtcctcccccagatatagaaaaaccgcagttggagagactgacagaagtgctggagaggaagggaggcagcaggacgtggaaaatctgggattcaagaacagcttctgctattaattagctgtgtgtcatttcaggcaaatcacaaaatctccaggcccccaaatccccatttgcgaaacgaggtgacctgcctcagttttccttcatccagcgataaaattctactaaaaaatttccaaccccagagcaagcatcaggactgtgcctgaagggatccggctgcatctcagtaatattccactcttacaggcttaaaaataaaaaagaaaagaaaagaaaacaagaacagtttcaccagcgtcaattgagaacagctgcttcaacaggccctgctttatgtgggcaggtggggacagggagttggcccagaaaacaggaccctcatttcctggagcccccagggcagctccccaacaccgtacacaacctgcatcatttacaggagccaaaggagttttagaaatcaacttcatagagttgctgtatcattgtgttagttttgccatcctaacctatacagcgtcactaatctctcccctcggagttgactgcctaaaaacaagccatggatacaggttccaaagacccgggggtgagggagcggagagggtgggtgtcaccaccccgtccagctccaagctttgtgtgccctggaactctccattttaggtcattgcttcagtttcttttctaaaaaattaggctgctgcaaggtcagcctgagaccacttctgccccgagaattctagactagtaagacctggtgacatacaaacgacgaagatattttacaataatgccatggcccttgatagctacacgaggtttgtgttctgattttaaattaatggatgacgtcgagactatatggaggaaatgacaaaggacaggagagaggtgggaaaggaagacctagactgaaaatggaagttgggcagcagctccacgaaagaaagaccagcccccaagtgcagtgacagcgcagagtagcgaccgagaagttcccaggccagctgccaccccgcccccatgccattccccagaacaggcacaggcgttagggcggggcgcgcgtgcgcagtcacgcgctgcgccaaccgccacagctccgggaaggcggccaggaccggctagagccggttagaaccagtggcgcccgcccacgagccagcgcctcacaaagggagggcggctcacggccctcgcgtatccctgcgcggcgctcgcgagccgcccctcccccggcgtttgtccctgacgcagccccaccggttgcgcagtccctccccgcccccgctctcccctccgcagcctgcagcccgagacttctgtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaatagggaacttctttttaagtagcctcctttccactatttagtaattggctgtgagctgggctgggggagaaatggggcggggtgtgtgtgtcattggaaagctctcttttttgtttttttgagacagtctcactttgtcccccaggctggagtgtagtggcatgatctctgcaaactgcaacctccacttctggggtccaagtggttgtcctgcttcaccctccctgtagctgggactacaggtgcacaccaccacgcctggctaatttttgtattttcagttagagacgtggttttaccatattggccaggctggtctcaaactcctgacctcgtgtgatccacccgcctgggcctctgaaagtgctgggattacaggtgtgagccaccaagcctggccgatccttttaagtttttaaaccagttaagctctttggttccccctcagagtcccaaggtcctgggtcactcaggatcacattttcctttaatcagttgtcactggtccccttttgtccctttgaacgtgctgtgggattagtagcagcatctggctgttggaaggactggctgggatctcaggtgaaataccctccctggccctccttacccttaagatctccctgaaaagtcagaccttgcttattggagtttgagatgcattctagtaaacccagacctaccagagagagggacccacgtctgaagaatcttccagcctggggaacctgtgactggccacacccttagcctaatggaggggcctcagaagcagaactacctttttttttttttttaatggtattacattttgcaaatggagaggtagactctgattgggccccttttgacaacgcagcagagctgaggtttgaatcctagtcagtcaacacttcaacccctatgttgctgtttcttcaatgtctagaatgttctgatagatgaagcaatggcccggcaggtcagcagcacaccaacccccaacctacccagcctgtataggccttggccacaggagctttctcttcccttgaagtgatctaatgggggatggggtatctgtctcgctggttatgaaagaagctgagctaggtgctctcctaagttgcttaagtgtcttctgaattgatgcccagtcagtttcgtatggagaaaggtctctgtttttccaaagcagaaggttctgtggaagcacaaatactttactggagagcaaaggagtacgagtaggaattgggggccacgcacagtggctcacgcctataatcccaggactttgggaggccgaggtgggcagatcacctgaggtcaggagttcgagaccagcctgaccaacatggagaaaccccatctctactaaaaatacaaaattagccgggcgtggtggcgtatgtctgtaaccccagctattcgagaggctgaggtaggagaatcgcttggacccgggaggcggaggttgcagtgagctgagattgcgccactgcactccagcctgggcaacaagagcgaaactgtctcaaaaaaaaaaaaaaaagaagaagaaaggctgggcacggtggctcaagcctgtaatcccagcactttgggaggccgaggcgggcggatcacgaagtcaggagattgaaaccatcctggctaacacggtgaaaccccgtctctactacacacacacacacacacacacacacacacacacacacacacacaatttgctgggcgtggtggagggcgcctgtagtcctagctactcgtgaggctgaggcaggagaatggcgtgaacctgggaggcggagcttgccgtgaggtgagatcgggccactgcactccagcctgggcgacagagcgagactccgtcttaaaaaaaaaaaaaaaaaaaaaaagagtaggagctgggcattcgccaggggctacgtagttcctggagttgaggaagttctccaggattgaaaaatgtaaagatcagacactgatcacagcaacaggaggaggcagaaaagtaggccggaagtcatttccaccctctgagcacaaaatggagagcataaattccccaaaagctcctgtccaagtcaaggggactgcgcttttttttttttttttggaaacagagtctccctctgtcgccaggctggagtgcagtagtgtgatctcggctcactgcaacctccgcctcctgagttcaagcgattctcctgcctcaaccttccgactagctggaactacaggcgcgccaccacgcccagctaatttttgtatatttagtagacgcggggtttcaccatgttggccaggatggtctcgatctcttgacgtcgtgatcctcccgcctcggcctcccgaagtgctgggattacaaggatgagccaccgcgcccggccgactgctcttaataatataaacaagccctaggcattccccatatgtactcctccagttgtacacagggacctcagttttttcttttttttttcttttttcttttcttttcttttttttttttttttttgagacggagtctcgctctgtcgcccaggctggagtgcagtggggcaatctcggctcactgcaacctccacctcccagttcaagcgattctcctccctctgccttccgagtagctgagactacaggcacacgccacaacgcccagctaatttttgtatttttagtagagatagagtttcgccatgtttgccaggccagtctggaactcccgacctcaagcgatctgcctgccttggcctcccaaagtgctaaaattacaggtgtgagccaccgatcccggcccacagttttggatttcatcatcctgataatcctgagttcaaggggcagctccaccattccccaacccctccaaaacctaccctctcaagcccctcagaccgaggatcaggggctggttggtatggacctgtgtgagatttggtttgtttttgtttttgatacagggtctcattttgtagctcaggttggaatgcagaggcacaatctaggctcggctcactgcaacctctgcctctcaggctcaagtgatcctcccatctcagccccggggtagctgggattataggaacacctgccaccacacctggctaatttttttttttttttgagaagcagtcttgctctgtcacccaggctggagtgcaatggtgcaatctcggctcactgcctgccacctccacctcctgggttcaagcaattcttctgcctcagcctctggagtagctgaggctacagttgtgcgccaccacacctggctaatttttttgtatttttagtagagacagggtttcaccctattgtccaggctggtctcaaactcctgacctcgtgatccgctgttttcgtttggtttggggttttttttttttttgagatggagtttcattcttgttccccaggctggagtgcaatggcgcgatctccgctcactgcaacctctgcctcccgggttcaagcaattctcctgcctcagcctcctgagcagctgggattacaggcatgcgccaccatacctgtctagttttgtatttttagtagagacgcggtctctccatattggtcaggctggtctggaactcccgacctcaggtgatccacccgcctcagcctcccaaagtgctgggattacaggcttgagccaccactcctggcctaatttttgcatttttattttattttatttatttatttatttatttatttttgagacggcgtcttgttctgtcgcccaggctggagtgcaatggcgcgatctcagctcactgcaacctctacctcccaggttcacgctattctcctgcctcagcctcttgagtagctgggattacaggcactcacgacggtgcccagctaatttttgtatttttagtagagacgggggtgtccgccatgttggccaggctggtttcgaactcctgaactcaggtgatccgcctccctcggctttccaaagtgctgggattacagacttgagccactgcacctggcccgggccgagtacttctgacttcaggaaatggatgaaattaccagacttaggggaagggaacagtgtggggaagagatctgggagggttctcattcatgggttgttgatttggaagaccagaaacctggctctgacaaagcagtgttctttacgcctctgttttcctatctttaattggggacagtgctctgtcagtttactgtgacaagcaagagtagccacagtagacccacctggaagcaactagaaatgacttggctcttgctgccatctagtgaacaaattgggcattgcatgcgttagctttggaatacattgtaatacacttgttcaacaaactttttttttttttttgagactgagtctcactctgtcacccaggctggaatgcagcggtgccatcttcactcactgcaacctccgcctcctgggttcaagcaattctcctgtctcagcctcctgagtagctgggattacaggctcccaccaccacgcccggctaatttttgtatttttagtagagacagggtttcaccatgttggccaggctgatctcgaactcctgacctcaggtgatccacctgcctcagcctaccaaagtgctgggattacaggcgtgagccactgcacccgtctcaacaagcatttttattgctgagtaatactcccttgtgtggatataccatgaaattatttttaaaaatattggctgagggctgggcgcggtggctcatgcctgtaatcccagcactttgggaggccgaggagggtggatcacctgaggttaggagttcgagaccagcctagtcaatatggagaaacctcctcgtctctaccaaaaatacaaaaatgttacaaacctcacattcgacacatgtatcccaggacttaaagttaaaaaaaaattatctgagtgtgatggcacatgcctgtaatcccaggtactcgggaggctgaggcaggagaattgcttgaaccagcgaggcagagattgcagtgagccgagatcatgccattgcactccagcctggccaacagtgagattccatctcaaaaaaaaaaaaaaaaaaaaattaaggccagtctcagtggctcacgcctgtaaccccagcactttgggaggccaaaatggacagaacacttgaagtcaggggtttgagaccagcctggccaatgtggtaaaaccttgtttctactaaaaatacaaaaaaattagctgggcgtagtggcacacatctgtaatcccagctattcgggaggctgagacatgagaatcacttgaacccaggaggtagagatcacgtcactgcactccagcctgggtaccagagtgagactctgtttaaaaaaaaataaaaattaagagtggctgggcatggtggctcacgccggtaatccaagtactttggaaggctgcagagggtggatctcttgaggccaagagtttgagaccaacatggccaacacagcaagaccaaaaatatacaaaaattagccaggcgtggtggctggctcctgtaatcccagctatttgggaggctgaggcattgcttgaacccaggaggtggaggctacattaggccgagatcgcaccactgcactccagcctggacaacagagcaagactctgtctcaaaaaacaacaacaacaaaaaagagattgtgtcttgctttgttatccaggctggtcttgaactcctggactcaagggatcctcccacctcagcctcccaaagtgggattacaggtgtgacccactgcacccagcactggtgttttttgttttgttttgggacatggtctcactttgtcgctgttgctcaggccgcagttcagtggcaggatctcagcttactgcagcctctgcctcctgagctcaagccagcctcccacctgagcctcccaagtagctggaaccatacaggtgcataccaccatgcctagctaattttttttttagatggagtttcactcttgttgcccaggctggaatgcaatggcacgatcttggctcactgcaacctccacctccccagttcaagcaattctcttgcctcagcctcctgattagctaggattacaggcatgcaccaccatgctaggctaattttgtatttttagtagagatgggttttctccattttggtcaggctggtctctaactcctgacctcaggtggtctgcccgccttggcctaccaaagtgctgggattacaggtgtgatccaccgcacccggccttaatttttttatttttagtagagatggggtctctccatgttgcccaggatggtctggaactcctgagctcgagtgatcctcccgcctcagccttccaaagtgctgagattacaggtgtgagccgcctcgcctggccacagttgcgtatcttctttggtgaagtgtctgttcatttgtgttgtgtttttctcttttcttttcttttcttttcttttctttttaagacggagtctccgtctgtcgcccaggctagagtgcagtgttgcgatctcggttcactgcaacctccacctcccaggttcaagcgattctcctgcctcagcctcccaagtacctgggattgaaggagcgccccaccacgcccggctaatttttgtttttttagtagagaccgggtttcaccaggttggtcaggctggtcttgaactcctgacctcaaatgatccacccaccacggcctcccaaaggtgtgagccaccgtgcccagccattttgtgttttttttttcttgccattgttgttggcatttttatcttttgttgagttgtaagggcttttacatattcgagatagaagtcccttgtcagattttttttctttttttacttctgttgtatgtttattatttattttgtattttttgagacggagtctcgctctgtcgcccaggctggagtgcagtggtgcaatctcagctcactgcaacctctgcctcccgggttcaagcaattctcctgcctcagcctcccaagtggctgggattacaggcatgcaccaccacaccccactaatttttgtatttttagtagagacagggtttcacaatgtcggccaggctggtctcaaactcctgacctcaagagatctgcctgccttggtctcccaaagtgttgggattacaggcatgagccgctgcccgtggcctgttttatgtttagatatatgttttgcaaaagttttatcccaatatgtgtctttcttttcatttttttgtaacagtgtctttgaggagtagaagttttaaatctctttttttaaatttttattgttacaaatgtttacttaataaaaagcttaatataaaaatgcacatggcccaggccgggcgcggtggctcatgcctgtaatcccagcactttgggaggccgaggcgggctgatcacgaggtcagaagatcaagaccatcctggctaacatggtgaaaccccgtctctactaaaaataatacaaaaaattagccgggcgtggtggcgggcgcctgtagtcccagctacttgagaggctgaggcaagagaatggcataaacccgggaggcagagcttgcagtgagccgagattgtgccactgcactccagcctgagcgacaaagggagactctgtctcaaaaaaaaaaaaaaaaaaaaatgtacgtggcccaatttttacatcatagtaaaacaagtcctttggagaagggacttggatttctctgcagagccgccattgtttatagttgttccaaggcttctaatatgaggatacttctccctcatcttaccactgttccagggttgctctgttgtccactagttgccatcttcacactttcatctatcacaagattcataaagggatcaaatccccaaaatattccttggatacatctgccatcatttaatattttttattttttatttttttgagatggagtctcacactgttgccaggctagaatgcagtggctcgatcttggctcacagcaacctctgactccctggttcaagcgattctcctgcctcagcctccagagtagctgggactacaggcatgcgccaccacgcccagctaatttttgtatttttagtagagacgggttttcaccatgctggccaagatggtctcgatctcttgacctggtgatctacccgcctcagcctcccaaagtgctgggattacaggcgtgagccaccatgcctagccgttatctataatttttatgctggaggagggcggggggtgagctttgctcatagtgtctcaaggttttaaatcttgaacaaactactgatacacccgtaatacataagaatttcaaaagatgttgagattaaagaaaccagtttttaaaaactattagtttagtgcaaaagtaattgcaggctgggtgtggcagctcacgcctataatcccagcactttgggaggccaaagcaagtggatcacctgaggtcaggagttcaagaccagcctgaccaacgtggtgaagccccgtctctactaaaaatacaaaaattagccgagtgtggtggtaaacacctgcaatcccagctaccggggaggctgagacatgagaatcgcttgaacccgggagacagaggttgcagtgagccatgattgcacccctgcactcaagcctgggtgacagagtgagactccgtctcaaaaaaaagtaattgcagtttttgccattaatacatactgcatgattcaatttatatacaaatctttgtatttttagtagagacggggtttcaccctgttggtcaggctggtcacgaactcctgacctcaagttatccacctcccctggcctcccaaagtgctgggattacaggtgtgagccactgcacatggccaagagcatttttttttttttatagagacaaggtcttgctatgttgcccaggctggcctcaaactcctgggctcaagcaatcctccttcctcagcttcccaaagtgctgggattacaggcatgagccaccgtgcctggtctctgagagcatttcttgtgaagtgcactggaaaagcacagaagcaatgctttttaacaaattaattaaattaatttatttttatttctttattttgagacaaggtctcaccctgttgctcaggctggagtgcagtggttgaatcatggcttactgcagcctcaacctcctgggctcaagcaatccttcttcctcggcctccaaagtagctgggactacaggtgcacacctccatgcctggctaattttttgatattttgttgagatgagggtcctactctatggccgaggctggtcttgaactcctgagctcaagcgatcctcccacctcagccttccaaagtgccaggattacaggtgtgagccatcttgccaggctagaagcaatgctttctgcctgaataattcagggaaggctagacagagcaggggacatttggagtgagattcaaagaatacgaatttgctggatagaaaagaccagggcagccttcctccagagagaacagcttgaaagtgagaaatgtggggcactgcaacccagagtggctggaagggaggctgagagaggagttggagaaggggagagaggagaggagagaggaggggaggggaggggaggggaggaggagcgacagagagagagagagaggcagagagaggagagagagaaaggagacagagaaacagagagaggaaagacagagaggagagagagtagagagagacagagaggagagagacataggagagagataaaagagagagagaggagaaagagagacagagaggagagagaccaaggagagagacaggagagagacagagagagagcagagagaaaggagagagagagatggagagagagaggagtgagagtagagagacagaggagagagacagagagagaggagagagagacagaaaggagagagagagaggagacagaaaggagagagagagacagagagaggagagagacagaaaggaaagagagagagacagagagagagagagaggagagagagagagagagaagctggggtaggttggagggtagttaggccctaggacagcagatgagttaggggcttgcccctggggaacagatggtgagactgatgattctggctgcaaggtgggggatgatcacactcagttctagccacgtgcagtttgaggaggctgggctgcgcgggggtctgggccacgatgggggtgtaactgatttctgagtgggaaattctgagagtctttgtttgaaatatctttattttgctctcagttttcatgacagcttagctgggaatggcatttaggtagtggttgccacttgaagatgtctttatgtttaaaaagttattgttttgttttgttttgtttgaggcagagtctggctctgttgcccaggctggagtgcagtggcgcgatcttggctcaccacaacatcagcctcccaggttcaagcgattctcctgcctcagcctcctgagtagctgggattacaggcaccttgccaccacgcacagctcatttttgtattattagtagagacgaggtttcgccgtgttggccaggctggtctcaaactcctgacctcatgtgatctgcctgcctcagcctcccaaagtgctgggattacaggtgtgagccacctcacccggccagttttgttttgttttgagacaggatctggaatggcttgctctgttgcccaggctggaatgcagtaccgtaatcatagctcactgcagcctgaactactggactcgagcaatacacctgcctcggcctcccaaggaaatgggactttaggcatgcaccaccacaactagctgatttttaattttttttttttttttttttttttagagataggatctcactgtattgcccaggctggtcctgaactcctgggctcaagccattctcctgccttggccctccaaagtgccagggttataggcataagccgctgcacctggcctgaacttcttttcttagatttattcctagtaatttattctttctttatgttattaaaaatggagccagacgtggtggctcacctaagtaaaacttcacagatgacataatcttgtatacagaaaatcctatggagtctttgaaagctattaaaattaatgagttcagcaaggttgtaggatgcaagatcaacatacaaaaatcactatagcagcgaacaatctgaaaacattctttttttttttttttttttttttacctgacgactcactctgtagcccatactggagtgcaatggcacgatctcgactcactgcaacctcgcctcccaggttcaagtgattgtcctgcctcagcttcccgagtagctgggattacaggcacatgccaccatgcctggctaattttttttttttttattaagtagaggtggggtttctccatgttggttgctcttgaactcctgacctcatgtgttctgcccactttggcttcccaaagtgctgggattacaggtgtgagccactgtgcctggccaggttcaggtgaccttcacgccccagttcagactacaggaatgtgccaccatgcctggctggtttcttttttctttttaccgtgaaagactggtggattggcccgggcccggtggctcatacctgtaatcccagcactttgggaggccaaggccagcagattacctgaggtcaggagttcaagaccagcctggccaacatggcgaatccccgtctatactaaaaatacaaaaattagctgggtatggtggtgaatgcctgtaatcccagctactcgggaggctgaggcaggagaatcgcttgaacccgggaggtgaaggttgcagtgagctgagatcgcgctactgcactccagcctgggtgacaaggtgagactctgtctgaaaaaaaaaggaaagactggtggattttgttaattgctttttctgcttctattgagatgatcaggtatttttttgttttgctttttattctattaatagtatgtattacattaattaattttcagatgttaaaccaaccttgtattcctaggataaatcctatttaatcatgatatagaattttccttttctttttttttttttaagacagagttttgctcttgttgcccaggctggagtacaatggagcgatctcagctcaccgcaacctccgcctcccaggttcaagcaattctcctgcctcagccttcccgagtagctgggattacaggcatgtgccaccatgcccggctaattttgtatttttaatagagacggggtttctccatgttggtcaggctggtcttgaactcccaacctcaggtgatctgcctgccttggcctcccaaagtgctaagattacaggcatgagccaccgcgcccagccttttttttttttttttttttttttaaacacaggttcctgctctgttgcctagactagagtgcagtgccgcaatcatggctcatgtctcacggctcactgcaacctcaacctcttgggtgggctcaagcaatcctcctgccttagcctcctgagtagctgggactacaagcatgtgccaccatgctgggctaatttttttcgtagagactgagtcttgctatgttgtctaggctgacctcaaactcctggcctcaagcaagctaaccacctcagcctcccaagtgctgggactataggtgtgagccactgcaccggctagaattctcctgactcagcctcctgagtagctgggattacaggcaagcctggctaattttttttttttttttttttttttttttgtatttttagtagagacagggtttcaccgtgttagccaggatggtctggatctccagaccttgtgatccacctgccttggcctcccaaagtgatgggattacaggtgttagccactgcgcctggcctgctctgtagtttcttgtgatgtctttatctggttttgttatcagggtactattgataccagcctaatagaatgagttgggaagtattccctcttcctcttccattttttggaagtgtttgtgaagaattggtattaattctttaaatgtttggtagaagttagtagtgaagaagttactagtcatctgggcctagacttttctttgtaagtaggtttttaatttttttttgagacagagtctcactctgtcgcccaggctggagtgcagtggcatgatatcggctcattgcaacctccacctacagggttcaagctattctcttgcctcagcctcccaagcagctgggactataggtgtgtgccaccatgcctggctaattttgtatttttagtagagaaggggtttcatcatgatggccaggctgatctcaaacttttgacctcatgtgatccgcccgccttggcctcccaaagtgctgggattacaggtgtgagccactgcacctggcccatattcacaggttctgagagttaggacatggacatctttgaggggctagtattctgccgaccacaataggccagaaccctgaacagtttactttttaggcatcatatttgctaaaaacaaaacaaacaaaaaaaccaaaccaaacaaagaagtaaaaatcaaaacaaacaaaaaacacagagccattttttggaaagacaataataggaagtcaaaataatgttaattttggagttattattgtttattttattttattttatttttgagatggagtctccctctgtcccaggctggagtgcagtggcgtgatctcggctcactgcaacctccgcctcccgggttcaagcgattctcctgcctcagcctccagagtagctggaattacaggcgcatgccaccacgcccggctaatttttgtatttttagtagagacgggctttcagtacgttggccaggctggtctcgaactcctgacctcgtgatccacccacctcggccttccaaagtggtgggattacaggcgtgagccaccaagcccggcagcttgaagttattcttacatgctttggcagatgttaaaacgtttgttttttttaaaattctcaacatttagatctaggacagagcacaatttaaatactttctaaaattaaatttggctgttacataagattcagcattgtttacagcagcttttctgtttcatgcgttataatataagataaagtagaaagaacaccaaaggttttcctatgataagtcatcaacaaaataagtgtgggccattagcaagtagctcttgatatcttacagtgggctgaacaacaaatactttctcttgaagaatttggatccctgttagctaagcttaaagttcccactattttattttattattttatttatttatttatttttgagacgaagtctcactcttgtcccccaggctggagtgcaatggcgcaatcttggctcactgcaacctccgcctcccaggttcaagcaattctccctcagcctcctgagtagctgggattacaggcatgtgccaccacgccaggctaatttttttttttttttttttgagacagagtctcgctctgttgcccaggctggagtgcagtggtgcgatcttggctcactgcaagctccgcctcccaggttcacgccattcttctgcctcagcctctggagtagctgggactacagtcgcctgccaccacgcccggctaattttttttgtatttttagtagagacggggtttcattgtgttagccaggatggtctcgatctcctgacctcgtgatccgcccgcctcggcctcccaaagtgctgggattacaggcgtgagccactgcgcctggcctcgcctggctaatttttgtatttttagtagagacggggtttcaccatgttggccaggctggtcttgaactcctgacctcaggtgagccatccgcctcggcctcccaaagtgctgggattacaggcgtgagctaccgtgcccatccaagttcccactttttttttgagatggagtctcgctctgtcgtccaggctggagtgcagtggtgcgatctcggctcactgcaacctccacctcccagattcaagcgattctcctgcctcagccttcccagtagctgggattacaggtgcccaccaccacacctggctaatttttgtgtttttagtagagacggggtttcaacatatgtgtagggtccagccctacggggcttagcatgtgttctccccctgtgtggagactagagattgtaataaataaagacacaagacaaagagataaagagaaaacagctgggccccagggaccactaccatcaagacgcggagaccggtagtggccccaaatggctgggctcgctgatatttattgtatacaagacaagggggcagggtaaggagggtgaatcttctaagtgattgacaaggtgaagcaggtcaggtgattacaggatagggggcccttcccttttaggtagccgaagcagagagagaaggcagcatacgtcagcgttttcttctctgctcttataagaaagatcaaagactttaagactttcactatttcttctacctctatctactacgaatttcaaagacgaaccaggagtatgggaggagcatgaaagtggacaaagagcgtgagcattgaagcacagcaccacagggaggggtttaggcttctggatgactgcgggcaggcctggataatatccagccttccacaagaagctggtggagcagagtgtcccctgactcctccaaggaaaggagactccctttcgcggtctgctaagtaacgggtgccttcccagacactggcgttaccgcttgaccaaagagccctcaagaggcccttatgcgggcgtgacagaaggctcacctcttgccttctaggtcacttctcacaatgtcccttcagcacctgaccctatacccgccggttattcctaggttatattagtaatgcaacaaagagtaatattaaaagctaatgattaataatgcttataacaatgattgataattgttcatgaccatctctatatctaatttgtattatgactattcttattctaactattttcttttttatactgaaacagtttgtgccttcaatctcttgcctccgcacctaggtattcctccgcccacacatatgtgggggaaaggaagcgagatcagactgttactgtgtctatgcagaaaaaaagaagacataagaaactccgttttgatctgtactaagaaaaattcttctgctttgagatgctgttaatctgtaactttagttccaaccctgtgctcacagaaacatgcgctgtattgaatcaaggtttaagggatttagggctgtgcaggatgtgccttgttaactatatgtttgcaagcagtatgcttggtaaaagtcatcgccattctccattctctattaaccagggacatgatgcactgtgcaaagccacagggacctctgcccgagaaagcctgggtattgtctccccgactgagacagcctgatatggccttgtgggaagggaaagaccttaccatcccccagcccgacacccgtaaagggtctgtgctgagaattagtaaaagaggaagatctctttgcggttgagataagaggaaggcctctgtttcccgtatgtccctgggaatggaatgtcttggtgtaaagcccaccagtcattctattctgagataggagaaaactgccctatggctggaggtgagatatgctagcggtgatactgctctgttactctttgctacactgagatgtttgggtaaagagaaacataaatccagcctacgtgcacatccgggcacagtaccttcccttgaacttatttatgatgcagattcctttactcacatgttttcctgctgaccttcttcccaccatcaccctgttctgccgcagtccccttgcagagatagtgaaaatagtaatcagtaaatactgagggaactgagagaccagcgccggtgcaggtcctcgtatactgagtgtgccggtcccctgggcccactgttctttctctatactttgtgtcttatttcttttctcagtctcttgtctccacctgacgagaaatacccacaggtgtggaggggcaggcccccttcaaacatgttggtcaggctgacctggaactcctgacctcaggtgatcctccagcctcggcctcccaaagtgctgagattacaagcgtgaaccactgtgcctggccctcaccccagtttatagatgggggacctaacgcacccaaagggaactgtgtgagttctcacatccaatgaggggctgaaccgtgattgaaacccagcaccgtctcactgtggcatctctgcccttgagttatctcccaaaggcatcccaaccagacttttcataaccagtcccagaatctcaccagtgctccatagctgtggttgaggcactgtccccaagcctgggtcctgagaccctaccagcagaagaaccactgcctgtccagcccctcctacacagctcaggggctggatccccaccagtgtgatgtgctgattgagctaacaccactccatggctgtctacacaggcactgagagatgcaatccgttggcttgagagccgggcagctgagcccaggagagcagggtcccctcccagccctttggcctcttccagacctgcccagttgctccttctccctccctcctttcctggggtcacttcttcttccctcctcagtctctccttcctccattccctgggtgcccgcccctgccccggggttctggacctccttggaaccttggattcactctctgcctctcacccacgctctttctctggggcgtctcctcgtgcttctctcatggtcacttcaccaggaccgactcctccccggagcctggaggcacccacttgctggtgggagagagtgtctggcgtggggccagtctccctctctgggtctctgcctcactcctcactgcaccctctcatgcctgtcagtctttctacctctccccctttttgcctcggtttccccatccctctgtcccttcttaagctctcatccttacagtacgctagaaggcaggctctattatcctttaggatttaggcctctttagataaaagggctcacaggcttggagggttttaagtgacttacccggcggcggagtactgatcttagtaccgcccgccgccccggactgccccgcccctccctagcccccccatccccgcccctccctagcccccccatccccgcccctccctagcccccccatccccgcccctctcccgcccctcccttgtccccgccccttcccgccccaactcaggttctgccccaccccgccccaattcacgtcctgctccgccccgacgtaggccccgccctggcccccgggccccgcccccgtctgacgcaggccccgccccctctccgccccgccccggctcgggcggccggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggtgagtgcggccgagctccgtaggccgcggtcgacctgggccttgcctattccgcgccgccgaccccgtcgcgttgcgcccggcctgacgtggcggcggaaccaaggggtagcaggccggggagggggcgggcagtgcctacgtggcgggcggagggaccgagggaccgacaggcggacagggccggggtcacgtgggcccggcgaagtgtccctaaggctgacctggggagagacctggctgcgggcccttgtcttccggccacacaacagctctgggaccatctcaggccccgctgccctcccctaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggaggtacctgctgccttgcctgcccgtctctgcccctcacgatgtcctggttacccactcctgtctcccctcctgccctgtttccaccctatgtgccccagcacccccagatttggtttcctcttccccatctctcccaacttcaagtcgcttatctctccttcctctctgcccctccgcccttgataaccctgtgtccccttccccagacagaaaaatgcctccacgtcgtgacagaggctgtgaccccgttgggaatatacctcaaggcgagagtggaggctggtggcctgaaggagctggagatctcctgggggctacaccagatcgtggtgaggtggggggcagtggtgatgagagcagggatggggggttgcaggtgctggggcgtgatggctccttttgcccccagaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtgggtgactgggggcagcgcgccccaacctgccctgtcctggaggcccctgcagcctcaggactcctagactagttggcactcccctgttccctgctgcctggctggggagggaatcagtgtcccaggagtgagggacactcctctgcccccagggtcctcagggcggtagggcgggatggacacagcattcggggttgggtgattctgaacttgaaagctctgtgacctggacagatgtgcctagttctctgaggcttggtttttttaatctgttaagtgaggctaatgaaacctgcctcttgggactgatggctcagctgagggacatagccaggccctggcatgcagtgggtgcctggtgcccaaggcaggctggaggcctgtgcaggtggttggtggggccctaagagctctgggtcactgccacaggtcagcagacatgtggcgcttgggctgcctcatttgggaagtcttcaatgggcccctacctcgggcagcagccctacgcaaccctgggaaggtaagtttcttgcccctggctctttgccctgcctcagcccctctgccagctggctacccctgccctgacactgacccctcccctacagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcaggtgagcccccaacccaccctgggcttcgaccctatctttttcattctgcccctaccctgcttttcagggtacctcacaattgaccctcaggagacaagcatggactgtggagttaggccaatccgggttcaaacccaggctccagctcatacttactctgtgacttcccttggctgaagttcagtcccaataatagtacaggttgagcatccctaatccgaaaatgcatgatctactccaacactggaaactttttgaccaccaacattacaatccaaggaaatgcccattagagcattttgcatttcagatttttttggattacagatgttaaattggagccaggcgcggtggctcatgcctgtaatcccagcactttgggaggctgaggtgggtggatcacctgaggtcaggaattcgacaccagcctgaccaacatggagaaaccccatctctactaaaaatacaaaaaatcagctgggcgggcatctgtaatcccagctactccagaggctgaggtaggagaatcacttgaacccaggagacggaggttgcagtgagccgagatcgtgccactgcactctagcccgggcgacagtgtgagacttcgtctcaaaaaaaaaaaaaaaaaaaagatgttgaattggtataatgcacatattccaaaatccaaaaaacatctgaaatctgaaacacttctggtcccaaacattttggacaagggagactcaacctgtacctacttcaaagggacccagtgaggagtcagaattgaaaatgtgtggtatagtgttctgtgcccagcaggcatttagggccagctctggttactccagtcactccacgtgtacattctggctctggtccccaggggtgtaacaccctgtactggctgcaggggggtgggcagcacggtgtggaggaaggtgaggcggacctagatcactgtcctcaagaatctagcaaaaagtaaacagaccagatccccaaccttgggaactcttgctggggaagagacagaaaacataaaaaccataaataagagccaggtgcagtggctcacgcctgtaatcccagcactttgggaggctgaggcgggtggatcacctgaggtcgggagttcgataccagctgacgacatggagaaaccccatctctactaaaagtacaaaaattagccgggagtggtggcacatgcctgtaatcccggctactcaggaaggctggggcaggaaaatcgcttgaacctgggaggtggaggttgcagtgagccaagattgtgccattgcattctagcctgggcaacaagagcaaatctccgtctcaaaacaaacaaaagaacaccataaataagaaaaccagccagtgcggtggctcccgcctgtaaacccagcactttgggaggccggggctggcggattatttgaggtcaggagtttgagaccagcctgaccaacatggagaaaccccgtctctactaaaaatacaaaaaactagccaggcatggtggcgcatacctgtaatcccagctactccagaggctgaggcgggagaatagcttgaacctgggaggcaggaggttgcagtgagccgagatcgcaccattgcactccagcctgggcaacaagagcaaaactcagtcttaaaaaaaaagaaaagaaaaatccagtgcaggaaggaaagtactggagtgggtattcagggatgggctctctgaagtgtgacattggagctggggcctgaaggacatgactgtgggagccagagggatggtacctggagtaagagttccaggcagaggcgacagcacgtggagagatactgaggagggagccctctgctttgcctctgaaccttggtttccacatgtgtatagtgaggagcatctgggtgcactggcctgcagggttgctgtagggaggagggaggaaggctctgctctatgcaatgcccggccccagccgtgtgtggggaagacagcgggggctgagaatcagaatcaggagcaggggaggagagtggcagacactccacagaccctgacccagcagaggtcatggaatcttgactcagatgctgtggggcggggagggcctttggagggtggaaacctggaaggagaagctgctggaaacgctgagaccccgttgcctcctgggcagtgtcggggcagcaggaactttgttacgtggagttctcctcgtacggctggctctgccaagctacccttctccttaaagtgtaccccataggaaatagggtttcgggagcctccaggagaacatgggagggcagtgcccaggggcccctcttcccattgttaggtggagtggtggggagaacccagctgctactctcttgatgtatgaccttggatgtgatttagcctctctgggccttggccccgctgaaccatgtgatcagagcaccaagccggcctcccacgctggtctgagctgctcaagggccatctaggtcctctttgtcccaagccagaggtcgcctctccccggccaagccgcggctatgggggtggtggtacaacagagagcacagggactttggaacacaacactgggtcatgacccctgcctggccactcttggctgctgaccttgaccctctgtctcctcctttgtgaatggggggagtgacagcatcttttgaagggtacagcacaggagaggtgccaaaccagtgagtcagaccctcctctgaccgcttcttagctgtgtgactttggacaagctccttgccctctctgtgcctcagcttccttgttggtaaaatgtggattacattagcacctacctggtaaagttgtgaagaggactgagataatctgtgtaaaggttttagcacataatctgtgctccagaaatatgaattgggggtattatggcctcaaaggggggttaggaggactaaaggagaccgttgagcttacaggctggtccattttggctcagtgggaggatgaggtctgggagtaaagtgtacctaatccttgccttcccacggcctaccaggaacttcctgcccaatccagccagggcagggaaaccaagtaagccccttcacctctttgatcttcagtttcctcctctgtgctcacatcctgggtggcgagcagtagaggcaacactgataaagggcctgatgcccttagtgatgcctctgctgtccctagtggctgctctcccagcaacaggtcaggtagccgcaatggcagcaacagtccctaacccaccgagcatctgccgtgtgccagcctgttctgcagcttttatgtgcattttctggttgaatcccagaactatcccgtagatggtagagctgttatcccattttacatggcaggtaagtgggacagttgggctttgaacccaggcagccaggctccagagcccataaggcccataagcatcacttctccttgtcctcacccatggctgggtttgggctgcaaccaggctgatctcttccccgggtcccgtcctcactcccccagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgagtggaactgtggggtccagaaggctggctgggtgcacaggaactgccaaagagaaggccctggggtagggcaggctgtttagggcagacccaagcccatatgagcaggagcttcctgccagtgtctataaacaggtacctgaccagctgtcccctggggaggagagactctgccgctaaaatccttttttccacaaacctctggcttcacaaccctcagcccttcctccatttctccgggtctgacctgtgcaccttggttcccagggcccaggggattacctactcaccaccccactttgccctcctccctcctgactgcttagcactcagctcacctgacttctgggggctggatcttccaccctttcctcagaccccagcccgcctttttatgggcacctggcattccctgccctcctcaccttggggagaaccctttcatctgaaagacttgtcaggaggggagaagacaacaagcaagtcctgtatagctgagaacccccagaaattgcaggcagaatttctgcatatggcataaaggtacctgtttgtagggaggggcccagagctttcatcagcctcctgaaagaggccttggcccagaaaggttaagggcaaggctgagatggaatatgggtagaggagctactgaggaaatgcctgcccccccctccgccatcacttcattcccaccctgggatatcagccccaggaatttagataagcccagcaaagtcagcccattcctgtgagcagctgaacccatcttcctgccctttcaggtgggcaagttcctgagcgctgaggagtatcagcagaagatcatccctgtggtggtcaagatgttctcatccactgaccgggccatgcgcatccgcctcctgcagcaggtgaggcctctgtaccagactctgtggtggtccacccagaccccaacctggtggctggggaggcacctgccctggctgcacagggaccccagaaaccccacccctgaacatacacacaactgagggacccaatgaggccaggctctcagaaagttggccacatacagggctccttggcagttttgggaatggccagcttgcccaggctgcagcgctctaatgccccctcctctcctggctcagtcactctggccctctagagtggggatacagtctttctcctgcaaccccagggcagctgggagcatcagacaagatggatgggatctaggaagtaccagtggctcccagtgccattccctctgtgaccaccaaacacaccagtcctcctcgtggcactgtgggcaggtggggaggagcagggaaggggtgataccctcatttatagaagaggctcaggctgggcgcagtggctcatgcctgtaatcccagcactttgggagggccgaggcaggcagatcacctgaggtcaggagtttaagaccagcctggccaacttggcgaaaccccgtctctactaaaaatacaaaaattagccaggtgcggtggtgggtgcctgtaatcccagctgctcaggaggctgaggcaggagaattgcttgaacctgggaggcagaggtttcagtgagctgagattgcgccactgcactccagcctcggtgacagagcaagactctgtctcagaaaaaaaaaaaaaaaaaaaatagaagaggctctgagagggtggccagatgagccggactatgagccaggccttcctagcgccctcctggcctttcctcactcctccacctgggcctgaggccaaacacctgggtggtggctcaggaggttgacctggctggccagtgcctgctgggtggaaaagctaagccaggagcggttccatggctatggggatagagtgggaagggctgaccatgttgacgcatcccaacctgggccacagatggagcagttcatccagtaccttgacgagccaacagtcaacacccagatcttcccccacgtcgtacatggcttcctggacaccaaccctgccatccgggagcagacggtcaaggtgggtgtggccaggcccagagtggctacccctggttttccaaggcttggaggggctcaccctagacacagaggccttggctttggcccatgggtccaagcagacactgtccttgctgtgtgggttcaggccgtgggtgcagctcggcagctggcgggggagcacgtcctccattcagcagacaacgagcatctgcctgttcctggcccaagccccatgctgggaggcagcatgcatgaggtgcccagccccctgcactcatggagcttcctttccagggcacagagggtgggcttgccagacaatacaacagaattagaaaatatgtattgttggctggtcacggtggctcacgcccataatccctgcactttgggaggctgaggcaagcggatcacctgaggtcaggagttcgagaccagcctgaccaacatggcgaagccctgtctctactaaaaagtacaaaaccatctggggatggtggcgcatgcctgtaatcccagctactcgggaggctgaggcaggagactcaattgaacctgggaggcagaggttgcagtgagccgagatcatgccgttgcactccagcatgggcaacaagagggaaactctgtttcaaaaaaagaaagaaaatatgcattgttggaaagtgtggggagaagagtttgtggttttaaaaacagtggtcaggggctgggcgcagtggcttacgcctgtgatcccagcactttggtaggccgaggtgggaggatcgcttgagcccaggagttggagaccagcctggtcatcatggccaaaccccatctctacaaaaaaatacaaaagttaggcgcgtatggtgatgcacgcctatagtcccagctactcgggaggctgaggcaggtaggtagcttgagcccaggaggttgaggctgcattgagctgtgatcgtgacactgcattccagcctgggcaacagagtgagacctcatctcaaaatttaagaaattattttaggccgggcctggtggcccatgcctgtaatcccagcactttgggaggccgaggcgggtggatcacctgaggcgatgggagtttgagaccagcctggccaacatggtaaaacatggtaaaaccccatctctactaaaaatacaaaaaatggctgggcccggttgctcacacctgtaatcccagactttgggaggctgaggtgggcggatcacaagggcaggagatcaagaccatcctggctaacatggtgaaaccccgtctctactaaaagtacaaaaacaatctagccgggcatggtggtgggcgcctgtggtcccagctacttgggaggctgaggcaggagaatggtgtgaacctcggagatggagcttgcagtgagccgatatcgcgccactgcactccagcctgggcaacagagcaagactccgtctcaaaaaaataaaataaaataaaaattaaaaaaattagccaggcatggtggtgggcgcctgtaatcctagccactcaggaggctgaggcaggagaattgcttgaacccaggaggcagaggttgcagtgagtagagatcacaccactgcactccagcctgggtgacagagtgagactctatctcagaaacaaaaaagatacggagacgagagtggctctgaggcttgtggcctgagcaactggaaggttaggagttgctatttactgagatgacacaagcatgttgggccccatcttggctgtttctgttaggcagctggatggagatgtcgagttggccactggttatgcatgtgtgaaatttagggaagtctgggctaggggtatgtgcctgggggttgtcagctcacaagatggcattgaaagccatgaaatggctgagatcacctagggcaagagtgttagatagaaaagagccctctagattggctccgggtgtgtgaacgttagagtctcagcaaaaggagcagccagccaggtcagaggagaaccaggagggggtggtgtcctggaagaccagagaccaaagtttcagggagggaaaactcaggggtgtcagaactgctgagggtcaagtttggtgaggatggagaactggctgttgaaattagtaccggggagggcatcagtgacctcaccctgagccagtttggcagagtgtggggctgtttgtgtgagtctaggtggagtgccatcaggagagcagagcagaggaaatgggaaacaggagtgcagacagactttggaggttttgctgtaaagggggacagaaatggggtccctttcttcaacatgctggacagggccaggcccaggctgggaggtggccttgcaggctttgatgggtgtgctctgggatgagggctgccaggaggctgttcctgcacaaggccctttgcccgccacagcccacagttcccactcatttctgccccacagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcgtgagtgtcctgcacaactgctggagcccggtccctgtcgcaggaccacagcctcctccagggccaggagtcttgtgtgtgggggccttcattctcccagagacttagaccctgcacgctgttggccccatatctgggttcccagaggaggagtgagttggccgaagtcacacagtcaggagggatctgggatctgaatccaggcgtgcttggccccatggcctgtgtgcatcccttcagccagggtttgtaagttcagttgcttgccgtgcccagacagttaacaggaatgaacggtcagctgggcagggaggaagggagcctgtgtccgagccctggggacagctgctgttgtggtcccatgccctgaggcagtgtggaacccagtgatttgggaagagaagcccaggtccagagttttaggtcaactctccccatttaagtgattcattcatatttttcagattctggggacctatgggtggtcccattctgggaagtaagggctggtggttctgggtcccaacattgaccctacactcaggagccctctttcctgccccatcgtagaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggtgaggcacagctgggcctgggccctgggctggggctgtaggggatgtcagcccctagctggcctggtaggttcttgggaaccccagagaccccagctctgcctcgttaccccacaggccttcaaggccattcggagcttcctgtccaaattggagtctgtgtcggaggacccgacccagctggaggaagtgggtgagtggcttacactcgtgttccctctttccctgccatgtccttgactgtgacctgtttgtgtcccacccccactggagtttctgaaaggtcctagtgagcagacttgactcagctcccccttcacagatgggagaaatcaggcctggagaaaggaggggtggctgcagggcactgtcagttcctgctgtcctgtcacccatgggtgcctgacgtgcccatacccacctctctctcatgccactgcccagagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggtgagtgtcctggcctagctgcatcagtggctgagagggctgagagctgcaggcacccaggaactcttactgtctgactcccccggggatggtgaaggggatataggagctgggtaggctccagtcaccctgtgggcttccttggtgccccttccccccagtagcccccttcccctagcagcctctgccctgtcccaagacccccctgaaagctcagtgagcctctgctccccaggagttcctgccccagcccccacccctgttcctgccacccctacaacctcaggccactgggagacgcaggaggaggacaaggacacagcagaggacagcagcactgctgacagatgggacgacgaagactggggcagcctggaggtgtgtggggctgagggagcctccccaggggaccccagctcaaatccacaggctgccattcagggagcttctgtggggcctggctggagttggcctgtcctcatcagcacagcatccctggcacgtaggcctcatggagtggccattgtaggccagagccagcagcaggccccattcaaccccagcggccccagggagcaggctaggcagatggtgcctggggcattccctgaacttcctcactcttacccacaccgtccccctttcccctcctccagtgcccacccagccatgggggtcagcaaggagaggccactcctgggtctagaaccagaccagttctgcttgggggatgggctcaggttgggctgagggaggactggggctgtcctcagaatggggcagagctgggggcccaatttccccatctggctgacagcagcagtttctggccctcaaggctgttggaaggggcatctagatctcattccccagccttaaagaggggtgagggcaggccagggtcagcgtccatttaatagatgggaaacagggcctgaggagcaaatgaggaggaaggcaaaagacagtggtggggcccgtggctgggatgatgctggggcgggctcacttgccctttagcatggggtgggagtcagtggtcccttcccacactgcagcaggaggccgagtctgtgctggcccagcaggacgactggagcaccgggggccaagtgagccgtgctagtcaggtgagctgggtctggtggggaggtgtgtgtatggggctctttcctccttgggcccagggctacttccccctcccgctcttctacaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatctgaaggtgagggcgacaggtgcggcttcgctgagcctccaggcggctcctcaccaccggccccgcccctgcccccacccccgaagcccggctcacccacgcagcgggcgcgggaggcgtcgagctggaagccgccgggacactcgcacacggcgccgcccggccgcggcacgcagcggccactcacgcagcgacactcgtctgaatcctcctctgaactgtcctcatctgcgtggcccggaacaatatggacttcaacactgagccccggccaaaggctaccaaccccgccaccgcccgacccggcagcactcacctcttgggggcttccccaacagcagggggcttgtgtcccagaaggaattgctctcgctctgcgatgtcgggcaatgggaccctgggaggagcagaactggtcagcgacgtccgggtccccgggccctggcccccatcctcgctcccggccaactcctccccgactgccttacccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctctgcggaagacacctggcatcaggggaggggcccaaggcaggaaccgcccgcctccgccccaccccacctgcgcgggggccacgtgacggacagggccccgggatcggccaaggccaaccctcgccctcaccggccgggctctcggggagctggcaatcgcggccggagggcccgggcacccagggcgggcgacactcgcagcggtaggagcccggcaggttgacgcagcggccagggcggcaggctgccgggtcctggcactcgtccacgtctacgaacagcgagggggtgggtgggggccgtcacagctcggcccgggccccgcccctcccgcgtaccccactccccggcccgggcctcacccatctcttccgggctcaggcactggcgctgcgcgggactgtactcggcagggggcgtgcaggcacagcggtagccgccgcgcgtgttctcacacactccgttccggcagttggactcgtccaggcactcgtccacgtctgcagggaggaaaagcgtgggtagcaggggcaggcccgggatgggcgcggtggcgcgtgtctccctgccgcttccccacggccgccggggggcggagctcacccacgcattccagcaggttcccgtcgtagtagaagccctgcttgcagtagcactcgtagccaggctgcgtgttcacgcacttgccctccttgcaaatctccgacccgaacaacatgcactcgtcgatgtctgcggggtgacaaacactggccgctccggtcccgcagctgcagcccggaggcgtgggctgggcgcaccaccggagcgaagccatccccgggcggggcctacaggaggggcggggcctacagggcggggcctgcgaggaaggtgcgggcggggcttacccggcgcgggcagctgacccagcgagtcccggcgggatccgggcgagcccaacccggggtgagagggcgcggggcgggcggagccgcagggcgcttaccacggtgggctgggatgccgtagttgacgatgttgttgtcctgggtgtagccctttccgtctgggcagaggctgtggaactcggctgcaggggcagggcggccgtggggagggaagaggcaggactgagcgcgcgcgtgggcttagggctgcagcccgccgcctatttcccaactgccagggggcgccatttcccacatttggcttccagatgaagaaactgaagatctgggaaggggcctgcccggctcctgacctgagctgtagactgggcaggggtagatttcgcagtggtcgccccagccggcccccagagagcagcagcactcctgctgggtcacgttggtggccaatacgctgtcgcagaacactgtgtcatcgaagttcaggtagcactccttcttgtggtggggctgctccacctctgaggggcagacggcagctcagggttgtgcacagaccccccttggccctgtccaccctgcccacccaccacaggtctttccccccacattccctggctccccttagcctcctcctgagagttggctctgttctcaacgtggtgttctggacccttcatcgtctggccccaccagactcccccagccaaaagagatttcttccggttccccaaatttaggagggtggggccaggacacatctctgaatcccagctgcagctcaggggagttgtccagtccgagggaggagctgggaggacactcaccctcacaaccgtgctggtcctgggtgggagtgaagccctcatcgcagacacacacataggagccctgaaggttcttgcaggccccatggggaaggcacaggctcgggtcctggctgcactcatctatgtctgcggggcaagagtagcgcagctggaaacccagcccctctttccctggggctgcacctcaagggcctcacacaagttcagaacctgaatttccactttggtttcaaagtatgtacagcaggaagtctgctgtgtctgtgcatgtgtctgaatgtgcatgtggacattagctgctgtccttcataacaccttcagtggctcccactaaccttacaaaacctaaaagtatcagaagcccaaatggaaaggcctcaaatgcaattgagcttccgatacctttaggtctcatcacgccttactctagaccaccctccactccccaactctgtgctcagggcaccctcccctcctctgtaaacacaactagctccttccagatctctatgctttgcaattactgctctttggtcctggaatgacttctcgtgccttgcctttcccatgcctagggaactcctacttacgtttcagtccagttcaacattcacctccccattgcaattaatcattagtctatacctttcttggcacccaggaccctgaactgtcagaatcagtttacatgttggcctcccctagctgggagccctgggtgattgttgattacctagtacaaagcacagaacctggaaaatagtaggtgctcaataaactttttttttttttttttttttttttgagatggaatctcactctctgcccaggctggagtacagtggcgtgatctcggctcactgcaacctccgcttcccatcttcaaacgattcttctgcctcagcctcccgagtagctgggactacaggcgtgcgccatcacgcccggctaatttttgtatttttagtagagatggggtttcaccatattggccaggctggtcttgaactcctaacctcatgatccgcccgcctcagcctcccaaagtgctgggattacaggcatgagccaccgcccccagcctgagccactgcactcagcctaaacttttgttggatgaatgcatgtgtatgggtgagttgatggggaagaccaatacattaatatctgtaaagagcttaacagagtgcctggcacatagtaagcaccacgatagcactaactgtcatgtttactgtgatcattgttattctaggtgaaagactggaaggctgagcagatggatgggtgggtgagtggaaggatgaatggaaggatggatggatagaaggatggatggatggatggatggatggatggatggatggatggatagatggatggatggatggatgaaggatggttggatgggtggatggatggatggagaaaggccacagtgtgtctagggaattactgctccctgccacatccctcaggaaccctcagccagtcccccataccttggcatttcctgccacccaccagccgatgcccctgggggcaaagacatctgtaggagccattggtattgatgcagtcacccccaatgcaggctgcagggaagtcacactcatcaatgtctgtaggggatggaaggggtggagaatctcaggggctgatcaccaaccccagcctgaggcagccaaagctttctcccagagccctgggtcagtcccacgcccctatgccccaactgagatctggattaggactggaccctggggggtgggggtcctggggtagggagggacaggtcagcaccccagctctaagatccctcaccctcgcagtggctccggtccctggacagatggtagccagagaggcactgacactggaaagatcctggcgtgttgctgcagatgccattgtcacacacgtccccagcctcacactcgtccacatctgcagggcatagggggtgtcagaggaccaggctgggtggtcttgggtttctactactgttttctcacttctgcgcatggcctggagcaccagagctgaggccagcagcactcagaagcacaggcctcaccctgcttctgggtggcacacagtgccctgacgaccaggtcaggtgctgccagggtccctaggccaggtctgatgctaaagagcctccccagcctcccccgccctctctccctgccccagccgctttcactgctgctcccacccttccctcacctgccatggctccctttttcctctggggataaactccctatccttgttcttcccactttcttctgctcatgcagtaaaggaacttgaccctcccccgggacacactttcctgaggcctctctgatggagccagttgttgcccacatcccagacccctccaagcctgagctcggcctctgaggtgccgccggcctcctgcagcctcagtcctcctgtggctgtcagcacccaccttcctcattcctcctgctctgtttttctctccatcctgggagtttcgaacatccgcgtggacaaccaggtcagcctctgacctcacattcctggatctctcggcttccgtgaccttcccctcactctcagggtcccaaggggattttcatcactcagatctgctccaccctggggccctcagaggctgccttctttccactgttctcaagtcctcacctccaccttctctctcacagggcttggtggcctccctctcagtcctccgagcttgcctgacacccccagactctgatagttcccagctggagcccagggcttatcatccctaggactcccgtccctgatccataaacacctctccttcctcctcactgtctggcaatgcccagtctctggtcagagctgtggcctgtggatcctgggtgcggagtgggactggagcagccaccaagctgagcatgctggaacatacccacaggcttcagcctcagtccaacagagcctcgtgtggctggcacctccctctctgactcctctaaagctttgacttccataaagcccctaggcagccccatgccctgggatacttccaaaccgccactgttctcctgagtcccctactcaacccaggcccttcactgtgtattgagagaattaaaggtaatcccccttaacccactgaacatcgttatctacatccattcccctcctgctcctgttacagcaagagatgtcccttccgctggctctcctccctcctctcctgaccctgctgccctcgtctcctggtccactctcctggcatcacctcctcagcctataccaaagccccactttggaagagcaagagtccccaggtcttgttcttcttcactttctgcccacatatctctggcctctgtccctatcatatcccaaaagctaccctgccaaggctaccagggaccttcttgccaaggaaggcatcactaggatttccatgtaggattagggggcagacccctaagtcttgtcctaagacttattgtctcaccagttattattttacaagaacctctctactgcacttggctcatcctcctccttccctggaaatatgtcctccccagcttcccagatggtgcccctcaggcgcccctgccatccctcccccaccatctcctccaacgccttccgcagcctgcccctgaactgtcagtgtccacaaggctctgctagatgctctgcttacccaacccaccttgggttggctaagcaggcccacccaagactccatagctcccccggtccatggtccatcattccaggtgggtatgctggcatctcctgctgagaggctcacaggcacaatccattcaatttgtccaatgtggagctcagcattttccctcccaaacatgcccacgcatgaggacccattcccagtgagcagcactaccccctcactcacccaaactggaaacggggaggggtcgttatcaccctcgctttcacttgacatccagttaaaaaacccaggaggtctaatatttctccaatatcatcgtctcatggccatcctgagcccaccactcatcctgtccaccactgtctccgccctaagtctctgcaacagacctccctccacaatcagcagcagggaacgttctaaaacaaatggcaaatcttgtcactcttacacttaaaatgctgcaggtgccctctaacaccttctgggtgaagcacaacctcccaggcaggacttagggggccctccaagggatggggacctgtccctccccggccagcctcagcccccatagcctgatcattccttacagttccccaacaccccaccctctgtctcacctctgatctgccagtgccaacccctgtgcctgccatgctgttcctctcctcctttcttgcccaattcctagtgattctttaagatgacccaggcctccttcctcccatcccgctgtgtctccaggaagcagcccagctccatccaggcccagcactgcatgctacagtctgtctttccttctccagttttcaatgagtcccagcccccagccccgcctcttggcgtataataaacaggagtgcaggggggagtactatcgtctgccctcattctttgatatcttttttccttcaaatttaagtaacatgctttgcaaacgcagcttcgagctctaccccgagacccttcctacgtggaaattctagtggtgccttccttggcaaagttcgttgagaaaatgagtgagcagagtcacctggggatgaatgagccaccttccacccactgtttacagacagcgtgacccgctccccggcttcagcgcgtagggggcggcggaggcccggggcgggggtgctggcgctcacccaagcaactgcggccgtcgggcgcgggcgcgtagccctgggcacaggtgcagcggaaggagcccgggaggttctcgcaccagccaggcgagcaggggctgccctcggcgcactcgttcacgtctgcggcggaaagacctagcctcggactctgccccaccggaaggcggaccgcgcacctcgcgggggtgtgggtctcttccctggaacgcggggttgagagggcagcctctactcccggaaggccccgcccccagacgccaatcaccaccgctaccccgccccgcccccagcggagccagactgggggaggcacctgacggccccacccactcggctccgggccccgccctcaccgcgacaggccccgcccccctggctgcggtagccaggctgacaggcgatgcacttgaagctcccgggcttgttctcgcatttgccatccgggcaagagcttgggtcccggcactcgtcgatgtctgcacgggagggagaaggaagaggacccatctggggacaacgcgggtggcccggctcccagcgtccacagcagggacttcctcccacacagatcaacgaggctcccggaccccaacctctgagaggcccagagccgagcatacaggccgggtgcggtggcacacggctgtaatcccagcactttgggaggccgaggcgggtggatcacctgaggtcaggagttcgagaccagcctggccaacatggcgaaaccccgtctctactaaaaatacaaaaattaggcgtggtggcaggcgcccgtaatcccagctactcgggaggctgaggcaggagaatcgcttgaacccgggaggcggaggttgcagtgagccaagatctcaccaccgcactccagcctgggcgacagagtgagactccgtctcgggggaaaaaaaaaaaaatgcaggcaccccagccccaccccaggtggagagacagctaaggagctccttctttggtctgaatggggtcccctcaccttcgcacacaggaggccgggaggctttgagccggtagccggggtagcagttgcacttgtagtgaccgggaaagttgatgcagaagccgccgtcgccgcacaggtggggcttggcgcattcgttcaggtctgtgcgggaggaaggggccacgaagggggtgtaggaggcggcgggcaaggggagggattacacggcggtctggaggagagcccgtcccacccagggccgcctccgccctggcggcgctcacccacgcacgagcgccccccggcgcccacgtgcaggcggtagccgcggttgcagtggcaattgtaggagccgccggtgttcatgcagatgcccctccccgggccacagggctctgcctcgcactcgttcacatctgagaagaacgggtaggccaagaaaagtcaaaggaagcgtcgttatctggggtccccccccacccacctgcatgcccgccgcctgccctgcgctcacccacgcagtagcggtgctggggatgtgaccggtagccggggttgcagtggcaggagtagtcaggggggcccggcacgcactctccgtggccacagatgttctggttcagtcggcactcatcagtctctgcgggcatggccaggtcaagcggcagagcagggagcgctcaccttctgccatatccccagggcagacctcaacaccccagtcacaccatgacctcaggttcctgtacgcccatactccaactccaggatgtcctatttctctcttttagataaccccaatatcaagaccccagaaagctccaaactaggactccaggcccctgacagccgtatcaccccacacccaggcccggatacttccattcccggttcactccaagaccctgaccccactcacctcaaaccaaaccacatcccctcagggcccctcagtcgtcccagtactcccacccaagggactaaaactcctttctccccagtcgcctcaataccttaaactctatagcctcggtcacaccagtgtcctctagcccagtgactccataagcccttgccccagggacccgaccccctattccagaagggttgattaccccctcccaagactagcaggagctggtttcctgggaatcctaactagtgccaaagctgtgcacaggcagtcagatccaggaaccacccccctcactctctttgtcaccaagcccaggactccctgcctccagcctctcccctcctttggatcctcactgctcaccagtttcatttcccacaccccttccccctcactcctgccatgcagcctgggccataacagtgaactctgctctgccccaaactcacctggccagtgggctttgcaggctgttctctttgcctggagtacctctccttaggcttccttaacagcccctcctttgaggggccttgtccacattcccaaagcccccaagaacagccatctcccacctgagccctaaccctaggagctcatggaggatcagggtttcagctgggttggcagttcccttgtgcttttgaagcccacacaggcatgggcttgaacacggctcagctgtgtgacctggggcaggttactgaacctctttgaggctcagctttctcatctggaaaacgaggctaacaacgctcactttgcagagtatgagaaggttaaatggtatttagaacgtaaaactcttcagacagtacctggcacagagggactgctcagtctgagctagcaattatgatgctcaaaatcctgcagacactgcccatagcctctggcattaaactcaagcctccttgacaaggctcagtgcactggacttcccctggttcagagacactggcctgtgtgtgggttctccctcctccaccagtgtttcatgcttccatgcctttgcccaacttaacttcccttgtgatatccttttcccaacctgaatgcccctcccttcctcatgtctctggcatttctaaccatctttctttttttttgagatggagtctcactctgtccccaggccggagtgcagtggcacgatcttggctcactgcaacctctatctcccaggttcaagtgattctcctgagtagctgggactacaggcatgcaccaccacgcccagctaatcttttttttttttttttttttttttggatttttagtagagactgggtttcactatgttggccaggatggtctcaatctcttgacctcgtgatccacccacctcagcctcccaaagtgctgagattacagccgtgagccactgcaccctgccacagtttcccagttttcacaggaaaactccccaggccgggaaaaaaaaaaaaaaaaaaaagagcatggtggcgcacacctgtaatcctggcactttgggaggccaaggctggaagatcacttgagcccaggaggtcaaggctgtagtgagccatgatcctgccactgactccagcctaggtcacaaggtgagaccctgtctcaaaaaacaaactaaacaaataaaaagaaagaaaggaacccaaatatttcttgagcacctactatgtgccaggcactgttgaggtgctagggatattgcatgaacaaaaacagacaaaaatttcctgtcctcgcagagcagacaggcaacaagccgatcaataagcagaatctcctatgtcttataaatgctatgaaaaactaaatcagggccaggcgtggtggctcacacctgtaatcccagcactttgggaggccaagtcgggcggatcacaaggtcaggagatcaagaccatcctgattaacatggtgaaaccccatgtctactaaaaatacacaaaaaaattagccgggtgtggtggtgggcgcctgtagtcccagctactcaggaggctgaggcaggagaatggcgtgaacccgggaggtggagcttgcagtgagccgagatcgcgccactgcactccagcctgggcgacagagcgagactccgtctcaatctcaaaaaataaaaaataaaaataaaaataaaaaaatcagagtagaaggaaggagttctgagggttgtgataataagtagggtggcaatgatagaaggctttctgaacagattttgaaagatggttatgggctgggaacagtggttcatgcctgtaatcccagcactttggaaggccgacacgggcgcatcacgaggtcaagagatcgagaccaccctggccaacatggtgaaaccccgtctctactaaaaaaaaaaaaattagctggacgtggtggcgcatgcctgtaatcccagctactcgggaggctgaggcaggagaatcgcttgaacccgggaggcggaggctgcggtgagccgagattgcgccactgcactcccgcctggcgacagagcaagactccgtctcaaaaaaaacaaaaaacaaaaaacaaaaaaaaactgggaaacctgctagacaaattctaaaagacctgtaacactaataagtatttgttgaatgaatgaaatccctcagaatgggctaaccaccatgctacctggatcgtttagggcagtgggatctctggtgctcaccaggcttccccagtgcccagccctggatacacgctagcctattagcgctagggaatgcctgggggcgggagggaggagagaaaactaaagtgggggcgtggcctaggcaggggtggctttgctgggcgggccttacctgtgacctgagtgggagcgatctctacggcgctgcgggaaggaggcaagtccggcaggaaccagcgcatggtcgggggcgagggacgggagatcagctctgcgggcggcagtgcactctggtcagagacgatattgactgaagcctccctttccacttcagtcttggcccggcgccccaccccagcttgactgtccccgagtacttaaactgtgaactccccgcccacccagtgatttagcccttgaggactcatccctacagtgcccagctcaccggggtagggccgggcaggagtcgtggtggcagttgggtggctctgctgcactgacctctcctcactcaccggctgcgggtgacagcagcatgagccctcctgtccctcgcctgcccacccctcccatctgggttctcatactcactgagtccgtggtcacccctaaaagggaagaagatggggccatgaagtgttggggcgggagaagggagtcagatctgggatcagcagctgagtatttgcagttagggtctctgggagttcaacaatcatgtctccaggtcaagggtcaggggttagattctggggttagggtgtgtttgcatagtagtcacatgatcaggttgaatggccttgggttacaggtcaggctgtagaaggcttaggaggttatagctcagggtcaaatatctgggtcaggggtcagagggtcaggtgggaggtcagtggatgggtcagggataaggaattgggggttagactgtgaggtcagatctgtggatcacgggtcaaggggtcaggcctaggggcttggcatgggtcagggatcagaaggggtcaggctagacctctctcttcctctgtgtcctcaggtggtggagcctggctagggctctccggaagctgctggggcttgggtggcccgtcagggtgcaggaaaagggaaaagtcactctcgccctgaatggtgagcgtctggtgggaggtgagaatgtggtatcccttcccagctgggcagatctccttgaacgcagctgcagtcaagacagcagacacaaaagtgagcatttcctggacaggtgcatggacctatgaacccctatccccgggtaaccctgactcaccggtgccatctgttgggcagcgctgacaccgcgcgccccaggccttgccgacactgcagcagcagagctggcgggtcaggcgggtggtcagtgggtgctggcactggtgctcagggctcaccaggcggaaacacaggctcttctcctccggtttgtctgctgcaggggccagtggggggcatgggcatctgagcctgcacattgcccacgtccctctgcccagctgctgcagaccttgcctctccggcccagacaacccttgatcccccatgtggtctctgaccccatatgaccctgaactcatgtgacccctgaaacttatgtgaccactgaccccattgactcccgattctagctatcctggacttcaccactcctactcatcaagcctatgttctgcatgactctgactctatgtaatccctgaccccatgtgactgctaatggcagatctcatgtgaccccggaccctgctgatccctgatcctattggctctgggccttgttcctcctgcagtcaacccttaaccccactctgatctcttgcgatctctgatccttgctcccacccatgccttgtgacctcccaggaacctgagccccaggtctcaccaatgcactgtgtacgggaggggcctaaactatggccaggtgggcagacacagcgataggagccagggttgttgaggcagtcaccatggcgacacacgcccggcattgcgcactcgttgatgtctgtggtaagtggaagtttggcccctctggtctggggccatggggtgacagcaggctgctccaagaacctcagggtcttgccccagccccacctcctctctcgcccaccttgggaccctccccacccccagtgatggctggcctgcccctccagcccacagaatctcctagctggccataccctggcagtgggtgctgttaagcctcttgtagccctggggacagtcagcgcccacttccccacgtacaggccctggcttctgcactcctgtgtctgcagagagaggatagcttggcaggggagggtgaggagggaactggggaggggcacagcagatgtagagaggaatctggtgacctggggactcccactgcagggatgggtggggtgggtggggaggggccaccagatagggaacgccccctgagcccaagcactcacactgcagctggggacacttgtggcacttgctctggccccaggcagtgccgatgctaccgcagcagtcttcctgcttggtgaggccggggagggggttgctgccacactaggggaaggagggggaggtggggtcacagagcaccccgccccggtgccgcctgttagggttgggccttttcctcttcccccgcccctcagttttctgctatccgagtgagttggggcagagcaaccctgagagaaggaaaggcagatcccgactgtggattcactcaccggctgcttgggcagagtgtcctgaaagcagcggcccaggggcttctgggtgggcggccgggggtgcgagggcttggggtgcggcagcaggtgctgggagggggctgcgctctcggcgttcgagctctcaatgcggtgcacctggactgaggcctcgggcgggtgatggacgcgcacattcaccacggggggcggggcctgcactgggggcgggcgcggtggcctcagggctgcccgcaccgcgccgcgggtcaccgcgctgagctcctccagggctgaacctgccctgccctggccaccctagtgcccacccactggcgaccttcccgggtttgccagttgcctggtaccttctgctgagatctgtcccgggcctaggggcaccaggaaggctgcgtgctgggcaggaggcccctccccgggcccaggagggtcagcgatcacctggacggcgtagatggcgtgcttgctggccacagagtcgccctccggagccaggggcggcagcgcccctgtggacagggcccctgtcctgctcaggccggggcctgagccgccggtacccccaccggctcctcctgcgggcacctggcagaagcgcccagtgaagtccgggggacacaggcactggtttcgcgaggagcactggccgccattcatgcaggggagagggcacaccactggggagaagagtggggtcaggccctcacccacatcctgtctctttcccctcctccctacttccttgccacccactggctctgtcctcttgggaagccaggttttgagatacatcctacatagggaaactgccctctctaggttccccaacatccttacacctatgttgggttctggagtctcaagtccaggatttaaatcctcgctaagccatgtgccagctgtgcgaccctgagcaactcacgtcccctccctgtgccccagcgtcctcatctgtagagatgtgtgggttagatgaggtaagggctgtacaaatgcttaccccagggcctggtacacaaagggtgcttaataagtggtagcaaataattatggtgatctggctttccccttgagccttccaaaggtattggctccgtccctggcgcctcctcctcttctcccataaacccttccctccttcaggcctcagtcctctctgcctgctctccaccctctccctcttcaccatcctggggcgcccacctcaccactgccaaagatgtccacatctcaagacacagacacagcccccagcctttccagggctctctcaggcacctctgcccaggacatactgtcagaagtcagcatcctgcctccccacctcctcttcacctggccaccaggcatccacagctgagccccgacggctccgtccctcctgctctcccctgcccagttacagcctctaatgtcccatgaacctgcctcccctcctccctagggccactgctcctgccctggcccaggcctggccacccagacccctccttggcttccagcctctcctgctggtccacaatctcagtgtcccagagaaacctgcctcaggcagaagctcactccatggaccagaaccttttcagcccatccccctctgctccttccctgtgtactgcacaccccaggacccatctccctcttgcaaatgtgcctgcctcctgcctcctggcctcatccatgcccttccctccacaacagggccccaggtcccccccctctctatatatgcagatctcatccttcctagctcagtgtctccaccaggagggaggctttcctcctatccggcccccctgagctccctctcctgccttaccacccactggccagctctgcctggcacctgcttggctatgttcttgtctgtctgcctccttatagagggtgctctggaaggcagggccaggctggcctcagctctgggtcccacagggggttcgggggaatgaatgaaagaatgactgagggagaggatgggacctctgtctgtttctgtcccatactcaccttcaacctgtgctactaccagccttggggctctgactcatcccaaagccccagcccttctcctgcccaccccatggctgccctcacttcccagggcaggagggcaggagggcgggggtgctgctctcctggatgccagaagggcctcacagggacagcccatatccatggccctcagggtcaggctaagcacatcccagcccagcccatcctgcctggcctcttggggccaggcctcacagagcagaggggtgtgtcctgggcggggggaggtaggattctctttttcctttctgccagtgagtcactcatagcggtgagagtgacctcccaatgacacccgcccactgtggcctgggcaccgagcctgggggatgtgggcagcacagatggagacagcagcctgggcaggatggccagggagcctgggagatggacacacgtacactcacacccacagtcctcttgtcacacacacacagagactcatcctgacaccaacacaggttcacataaacattcccatacatttggccgggcgcagtggctcacacctgtaatcccagcactttgggaggccgaggcaggtagatcactcgagatcaggagtttgagaccaggctgaccaacatggtgaaactccatctctactaaatacaaaaaaattggccaggcgtggtggcgcatgcctgtaatcccagctacttgggaggctgaggcaggagaatcacttgaacccagaagggggaggttgcagtgagctgagattgcgccattgcactccagcctgggtaacaagagcaaaactccatctcaaaaacacaaaaacaaaaacattcccacatactctctaacagcgactagagacacacacccaagacaacacaaagacgggtacttcacagtgtgccacgccatgcccatggcatgaccccagacacaggggcaatatgcgcacagacacacgcacgcacaccccatctcatgacaaatttgagccacatgagtggggttccttagctctgtgagtgggagagtgaatataggaatgtgtaagaggggctgttttgctggtgccatcctgggcctggcctaattaccctgtccaggagggtaattactgctgggacacctccccgagcctggcccacggggcctagcaggaggatgactgagccccaggcctggccctttaaagagagatgctggggagggggtggactccaagctgaactggggagggtgtaggggcttgggggaggatgaggggggccctgagggcctctgaggcaggatgttaggagcttatggggaggcattggaaaaggagaggctgagaaccccgaactagtccctaccttcaggcctgcaccctacttttaggcctcaacaccctccctactcagaccttgccagtagccggctcccatccccagccctgaccttagctcctcctcccagggaatgcaggtgtctactctggcaggccctactttagacattttgtaaagacttttcttgtttcttccagcaagtctgcttcttgcgggaatatttagcccttctctgaggcttcctgtccccggctcacattcctcaaaaaccctgtgtgctcctgctcagaactcagcaccttctgggaagccagtgtcatccaggacctctgcatttccccaccccttaggccccaaccctaacgcaaagcttcaaagtccaggcctccatgcagccctccaactctggcccccagagttccagcctcccaagttccctgaggcccctggtcccccaggccctcggatctctgccctttataccctcagcccccagtctctaaggccaagaccccactagctctcccaccgggcctggtgcctgtccttcccctgcccccagccgtgcccccggccctcacccacgcggaagccggagcccgtgagcgtgtctgtgctgtggccgttctctccgatgagcgtcatgttggagccctgctgacaactgtcccgacactggcccttgagacaggtccgcttgcagatcaccggcgcaaagaccaccttgaagcgctcgcgggccagcgccccgcccccgcctgcgccccgctcgccggccggccccccctcgaccctgccgcccaggcccagcagcagcagcagcagcagcagcagcagcgccagcagccccgccgcccccgccccgcgcatctcaggggccaggccgccagcagcccctcggggcccgggcatccggggccgcaggacccgggggagggggggcgcgcccgggcggggcgaggggcccgcgcccgaagggagtagagggccgggagccccgggagagggtagggggcagcgagggagggcagcgggggaagcgggcgggaggggaccgcgggggcccggcgggaggcgcggagatgcagactggacagcggggagcgcagaaacttcccagccccaggacgaagcccagaccaggccccgaactcaggcaggagcgaggaggccggagcaagttgaggcggagaggaggagcgagggagaggaaggccgggcggccggcccgctccgcgcctccccctggccgggctcctctcccgcggccgcggggaggcagggagcgcgcggggagggctcagggagaagtgagcagttgttttccctggctggagcgcggcgcggcggcggcgaggggggctgggacgctggccccgggccagggacacagtttttttttttttgttgtttaaagcgtcgcctctgccgcctggagaagcgagggtgtgcaggctggcggaggctggggggtggcgcggggacagtccccaccccagatgcccgcccccgccggaacccgcggccgcgctgggccctttccagagggccctcacctgggaccgtctggccggccgcggattcctccgggcggggcggggcggggaggcctgcgtagagcgagataccgaggctgagggagagaggtggccctgccgggtcacactgacgatggaggccgggtggagccggagcccaggccttccagctctttcccagcctcccttgcaaacgtgggggtctcagggccccaaagtaacttctcgttagtgctggtccaatcccctctgaggaaagggctaaagggtggggacagcctttggccagggctcacggaggtcccaggaggaagtctgtggggtccagaagaggagcagaaagaacaaagctagaacccagcttccctgccagccccctcggaatggcttcctggtgcccaccctgccacctcccccctttcctttcgtctggccgtgctggcggggctggctctgggcctcagacactctggaatcgccaaggtctgagctcagggcctggcccccttcccaggctaacagccgggaggacgggggcgctgtccgagggcccaggggctggagaggggcacagcagagccccagggcaggggctggcagcggctgggggtgggggtcttcaggttggccatggctggagaggagcatagttccagaccaggcttgtccgctggtctggaaggaaaggctgcaacgtgcgggggcccaggccttactgtggggcctgccaggagaccccagggttccgtctctgactcacagaactcagcaggaggtggggacggctagggcacatccaggaaaagcgctgccaagtcagggcggcaccagaccctctcccggacagcacccggggcagcagtctaattggggagaggaggttcagggactcactttcaggcacacctgtccaaggaactctgtttttactttgagcgtaagttgatgtgggtagctttagggggacgcttagtaagtcccccttactaagcggtgcagggctgggagggacaatcacatgtccccagggatccctgctgccggaatccaggatggggtgtgaggggcaagcccctgcttcttggggccctggtccacacggaggcagggaataatgctaggtgccgaccacctgccaggcacagggctgagcattgtatactcattttttcctaacactcatctgaacctgtcctgactctgcctagagctggctgtggctcaccatggagcacagcacagtcaaacagtccagggttggattcttactgtctctaagccccagtttccttgcttgtgagatgggtatctattcactcaacatctatgttcaactactggtaataaaaaacaaaaaattaaaaaataaatgtaaaaaattcactcaacaaactgagactccaccacatcctaagctcttggccacaaatagaaccagtcctgccttcctggagctgctgtactaggagagctggatatgtgccagatcaattcacacagaactgtggctacaacagaggctggtaccgtgacagagaagggcagggaagcaggacaggagagggctgggacctgggagacaaagagagtcttccatcggaagctggaagatgagtaggagtgagtcacacctgtgggcatctgacctcaggggaggctgcagggggaggctatccagagaactgagggaaggccagtggaacaacagggtgtggtggagagggagagccgaaggtgtagtggtggtgggaggggccggccatggtgaggaatttgcttttattctcattgcagtgggactgtgtcagggcaagagcgggcactctgccttcatcccaggagagagatctcacttggccctgggagagatgtatttgggaggggagatgtaaagactgggtgaagtaggggtgctggagaggtaggtggcatgaatggcccccagattcctggcctgatctctggatgggcgaagaagaggggaggcagaggagctggaaacatggggcagggtccacagctctgttctggtcctgctgagtttgagatgcttgtgagtcatccaagtggaggtgcccgaacccgggagtctgcagctcagacaggatgtctggcctggagacagaggcttggggttatacagggggcatctacgacagcgggaaagggtgggcttactatggagagaagagagcccagggtgcccagggagatcactgttcccgggtcagggagaggaggcggagtcaggcagggagaggaggcggagtcaggcgaaagaccagaaagagcagctggagggagcagagaggaaaaccaggagtgtggtggggaagagccaggaggacggtgtggccctcggtgtctaaagctgctgccagtatgatggggggataacagcccttcttcaggggctgatgaggggactcagtgagaaggatcaatgaaagtgtccagcccagtaatgatgcccaactcaaatgatatccaaccaaattccttcagctctcagggcctccgcaggaaatagctgaaaccactggggctagcaacagagggacatcactccagtgcacattgctccactggcataaccagggagggtgcctgagaggtgtggcctgaagcagagcagcagcccctggccctctgcagtctgcagggagggcgctgggggaacaattatcaccctaatctcttcctagccacgggtctccagctgggccaaccgtgggctgaacccagaagaaagcctgtgggctgaggggcctgggggtacagcaggtggagcttagctttccagctcagcagggaggtcaggaatgcagaaggggtctgcagggcaagctgacaaagcccaacacacatggtctctttggcctgaacatcttttctaacctcatcactacatgtggcacctcatttgcctagaatctgccagcacactttttttttttttttttttttttgagacagggtctcactctgtgccagggctggagtgcagtgacatgatcttggctcactgcagcctcaacatcccttaagcagcctcgagggatcctcccacctaaaccccccctcccaccgccgcctcagtaggtggaaccataggtgcacaaccatgcttcgctaactttaggatttttggggtttttttggattcttttggagacaagctcttgctctgctggagtgcagtggtacgatctcggctccactctgcaaccttcatctcccgggttcaagcgattctcatacctcagcatccccaatcagctgggactacacgctcatgccaccacatctggctaaattcttttgtatttttagtgaagatggggtttcactatgttggccagactggactcaaactcctgacctcaagtgagccacctgccttggcctcccaaagtgctgggattacaggcgtgagctaccacgcccggctgccggcacacttttattcctccatgatgtacattctcctgtaagtccaaggagaccatgatcttcctgattacttcagatcattcctggcaataacaggtcttcccactgctactctgcatcatctggtccctcctcctcctggtgccggagtcacctttcaaaacctaattccaccatgactctcctccttaaaatacctccagtgatttcccttgctcacccgagcctgccaggtccactgttcctcagagtggctgagctcattcctctgtctggggatgctcttctgccaacttcatggtcctcatgtcagggttcctgcagatgcttttctctaaaacagccatcccttggccaggcgtggtggctcacgcctgtaatcccagcactttgggaggcctagatgggcagatcagttgaggtcaggagtttgagaccagcctggcgaacatggtgaaaacctatctctattaaaaatacaaaaattagctgggcttggtggcgggcgcctgtaatcccagctacttgggaggctgaggcaggagaatcacttgaacccgggaagcggaggctgcagtgagctgagatcacagcactgcactcctgcctcagtgatagagcaagactgtgtctcaaacataaataaaataaaaattaaaaaatttaaaaaaatgaaatagccatccctagccctctgggtcatatcacctgtgtttttccctggtattccacaaaatctgaagcattctttgtggatttgttgacttgcttattgtccagcttaccaccctctcagggagggacaaccttgtctccagatcccagaacaaggcttggcacagatagggtgccgaagtttgttgattgactgcacagagaggccacaagagtgcctgccatctaccatgcactttacactgtggggtcacgtcatcctcccagtgaccctgcaaagggaaaaccaagactctgaaagatgaaatgactagactcagctgggcgcggtggctcatgcatgtaattgcagcactttgggaggccgaggcaggcgaatcacgaggtcagaagatagagactatcctggctaatacggtgaaaccccatctctactaaaaaaaaaaaaaaaaaaaaaaaaaaaaaattagccgggcatgttggcgggcgcctgtagtcccagctactcgggaggctgaggcaggagaatggcatgaacccgggaggcggagcttgcagtgagccgagatagcgccactgcactccagcctcggtgacagacagagactctgtctcaaaaaacaaaaacaaacaaacaaaccaactggactcaggtcacctggtgattgaacccaagcctgcctgatccagaacctatatatacaatgatcctggggagaggaatgagaggtgtcctgaaggcatcaggagccctgacatttgctcacaaatgtcctgaagataggtgggtaggaccctgagggcaatgaggggctttgctggaatgggacaaggaggaggaataggacccaggcccagggaatgttcgggctagtcaaatgttcttgaggttcttgggttcttgaagcccagagaagatatgggacttgacgaaggttacacagccagccatcagcagagccagaacctgaactcagggctcctgatgccatgttaagggattggctggacagggtgacagcagctgcatgatgaaagttctgtctcaggaggccgcattgcagtggttgttttctagcattagatcatactggctgtgtcatgcaccagctaagtgaattgggaaaattcttcaacttctctgtgcctcagtcctcaaccccctacccttccttttttttagagacagtctctgtatattgctccgtcaatatagagtcaaactcctggcctcaagtgatccttcccgctcagcctcctgagtagctgtgattacaggcacacaaccctgcacctggctttcctcatttttaaacagggaatgaggccagtctcagtgactcatgcctgtaatctcagcactttgggagaccgaggtgagcagattgcttgaggccaggagttcgagaccggcctggccaacatggcgaaaccctgtctctgctaaaaatacaaaacattagctgggtgtggtggcgcacacctgtattccagctgcttgggaggctgaggcacaagaatcgcttgaacccaggaggcagaggctgcagtgagccgagatggcgccactgcactccagcctgggtgacagagtgggactctgtctcaaaaaaaaaaaaaaaaaaaaaaggccgggcacggtggctcacgcctgtaatccgagcactttgggaggccgaggtggatggatcacaaggtcaggagattgagaccatcctggccaacatggtgaaaccccatttctactaaaaatgcaaaaattagccagacgtggtggtgcgcgtcttagtcctcaggaggctgaggcaggagaattgcttgaacccaggaagcagaggttgcagtgagccgagattgcgccactgcactccagcctggcaacagagcaagaccccgttcccccccaccaaaaaaaaaaaaaaaaattaacagggaagtccgggtgtggtagctcacacctgtaatcccagcactttgggaggccgaggtgggtggatcacttgaggtcaggagttcgagactagcctggccaacatggtgaaactccatctgccaaaaatacaaaaattggctggatgtggtggtacacgcctgtaatcccagctactcaggaggtagaggttgcagtgaaccgagatcgtgccactgcactccagcctgggcgacagaatgagactctgtctcaaaaataaaaataaaaataaaaataagcagggaatcagtgggctgatatttatgaagcccttagcagatgcctgccaaatagtaagcactcaggatatgtgagaccttttcatcattgtctggatctgcaagccaagatgggcagggtggtgagagacgggctgctggtggagagccaccgtgccacgagggctgactgtgtgtcagaggctgtgccgcctccatgtgttgtccctctgagttctgaatgtctttgggaagcttctgggctctgaagaaagaaatggctcttggcgagggggtgggtgggtagaagggaagggggtcacactcatcagttttattttttttttgagacagagtctcactctgttgccaggctggagtgcagtggcacaatctcagctcactgcagcctccacttcctgggttcaatcgattcttgtgtcacggcttcctgagtagctgggattacaggcagccaccaccaccactcccaactgatttttgtatttttagtagagatgaggtttcaccatgttggtcaggctgatctcgaactcctggcctcaggtgatctgcccgcctcggcctcccaaagtgtgggattacaggcatgaaccactgcgcccggccttgctcatcagctttaaagatgagggatggaagtgatgaaggcctggaggggacaaggttgccctaaagcatttctctccaaagacactttactgaaagtggctattaaacccctctaatgtgccacttactgtgggtagtaaaacgatggacactgagagttgggattggaaatgagatgaaactaccttcacgcttgataaatcagggggcccttctgccctgccactcttccccgccttttgagcacgggagaaatctactggtaagagctcaggctcaagaggtacactggctgccagccgggagccccagccctgccactcccaactgggtgactgtggatacatctctcactactccaggcctcagcctcctcatttgcaaattgggaatgatgataagacctagctgccagtgttgtcctaaggaataagcgaaatacttcataaagagctcttaacacagtgcctggcccaaagaaaacacacacaccaagttgagtgtgattatttttattgttgtatcatccagccacttcctgtttcacagaaatgtcaaggtgattcacattgcagtgaaaaccaaaaaaaaaaaaaaaaaaaaaagaatagctgaccccttttcagtgcctgtgtgaaaatacaaatgataagttacgtttttcagaggccaggcaacatggcataggccacttgttgccatgtgaaccatccccaccaaatcagccagcccagggggagctgtaattgagctgtgcatgactgagctgctgtggggtgctctatcacccagaaaagagcctaactacagccatgtcatcagtgccacaaggagggaccaatttggactggctcacatgaaactgtgattcccttccctccccctccccctcctcctttccctcctttctcttccctgactccatgctctgttgcccaggctggagtgcagtggcaggatctccactcactgcaacctccgcctcccagttcaagcaattcccgtctcagcctcatgagtagctggaactacaggctcgcaccaccatgcccagctagtttttgtatttttagtagagatggggtttcactatgttggccaggctggtctcgaactcctgacctcaagtgatctgccagtcttgacctcccaaagtgctgggattaaagttgtgagccaccatgcctggctgaaggtgtgatatattgtcggcaagggaagggtgtgaaagagcccaagcccattgctccacagacactggcctgtccactgtgactgctgcgaataggttttaccaccaacacctgtgagcaccttctatgtcaaggactgtgaagcatctgagatcttacccacttgcaagctaccaaggtagcccgtcaggttcaagaatgctggcagaatacaggagagtcctgggtcagagacaaaggacttgatcgctgtgcagcaaacagcatgagcaccagcatatttccgttagttccttttgaccctaagtcccatgggggtgatgctgatgggctcaggcaagtgtgggcacacagagcgaattacattgtgggagaggaccctaagcttaggaaactcaaagccagtaagcatggctgtcctttgctctggagggagacactatctccatcttccatagctgttccctagataaacatctttgaagctggcgcggtggctcaggcctgtaatcctaccactttgggaggctgaggtgggcagatcacctgaagtcgggagcttgagactagtctggccaacatggtgaaacaccgtctctactagaaataaaaatttaaaaaattggctgggcgcggtggctcatgcctataatcccagcactttgggaggccgagacgggcagatcacgaggtcaggagatcgagaccatcgtggctaacacagtgaaatcctgtctctactaaaaatgcaaaaaaaattaatcgggcgtggtggcaggtgcctgtagtcccagctacttgggaggctgaggcaggagaatggcgtgaatccaggaggcagagcttgcagtgagccgagatcgcaccattgcactccagcctgggcaacagagcaagatgccgtctcaaaaaaaaaaaaaaaattagccagctgtggtggcgcatgcctgtaatcccactccagtgggtgaggcacaagaattgcttgaacctggaaggtggaggtggcagtgagccgagaattgcgccacttcactccaggttgggtgacagagactccatctcaaaaaacaaacaagcaacaaataggcataagtggccccatttttattttgagtcagggtctcgctctgtcacccaggttgcaatgcagaagcctgatcatggcccactgcagcctggatctcctgggctgggagcaatcctcccactcagcctcctgagtagctgggactacaagtgcatgctactgcaccagctaatttaaaaaatacatatatttcttagagatgggttcttactatgctgtccaggctggtctcaagcaatcctcctgcatgtcctcccagagtgctgagattataggtgtgagccacagcacctggtctactggccctgttttacagatgagaaattgaagtccacagcgatgaagtaaactactccaggtgatacagtaaatagatccaggatcaaacccaggcctgcctcattccagttctgcgtcttgtccaccctacagtggaacttaagatggtgagaggccctgagaggagaaaagggacaagagtcctcttgagcagtgggagaagagggatgcaggaaggatgggagatgtgtgtgcatctctctatgtgttgtctggatttggggggtcaaggaccagatttataggaccttggagaccataacaaggactttggatttttgtctaagtgtgatgggagatgccaaatggctttttttttttttagatagagtctcactctgttgcccaggctggagtgcagtggtgtgatctcggctcactgcaacttctgcctcccggttcaagcaattctcctggttcagcctcccgagtagctgggattacgggcgcccgccaccacacctggctaatttttgtatttttagtagagaaggggtttcactatgttggccaggctggtcttgaactcctgatctcaagacatctgcccgcctcggcctcccaatgtgctggggttacaggcgtgagccacagtatcgggcagccagatggtttttagtacaagaacgacactgtattttaaaataattattcagtttcctgcttatgtggggatatgtaaggttgtcatgaggagtaaattggagagattaagtgagaggactcatgtaaggctctttgtaggtgcgaggcagaatagacagttgagtggatattggccatgatggtgacatagtcggcgcactgaggaattcagggtagggctgggagctggagacggtaataacctgggggtctgtgcatacaggctggagtccaagagatggttcagagacagttcctctagtcagcctcaggctaggtgctgtggctcttcgctgtaatcccagcactttgggaggctgaggtgtgaggatcacttgagtccaggagttggagaccagcctgggcaacatgacgaaaccccatctctacaaaaaatacaaaccaaaccaaacaaacacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtccatgttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcggggtgaggcgagactcgggcgagtgaccggggatgggtccgcgggccaggccactcagcccttccccggccctcccctctggaccccattgccggcgtctcattccggccccgtgtgctttttggtccgtagacgatcctcctccaagacaaacagcggaaaatctactgcgtggcttgtcaggaactcgactcagacgtggataaagataatcccggtaagagtaaaaaataatccgggagaggggccggatatgcttaggggggaagcgtggttaagtggtgatagaggcccgagaacagtagggctgagaggtgacagtggagtctctgggtggggtagaagtaaaattatttctcctttaggctctaaagaggacccttaactcaataagagcaccaagcacctcctgtgtgccagccactgcgcgagagtctgagctcaaccaggcccagtactgatggagaattgaagctagggcataaatgtgatacaaagtagaaagtggatgagttgccttatagagggacagggaaaacacctcaagcacagaaagagcagagcagaaaaggagatggctcagggctgaggtgggccaggcatcctgaccattccacccactttctcctctttttagctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgccctgagatgagttgagcttgtttcttctcagtttccccagtcaggatgagggagtaggtagaggactatgtgatgccccttttctaaggaagaagccatagccttttcaaaggtagcagccagaggggtggaccctagccttgtctctggcagcacctctgcagcctcttccgccatctggtgtccattccccacctggaagtgaggttttgtgttccgatccccttgatagattcccctccttcccctgagcatcctgaccctatcagcctatcccatctcatgcccaccccaggtactcagacaccgacaggagtttgtggtgaccccagcgtcaggtggcacgttaggcaccaagtgtggacttgccagtctcctgactccactgttagatcattttccttgggtgtgggggcggggcggggcgcggcggggagacggggtagcaaaaagaaccgtgaagaaaccacgcctgcccccttcagccttttcccccctccgccgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatggtgagtgggtgggcgccgggccagctgggcggggggctgacgcggaggaacgcaggggactgggacaggcggcctgggtctcagaggacttgcaggcaccagttgggttgcaagggttatggtaacaataattagtgatagttaccaattatggcagtagttaccatatattttcaaatgttttgctgacgttacttcatttcatccggctaaatggataaccccattttttgggtgagggtcatgactaaagttgcatagcttgcaggtggtgcctgatgtccacaaaaacttcgtttaggaaggtgcggggaagatgggctggggcccactattccagggggcggggctgggctggggtggcctggaccccaactccagcccaccctcagttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcgttgtgctctgcctggctggctctggggcgggaagaccgcggtgtttgtggcaggtgcggccccgcgctctgccagcaggtggcgcccgagaccccctccccccccgccccgcgccgagtgaaggccctgccgtcccgccggggcggggctgggggcgctgcctgctggccgagcctggctcagccgccgggtgactgcggtcgagtcacttcccctctctcgcccgcgacctccgagtcccccgctccctcctcccagttcgcttcgggctttccctgcctgccgggaaggaaggagaaggagccgcccaccttgaggagggaaactttccaccccgcgcggggcggggttgaggcggcgcaggaaatgggtggccggagtcgccggagcaaggggccccggcgggggcgggggaggcgcctccgggaacggcctgggacctcacgccccgcgggtgggagggaggggtggcagaggccgaggggagtgaagtcgcggcacctcgggccttcccggaggccaagcatgagactccgcggcggtgaagtttgattggggttccagggacccgtattccccgctcagtctgtgaagaccgccggctctccccacagcactagcggtctttacagttatctgtggaaggtttcttaggaaaccggggacccacaccgctgggactgagaaccaaacccagttgtcaagcccaccggaagaagccagcacgttcggagacagtgggtactcagccccctacacgcgcacacgacacctcacaacctcctgaaaagaggtgaagccgcacaccgaggtgtgcggacgaacagcacatccccgcgccctgctgcagccatttgcctcctggagatgcagcccagatggcagtcctggcactcagacatcccgttaaaccaagtagcagtcacgcaccgggctcctgtccatttacacaccttgcagagcagcgggaaggaacaaactgacctattgccccagggcagctgacacctgcagaggctcattaccatgcagggcgggtgggtaggcgataagggctctaatctaggggttcacagctgctaacgctccaggcaggctttcctggggagggagagtaaacatacacaaaaatgacacgttttccccatccattatagcgcatcccatttaataaggaggcatggcaaaatcagccaggctttctgctaaatgccttctgaggttcatcctctcagggattccctaaaaggcggaactacaattatccccatttaatagacgttgaaactgaggctcagagtgttagcgctttgcccaaagtcacacttggttggaggtcagttatgattctccagctacttgtcggggtttgggattatcttcccccttgacagcagagtcaggttctgaggttgggccaccgaggttactgacgccttcctgctctggttaagacgtgggtggctgcaccttggagttgagagctggtcctcgtccacattcacagtatgactctgagcaagtcccttcccctttctgggtctcagttttcccagccgttgaaagggggccagtagtacgtacctcccagggctgcgggcaggaaggaaggcggcccgggcagcgctctctagggtggcaccaagttgctggttgccctctctccacgcagcctctgcgcgcaccgagcgggcactgcggtcgggcgacaccccttccacgcccccctcccccgcccccgctcccgctcccgggtcgcggcgcgaggccccggaagccgggtcgccccgcccccgcgctcctgccccggcccccgccccgcgccggagccccgcccgccttccgacgggggtgcggctccaggaaacggcgcgctcccagctccgcgctcgccacccgacgcgccccaggcgaccccgcagactcagccagaccaccctgcgggccccagcggcggcagcggagagcgcggtcccgggtcggagcctgggacacctccgcacggacggggcgggcggcgcggacaggccatggggacccgggccgggccagcggtggcgggccagcgggagccccgggcctgagaagtgggcggcggggtggcgggggccatgacctcggtgtggaagcgcctgcagcgcgtgggcaagcgggcggccaagttccagttcgtggcctgttaccacgagctagtgttggagtgcaccaagaaatggtgagtgggagggaggcgggggggctcccccgaacttgctgggacctcatccggccctttgagcctgagaggactctgcccccccagcccaatgaccaaatgggcccccaccccagcttgggccctggttccgttcccaggctcggagattcagaagtgcccttgcaatttgtgggacccctggagttgggggcgtgggcagccttccctgcgcgggggtcaggactttcaggcctgaggttctgcctgtgtccactccttcctcagctgcggtcagggctgggggagggaggccgcatgtcttgtgccagaaaggtggttcagggtggcattggaaaagggatcaagttttgaggtctgcaggtggctagggctggggcaggagcctccctgaccttacttagtccagctaagaacagagatgttgccccctcctcccctgccatcttgttgagccagaagaacccctccaactcccgcctcttcagccagagtgctgggaggctggaaacatctccacaatgtccttaaaaggggaaactgagtgctgggaggattgaggagggaggcggggagcagcttaaaggggcctgaggacctaggaggttgtgggtccgggaggagagggttgcggagggcaaggtggcagggtgaggggtgattcaccagagggtgcaggccccagcctggactaccaacaggttcaggggcatctcgttcacatgccgccacccatagctgcccaggcccctgcgtcacaccctaaatatacgtgcttgctggtgtcagcttcccttggctggattagggcacagctgtgggggcctcacccgccaggcggggctaaatttaggctccccaggggaagggctggggcaggaagggaccatggggtccagggggaggggagtaagcaggaggctggggtcccttgggcagctgccatatccttggccttgcccacactgggcctgctagagggccattcacatctttcagcagagcctgggagagcttgggggctggcacttgaactctggcctctggctcctgctccagcatcctgcgggaggccagggaaacactgggcacagcaggctgagggtgccggcagtgtcaacgcagctgagtcacaggcggctgtgggtagggcctcctgggctgcttagcctggagcccaggccgggaagctgcccctgcccaggttgcagcttcccaggagggcgtgcccagcctgagtcaggctgcccagccaagccctgccctccctaggcaccccctgtccgcttcccctttctgggaaggccccttagttacccttgctctgccatcgctggcaatttgggcttggggaagggaacttggctctgggttggagggctctaggctcaaccgtgtaaacttgtttggctccaaacctctgtgggcctcagcatcctcagggttaacagagaggcacttatcctggcttggcctcagacgaacagtgagctgggcaaaccccagcatcacgagagggtgcaggcatggggctgggtacaggcaaggccagttcgcgtgctgccctgggccggatcgtcccctcaagcatcacccctcctgggcagcagttgaacatctaaccccaaggggccctctgcccccaggcccagccatgagtccactcagtgcctgggaatgggccctgcgcagccatctctgtcctctggctttgcctctgcctctcctccatgtctgacctggcatatgctgttcagcttagatgtcaccccctggaagtcttttctgattgccctccaggctccactgtcatcatcttgccgaaagctgatcctccttgggacccctgcgcccagcaaagggctggacatggtgggcgagggatggcggtgttggttaatgacaggctgaccctctgctgcttctccggcctcacccccaactctctgcccctctctctgatgtcaccctccagccgcagacccttggacttgccattccctctttctccagatcctcacacagcccatccccctgccactcatctctgcccagacacccaacctcaaggagacccccaggggttccctcacatcaccctggagttcgcttgttaatttattttccttcttgactggtagtctgcccccacctccattgtcctcaccggaaaggtcttgtctctcttttgccctcctctgtccccaaaactgggctgggtttatggtgggcgctccacaaacatctttgtgcgaagggacttcttttatccctcgtctttgtctctccctgtgttggagtctgcgtgtgtgcacgatgctcacatgtgcatctgtgtctggcatctcttgccaggtccttgtgtttctgtgtgtcttggtctctgtatgtgcctgtccctttctcacttgctgtctttcctcatagtccctgcctgcccacactgtctgggcctttgcccttctgctctggccccaccctaccttagcagctccaccctgcaccctgtggccccagataaggggctgcccaggccctcttctggaggagggggaggtgggcagaaggaagaccctgagggagctgggggaggaggaagaggagatggggaggcaggtgagcctgaccaagcagcctgctccctttctccctccccttccccctcccccaggcagccagataagctggtggtggtatggacccgtcggaaccgacgcatctgctccaaggtggggaaggatggcaactggggatccaggttagggatgggggccggtgggaggctgatgggggctgatgggggagtggagtgaggttcaagcacagatcagaatccacagaggggaggggaagatggtgtcaaggttggtgatagggggtgcaggtgggagggaagagttaagatggggggaggactcagattgtcccttgtaggcccacagctggcagccgggcatccagaacccataccggggcaccgtggtgtggatggtacctgagaatgtggacatctctgtgaccctctacagggtgagtctctagccctccagcatggatggcaattgcaacacaggcagttgcaacaattgcaacacaggtctcctggtaggttgttcatccagatagaagaggatgcggggggtgaggccaagaattaggggggcctgctcagcatcactggcccaggaggtctccttggaggaggcagcatttacccaacacatgcagcatgagaggcagctgggaccagaacttggggtgcatcccaggaggaggtagcaaccaccgcgtgcacctgtaatcccagctacttgggaggctgaggcacgagaattgcttgaacctgggaggcagaggttgcagtgagccgagatcgcacccctgcactccagcctcgacgacagaggaagactccgtctcaaaaaaaaaaaaaaagccaccactaccaagcacctcctgagccagacaagctctgctccctttgctgctgccccaacagtcctgtactcaccagcacccttcttcccaggacccccacgtggaccagtatgaggccaaagagtggacatttattattgaaaatgtgagtgtctggagtgggctcaggtctggaatcttggggaccctgggacagcactgatgccccttctcctggtctctcccctggcccacaggagtctaaggggcagcggaaggtgctggccacggccgaggtggacctggcccgccatgcagggcccgtgcctgtccaagtcccagtgaggctgcggctgaagccaaagtcagtgaaggtggtgcaggctgagctgagcctcactctttccggggtgctgctgcgggagggccgtgccacgtgagtgcctacctgccctccttgatcctggcctgtgacctctgactccaccctcacctttaacctctgcctcccagggacgatgacatgcagagtctcgcaagcctcatgagtgtgaagcctagtgatgtgggcaacttggatgactttgctgagagtgatgaagatgaggctcatggcccaggagccccggaggcccgggctcgagtcccccagccaggtgggctcacagcctgctgtggatcgagactgccaagacctggggagggagggttacccgggccaccagccacttgctgtgcccgccctgtgatgggaactcattactgcccaggcagtcccaaccaacccagcagcctcaattgtcccaacctggctgctggtcccacgatagccttggtcttcagctgagtcctggaggatgggttcccaatgtctcgctgggctcctgggtcctctcctcatccctttgtggtgcttgccaggcccgtacctgacccaggacagctgggtcagaagcccggctcctgatccctcaccaccagccctcctgggccagctggggcttcctcattcctccctgctgcttgtccaggctttttctctgtccactgttgaggttctctctctctttctctccacatctgtgggcctgtctcttctcgcaggccggggcggtgccctgaggccagggcgtttcccaggtaggacctgcactgtagttgggggagggggtcaggcctgtggggccctgccctgggctgactctgcccttctcccctctcctaccattcccagatccctctcgagagctgaagacgctttgtgaggaggaggaggaaggccaaggacgaccccagcaggcaggtgagacccaggctggggttgggggtggagactggaccccaggtcactgggcccaggccacagtgtccccctctttcttctcagttgccagcccttctaatgctgaggataccagcccagcccctgtgagtgctcctgcacccccagccagaacctcccgaggccaggggtcagaacgagctaatgaagcggggggccaggtaggccctgaggccccaaggcccccggaaacctcaccagagatgaggtgagctttggaaccagcctcaccccccattgccccctgataggagctgcagtcctcacccccaccaacctgcctccagggccccaacagtctgaagggtggcggatggtgctgagagttggggccaaagcagccccccaactccccctcctgctctcttctcaggtcttcaaggcagccagcccaggacacggcccccaccccagcccctcggctccggaaaggctctgatgccctccggcccccagtcccccagggggaagatgaggtccccaaagcctcaggggctcctccagcaggattgggctctgctagggagacccaggcccaggcatgccctcaggaagggacagaagcccatggagctaggctgggcccgagcattgaggataaaggttctggagacccttttggaaggcagagactcaaggctgaagagatggacactgaggacaggccagaggccagtggggtggacactgagccaaggtcaggaggcagagaggcaaacactaagaggtcaggagtcagagctggggaggctgaagagagttcagcagtttgtcaagtggatgctgagcagaggtcaaaggtgagacatgtggacactaagggaccagaggcgacaggggtgatgcctgaggcaagatgcagggggacccctgaggctcctccaaggggctctcaggggaggctgggagtcaggaccagggatgaggctccctcaggcctgagcctgcccccagcggagcctgcagggcactctgggcaacttggtgacctcgagggggccagggctgctgcaggccaggagagagagggtgcagaagtgaggggtggagcacctggtattgaggggacaggcctggagcagggcccttctgttggagcaataagcaccaggccccaggtgagcagctggcagggggccctgttatcaactgcccagggggcaatatccaggggtctgggaggctgggaggcagaagctgggggttcaggggacctggaaacagagactgaggtggtagggttggaggtgctgggaacccaggagaaagaagttgaggggtcagggttcccagagactaggacactagaaattgagatattgggggccttggagaaagaagcagcaagatcaagggtcctggagtcagaggttgctgggacagcacagtgtgagggactggagacccaggaaacagaggtgggggtcatagagaccccagggacagagactgaggtattggggacccagaaaacagaagctgggggttcaggagttttgcagacaagaactacgatagcagagactgaggtactggtgacccaggagatatctggggatttagggccactgaagatagaagatacaatacagtctgagatgctggggacccaggagacagaggtggaagcttctagggtaccagagtcagaggctgaggggacagaagctaaaatattagggacccaggagataacagctagggattcaggggtcagagagatagaagcagagatagcagagtctgacatattggtagcccaggagatagaggtgggacttttgggggttctgggaatagagactggggcagcagaaggtgcgatattggggacccaagagatagcatctagggattcaggggtcccagggttagaagctgatacaacagggatccaggtgaaagaggttgggggttcagaggttccagagatagcgactgggacagcagaaactgagatattggggacccaagagatagcatctaggagttcaggggtcccagggctagaatctgaggtagctggggcccaggagacagaggtcgggggttcagggatctcagggcccgaggctggaatggcagaggcccgagtactgatgacccgtaagacagaaattatagttccagaggctgagaaggaagaggctcagacttcgggggtccaggaagcagagactagagttgggagtgctctcaaatatgaggctttaagggccccagtcactcagccaagagttttaggatcccaggaagcaaaagcagagatttcaggagtacaagggtcagagactcaagttctgagagtccaggaggcagaggctggggtttgggggatgtcagagggcaaatctggggcttggggggcccaggaagcagagatgaaggttttagagtctccagagaacaaatctggtacttttaaggcccaggaagcggaggctggggtcttgggaaatgagaaggggaaagaagctgagggaagcctcacagaggccagcctgcctgaagcacaggtggccagtggggcaggggctggggcgcccagggcctcttccccagagaaggctgaagaggacaggaggctgccgggcagccaggtagggatgggggccgccgagggcccagtctgctgcttcccactaacctggggctgagcgaacggcggctctgcatggacccacctggtggaatgggatcgggtggggtggggggctcagcttgaaggagccccctcatcccctcctctctcaggatgccctggctctcttaccccatcttccctgggccgcatggagctggacacctctaagctgattttctgggctgactttgaggtgtggctgctggtgacctctgatcttgtctgggggccactgaccttttaggtgaccttggcagataaccctggatctagaaacccttttacctggccccaaggctctagccagtggtctctggtgacccctgcaagctcagagatggggctgttgtgtgccaggcatgagcttccccaagaggcagagggcatacatcccatttatacattccctaagcccacccctgtgtcctcaggcaccacctgccctggtcagctccagccagtccctgctggagtggtgccaggaagtcaccactggctaccgtggcgtccgcatcaccaacttcaccacatcctggcgcaacggcttggccttctgtgccatcctgcaccgattctacccagacaagatgtgagctgccagaggggtgggaacgaatgggggagccatcagggagggcagtgtggacccagcctctgaccagcacactctctgcagtgactatgcctcgctagacccactcaacatcaagcagaacaacaagcaggtgagatggggtgggggactgcctggagggaaggagggtctggagagccaggctctcagtgtcagatttggagaaagtggactgccgggcccagcagtggcttctggaagttctgccactttttacccctttggtcattaaattgtttgttttccttattttcgtttgtttgttttaaagcgtttttcctcccttagatggtttttccaaaaccaccctttggtaacggggtggacggtgtgccgttgctaagcaacgcgagggcgggccttgttgctggatttccctcgctaggagggggcggtgttgctaggcaaaacccggggtgccaatcccggggaccccctccgtggggcggcactgcagcgttgccgggtggcgcgggccaccgccgccgctgaccccgagtgcacccttcccctaggccttcgatggcttcgcggctctgggcgtgtcgcggctgctggagcccgcggacatggtgctactgtcggtgcccgacaagctcatcgtcatgacgtacctgtgccagatccgcgccttctgcaccgggcaggagctgcagctggtacaactggagggcggcggcggcgccggcacgtaccgcgtgggcagcgcccagcccagcccgcccgacgacctggacgccggaggcctggcgcagcggctgcgcggtcacggggccgaggggccccaggagcccaaggaggccgcagaccgcgcagacggggcggccccgggggtggcctccaggaacgcggtcgcgggccgcgcctccaaggacggcggggccgaggccccccgagagtcgcgacccgcggaggtcccggccgaggggctggtgaacggggcgggggcaccgggcggcggcggcgtgaggctgcgacggccctcggtcaacggggagcccgggtcggtgcccccgccccgcgcgcacggctccttctcccacgtgcgcgacgcggacctgctcaagaagaggcgctcgcggctgcggaacagcagctcgttctcgatggacgatccggacgcgggagccatgggagctgcggctgcagtgagtgtcaaggtccttctttcttcccccgccgcagcgcggggtcccgggaagatgggcagagaacgggcgagcccccaaggggccccaaggacagagctggcgcgagggtgacggtttcagagtggcggggctcggctggacccaggaggggctatctgatcagagggaccctggtgctgtggaagagtcctctggtgtggtagtgagctcctcattaggggacgcatttgagccaaggcccaccaggcagggtccccagctttgcggccagcctgggataagtgctgagggtttttagtgcttggcacttggtgtggggaatcaggctgcagaagttcccggagcatccacgttcctggcactctgcccagtgcttggtaggctggaaggtgggtttgggcatttctttccctgcaggtggctcatcgttaaccagcagccaccctgccccatgagctgggtgcagactatctgtactcaagggggattctccagggcctcccagccccaggactctggcgtacatctttaaccccagatgctggagaccagtctcctcttttcttacaatggaaggttggagatgtgagatcgtgagggcccgtgtccctgctgtcatcccctatgggttgtaggtcatctcctagagtgtcgtgtcactgtgctgaaggggacatggtcccagaaagagcagggatttgctcagtgacccacagctgctggagtccaggacacgggctttccagctggagtcccagcactgccccatcctgcctgtcaaccaaggggcagctctgccaggctgctgcaaaccttcagctgtccaggaatgacccctgcatttgaaggaaaggagtgaattcattgggaaagtctttctggaagaagccaccatttgagctaggttgataagatggccaggtttttcccaggtgaaaaatgagtggggttctcaaatggtgggaactgcattagcaaaaatgtggcagcaggaaagtttaggcctcgtttagggaactgccagccatctcccggaaggtccataagtggcaatgaggccaggctgagagcaggagtcctgggtgtagggtcagaggcacaagcattgagcctgtgagtgagagacagagggcatgggtgacacccacctgtggaagatgtgatacgcaggagtcaagaggacaaggccagctttggcccatctgttggcctcattaatgtgtgtcagtggctctttaaatcttaaaggggaggtgccccctctgggcccaagttccagcatctggtgtttccaagtcaggccttcccccagctcttgtctcacaggagatatctgacccatagggctggaggggactcctcattggccacccccctcccccatgcccattgtgtgcagtgggaggtggtctggcctggcccggcccttgggagctcccaaagtcctggtcttcctggaggaggggccaggcatgagggtattgaaagaggaatttgaggccgggcaccgtggctcatacttgtaatcccagcactttgggaggcagaggtgggcagatcacgaggtcaggagatcaagaccatcctggccaacatggtgaaaccccgtctctaataaaatacaaaaaattagccgggcatggtggtacaggcctgtagtcccagctactcaggaggctgaggcaggggaattgtttgaaccccggaggcggaggtctcagtgagccgagattgtgccactgcactccagcctggcaacagagcaagactccgtctcaaaaaaaaaaaaaaaagaggaatttgagttagacatgaggaagcactggaattcccacgaggcctggcatgcggaagctctgcgctgctgaggctggatttctccactctcctgcttctgcctgtcccgtcagctcagcactctttatgtgcctggcctgcccatggactcttagggtgtgtatgaaagcattttgcaaggtggcattgaggccccctgcaagttgctgtcaaaaaaggggagatgtgtgtttccctagattcctttctagaagccctgcagctcccaggtcacacagggctgggctttctcccattttacatacaaggacacaaacagaggccccaagggtgtgactggccccaaggcacacagcaagttggtggccaagcttgggaacaaactgctgggttagacaaccctgggccctagaccagaccctttaggagcctcatctctgaccctcagtttcctcatctgtaaagtggggagggtcgtggtccctgcctcacagggctgttgggaggattcagtgagtcagtgcacataaagtgctttaagtgcccggcacagaaacacttggtagatattagctgctgttattagtcagtgtaccttgactgtattttttgggcccagctctgtataagggggagacatgggaaaccagcagctgtgacggggtgagtgggggttggagctgtgatgggggaggccatgggagcagcatctgcccagcctggggatcagaggaggcttctggagacatggaagtcagggagggaggcgggaagagtgtgggggccccggcaggggggtctctggaggaagtagggctgggctgggtcgtggaggtcacgttggtaccaggcagcccaagatggaagctgactccaggctgagaaagctattttgggaactgaaagtcggccactgtggccagggggcggtgtctaggcgtggctcagggtggtaggaacattgaggctggggccgcctgaggctttggcatgaggctggggggctgaggagagatgtgaaacagttacaccgggggtgaaggtgtcagagaggcctctcagtttcagcttgagtcagcaggcaggccatggtggtggctggtggggaagtcaccactgccccaggccagagaggattgcctctgagccagggatgtccagggctgcctctgagagaggtacaggtgggagtggacacgggcaggtcaaccactgtccctgccccatgaccccgacacaggtcagatgacccagatgtggggggccagggcaggagcagttgaggggccaggctatcagctgagtcgaaagttggggacccccagggctgacagtcccaacaagtcactaggggcgggcaggtacatggggtcagccctgcccttccaagctaaaattcaaagatccagccagcctggcttgtcctgtgtgtgtgagcatgcagcagccgctcctgggtgtgggaactgaaaaggcagcagggcacccccttttggccaggaggtggaggtgctggctcaggagggtccaggtctggggagccctgaggacagaaggggagggagcctggtggggcctctgcaggaggcagggctgggctgggtcacacggatggggccatgtggggcagtgcaatggtcactgcatggggccctggccatgacggagaagccagcactaggtgacagaagtcagaggtggcctgagggaattccatggaagaggagtcgaggccgggcgtggtggctcacacctgtaatcccagcactttgggaggccaaagtgagcagatcacctgaggtcaggagttcgagaccagcctggccaacatggtgaaaccccgtctctactaaaaatacaaaaattagctgggcgtgatggcgggtggctacttgggaggctgaggcaggagaatcacctgaaccaggaggtggaggttgcagtgagccatgatcctgccactgcactccagccagggcgacagagcgaatctccatctcaaaaaaagagagtagggaggaaaggcctgggctgggcccttcacaggctctcatcctgtgaggccggagctcagcccagccccaggaggggaattgggaggctcggagcctgggtgtggatgggcccagggccacagggccaggaaggatgaaggctgtggcctttgcttgaggaggcatttctcttggaaggaggtgggcccgggggttctgtgcatgcaggactagaggaggggcaggggcgggcaggagctggggtcaaggacccctcctcccctctgtatgagtggctctggctggccccaggcccaggctggtgggaaacccctcccagccctcactggccccttcttccacaggaaggccaggcccctgaccccagccctgccccaggcccacccacagctgcagactctcaacagccccctggtgagtagcaggagtggtgaccatctcagttcaggctgctcacaaagcctggactggggacttcctgggggtgggtggtggttagggggtgccttatcatcatctctgtctgcaggtgggagttccccctcggaggaaccacccccaagcccaggggaggaggctgggctggtaaggagggctaagtgggaggagctgatgggtgagcaccacctattcagggcctgggctgagtccaccctgttctctgccttttccacccccagcaacggttccaggacacaagtcagtacgtgtgtgcagagctgcaggccctggaacaggagcagaggcagatagatgggcgggcggctgaggtggagatgcagctgaggagcctcatggagtcaggtggggcatacatctagggatcccttccccaacacatgccactaggtctgtccagccctgcagctgttcctgaccttgggaggagctgggaggaggcacggctggcatcagcgttcccattttacagccaggcatgctgaggccctgaagtggcttcctcgaggcacacagttctggcttctgggatgtcacaagggagcaaaccccctcccccaacccccagctgccctaccctgacacggggcagggggcaggcctggtgactgtccctgtccaatgcaggtgccaacaagctgcaggaggaggtgctgatccaggagtggttcaccctggtcaacaagaagaacgctctcatccggaggcaggaccagctgcagctgctgtgagtgctggccccgggccaggagagcagagggactcttagctactttggttagagttcttcactactttcttattcctacagagatctttttgacaaacgattcctcttccatcttactgtttttgtcctaaacaaattgctgtttaaagtgtaaaactggccaggcacggtgtctcatgcctgtaatcccagcacctggggaggccgaggcaggcggatcatctgaggtcaggagttcaagaccagccaacatggtgaaaccccatctctactaaaaatacaaaaattagccaagtatggtggcacgcgcctgtaatcccagcaacttggaaggctgaggcaggagaatcgcttgaacctgggaggcagaggttgcagtgagccaagatcagaccattacactctagtctgggcaaaagagtgagactctgtctcaaaaaataaaaattaaaacaaaaattaagggtaaaactcttaaattagaactatttttactaataagaaaaccggccgggcgcggtggctcacgcctgtaatcccagcactttgggaggccgaggcgggcagatcacaaggtcaggagattgagaccatctggctaacacagtgaaaccccgtctctactaaaaatacaaaacattagccaggcctggtggcgggcgcctgtagttccagcttctgggaaggctgaggcaggagaatcgcttgaaccctcctggggttgagagattgcagtgagccgagatcgtgccactgcactccagcctttacagtaaggaaaacagaagcccagagagatctgatctggttcccatgtggggtccgaagccactctgcggccattgcctttgtcatcctgcagggtggagacagctttgcctcccttttgcgtttgggatttttcagaataactgtagccagtgcttcctgtttatgagtactgttcatccaaataatccttcgggggtccttctggggggtgtgtgggaggagcaacacaaacacccagcaattggagaaaacagaagaaaagcgataatgtggtctggagactagaggatagctctgcggtcagccctgccctcgggaactgctggggaggtgggatggggtcagggagtggccagagccctgggcactctctccctacgccccttttcctgaactgccacccccccgccacccaccccccgccaccttccagcatggaggagcaggacttggagcgaaggttcgagctgctgagccgcgagctgcgggccatgctggccatcgaaggtgggacatgggctcaggggccgggaggcaagacagagccagggtggaggcggcacagccctgggcccgcgcctcctgacgcttagccgcttcgaccctcagactggcagaaaacgtccgctcagcagcaccgagagcagctcctactggaggagctggtgtcgctggtgaaccagcgcgatgagctagtccgggacctggaccacaaggagcggatgtgagtggcgctgggcggcgctgggagttgggagggtccgggacttgctcccgcagagggctgcgtgtggaccccgcccaacggagcgctgactcgaacccgttctccccagcgccctggaggaggacgagcgcctggagcgcggcctggaacagcggcgccgcaagctgagccggcagttgagccggcgggagcgctgcgtgctgagctgaggccgccggcccgggtggcccataacttctcgcgtccccggcgtccgccgccgccccgggcctgcgctgcggacgacccggccgtcccggaggccgcgcgcgtgtccgctaggggccgccggcgcccttccccgtacagggcagggcggatccccgaccccacgggcggggcggccgccgtatttatttgtcaccgagggtgtgtgcgcgctcgcggcgggtgcggggtcctccccgacggcacggccgggccggcggcctcggggagagggatgcctgggcactaccgccccgcgctggcttgccctcctgttctccagagcaataaagttggacgagactaccccagcgccggccttttctccgctccacctgggctctcaataggcggaggggagtgcgccgaggctgaggcgggcggctctgccatcctaagccggaaggtgcggtttcgaggttcccagggccagcggaggctggacctcggccttcccgggatggtggccggtggctcagggaagtcccattcgaaatagttgaaaatagccgaagtcgttgctcattttatgattaacagtatcctctgaggcctcccgcccaccctcaccgcggctccatctccagattcttccccagccactcctggctgcttcctcctcaggtgccgccaccttacggagctgaactcggtcacctgacgcttcagcaagcaggggcttgtcctgaagctggggccgcgggcggcagggtgctcagagccagttcatcctgccctaggatgccaccttggtcctcagcagtcacaggaccactgggtctgaagaacttccccatggcacggacctgcggcagctcagagaaggtctccactgccagcagcatggccaagagtcctagaagcaagtaacctggggaggagaaggtgctggggcagcgcctgggttctggtgatgctccccgcccacctcccagcgcagtgacttgccctggcaactggcaccactcacccccttctcaacgctgccaccagagctcttcgactacccctcccacgccgtgccctggagtgaggtccctccacctgcaaggcccagccccccagtgatttatgggagtcctagtccaggctcctcttcccccttcccccacacgctgttaggtggctggacttaccaagaagtgcgagctggcccaggtggtaaatcacggggtgcaggctgcggccgcggccgggcagcaagtcctccaggccaatggtgctgagcgagctgaagcagaagtagacggcccccagcaggctgcagtcgccctgaaggccccacagcaccagcgctggcagcagcacaaagctgctggccaccagcagtcccagtgcaactgcctgcagcagcgcagccctggccggtgacagctgccagtggaccgctacccaggcacgtgggcggctgagcacaggcagcaggcaatggcgcagggtggccacgagagctaaggaggctggcagccccagggctgcatagaccatgcagaaggcctttccgcctggcgatagtggggccatgtggccataacctggagaagagagagtcagtggacagtgagagctctgagtgccatgtctgctggggtccctgcctaccccaatactgccttccgcagaaggctgccctctggtggccttgaactggccaggcccaggttctagctggctctgctcctcttcgtcaggggatcccttaccctctctaggccattcttttcttttttggaaaatgaaaggatgaaagaagacagttcctcaggccttttgtagctgggacaattctgagaactgcgctgcccttaacagatactcccgattccacagctggtggaatatcatccactctttccccaaatgtgtgtcatgtcctgtgtgccaggctttgtactgggatctgaatcagcccaggccctgccccttctggtgggggagtcgggcaggcaaatcatgaagggctgcaaagaggcagcatgggcgagagagggcatgtgccaggcggggaggggtgggagtgcggggtgtgctgggagaacaggatcagctaatacagagctgcaaacgcacatgcctaccggagccagatgggagacaaacaggagtggtggggacaggggtacactggaaagtgtgagctgtatccaaagggcaggccccattctgctccagtcaggatgttgccttgcagggattctggctcagtgtgagtgggtttcctgattttccaaaagaagttggaaatatgagctgggcacagtggctcacacctgtaatcccaacactttgggaggctgaggcaggtggatcacttgaggtcaggagtttgagaacagcctggccaacatggcaaaaccccgtctctactaaaaacacaaaaattagccgggcatggtggtgcatgcctgtagtcccagctactcaggaggctgaggcaggagaattgctagaacccgggaggtggaggttgcagtgagccaagatcgcaccaccgcaccccagcctgggtgacagggtcagacaccgtttcaaaaaaaaaaaaagttggaaatacaaattccaattcaaaaaatactgagacactttgtggggcaaaaaatacgaaaacccagggctgtgggtctcattgctgcttttccctgggcctgtgcccacgcgatttctctgcaggactccctcatccctgtctgtgccctcctgatccacaagcatctcatgccgacttcctcccctatcttccctcactcccccacccgaggccatggtcctgatctgtccttcccaggttcattctatttgcttccatccaagaatccatcccactgtattgtatcccctatctggccacaggctgtggcatctgggcagctctcctgggtctcaaagggtgcctggggtgggactggggaggccacacccttcctggcagttgaagtggaggcaccagttggggtgtgttggtggggagccccagctgtgatgtcaggcctcacagggcctgggctccatctggctctttggggctgaaggaagggctgcatgaaccccaaagcccccagggagccatggcctcttggagccgcaccccccgacttggctgcctggctctcttacctgtggtggtgaggatgctggcagcgaagagcagggctgagggaaggtcccaggtcctgccctctgagctgttgcccagggtggagaccccatgggcctgggtggccagggcagtgcccagcagctcttccagagctccgggtggcaggcaggccctatgctctgcctggaaggctgccagctctgccctgagctcagcctgaagcctgcatgcaggaggcccctccagggcctggaacaccacagccccaagccccagggccagcaagtgggccacaaccaggagcccgtatcgggaccagggccttagaccccccatggcaggccgctggggtgctgtgggaactggcggctccacctcaggcacctgggaggggctgggcagggcggggccaggaggaggtgctgtgtgggtggctgggacccggctgggatggctggggtggctggggtgtgaacaggagggaggtgagctgcatcacccttcccaggtcctggaggcaagacatttgcccatttcacagcagctgggatggtggggatgggtggaggaaggcggctgcggtgaggggaggaggcggaggaagctgaagcctagagaggacctcacacttattcaaggtcctgctcactcaggcacccataccacattcattcattcattcattcattcaagtgcttagggaagaggacaggcacaggtcctttccttcctggtgtttacacaagaaacctcttagcaaagaaacatggcaacctcacattgtcatgagttccatgaaggaaacaccctgggtgatgggagagctctgcggggagcgggggggttatctcactgggaaagctctgctaaggaggtgatatttcagctggggagtaagaggccagtgaaggtaggaatgagcttggggtgtgagaggaacagagggctggctgtggcaggggagagttgggggtgaaggggggataaggacacaggcccttgaggataaatgtggtccagggagacctacgctgggctactgtaggcgtcatggatggagtgattttggcctgggtggtgtggtgggagaggaatggtggcagctgggaaggatcaggtgggggtgggaggtggggagaggactccagggtgcccagagcacccgggcagatgatacccttgcgcccgattgccagttcttcctgagaacgctttgtgcctgccctcctgactccctgcccctgaactgcagacacagagtctgggctgccatggggcacctgggagaggggaagggggagcctgggttccaactcctctaacgtcagaggggctgaggacagaggccaaggaagggacccagccctagggtatggtgtgggagtgccagagcccccatggcagtgtgaagagaatggacagaggccgagggagggaccctgccctagggtatggtgtgggagtgccagagcccccatggcagtgtgaagagaactgtcaggggtgccagatgccatggcaagtcaccatactgggaggtgggtggaacttactactcttttttttgagatggagtctcgctctgtcgcccaggctggagtgcagtggtgcaatctcggctcactcaaccttcgccgcccgggttcaagctattctcctgcctcagcctcccaagtagctggggctacaggcacctgccaccacgcctggttaatttttgtatatatatatatttttttcagtagagacggggtttcaccatattggccaggctggtctcaaaatcctgaccttgtgatctgtccgtctcggcctcccaaagtgctgggattacaggcgtgagccaccatgcccggcctatggttttttgttttttttttttttgagacggagtcttgctctgttgcccaggctggagtgcagtggcgtgattttggctcactgcaacctccaccttccaggttcaagcaattctcctgcctcagcctccagagtagctgggactacaggcatgcaccaccacacctggctaatttttgtatttttagtagagatggggtttcaccatgtggccaggttgaactcctgacctcatgtgatccgccggcctcggcctcccaaactgctgtgatgacaggagtgagccactgcacctggccgagaagagccttgaatgactgaccaaggctggtggatttggtcccaggagaggcatgcagtacaaggcatccaactgcctattgttggggcatcaggacaccagggttgtatgataggttgggtcacctggttacctccaagaaaggtgacaggctacatgtggggagacagcttttgagtttatttggcttctggcttcactggatcccgaggctaagactccaaccctggctggggcagcaggaaggcatccagagagccctggccccagatgacccccagggcaggaggtccatgctctaagccctagggcaggggccgcagtagcaggacttggtcaaaagtgctggtgacagctgaggccggcccctcttccctgcacctcccctcctccctgcatcaccccagcaggcaattccctgagacaggctctggtcctcccaaccagctgggtacagtgttgggccccagtagggcaggtgagctggggggacctacaggtttcagatgtgggggcgcaggtcccccttccagtgtgaaggcttcctgtgcagtgtagtgttcctgacccccaaaggggggtggggtccctggggaaactgaggcagctgcagaggctgacccagctcctgttccagtgtatgctgtgactcctcctaaggcagctggagctcgggggagtggcctggcccactcaaggccccgcttccggcacccacggggcctgggcacccatgtctttggtctgtgccctgcagtcctgggggcccccctggaaggggttggcaggtggggagtcccagaaggggtctgagtccgggaacaaggtccagggtgctcggcggggtgcaggctgtggtgatggcaggggagaaggccgtggcccagctgacacaaagctccagggatcaatgcggctgcgaaggggcgagggccgaggtcggctgatgaggcccaggggtggtgaacgtggggtgcctggggtgccaggagcagagcgtgatgtccccggtgggggtgagacagtgcctcctgtgaggatataggaggggcacagggtcaagcaacccccaactgctgaggtccccaagacactgtcctgctctgggcctcagtttccccatgtgcacagtgacctacttgactcaacttccaccgcccttcctgctccgtggtgcctctgttttttgtaatagttaggagtgaggcctctgcagcaggctggcctggatgtggatcccggccctgccacttactagctgtgggagctgtgggtcccttaatctctgtgccttaaatttcctcatctaaaaatgggcatccaggagcgcttagttctctggttgttatgactaaatgagaccatctcgggaaagccttgcaaacagtacttggcacaagtaaggagccaggagtttgctacgattatgattacatgtatgctgtgtcgcccaggctggagtccagtgtcatgatcaccgctcactgcagcctcaacctttcaaggctcacgtgatcctcccagagtgctgggatcacaggcgtgcaccactgcctggcccgattacttcttttatttcacagcaggcatcgcccccacctgcctggaccacctgatagctgaacttagaactctgctccctacatgcgtcttcagtaccccgaatgcctggttcagggtccagctgatgactgtggtctcggccttgcctccttgcatgtccccaccagccactcctccctccctgggaacccccgtctcccatatgtgaagcaggccggcttcaggccactcaccgcggggctcctcctcacgtcgggggctcttggctgaccgctggcccacagggatacccaggtccagcaacaggggtgcaggagtgggcggggagtcgggcgtcttgagcgagaagcagatgagcggggaagggggcggctcggtcgggcagggcgcgggcgttggcgtggggggtgttgtcggggactccccgcgctcgcgtcctgggcctcccggcggctgcaggtcgcggccaaggcccagcgaggcgagcagggcggtgccgcgcagcagcgcccgctggatcagcttgggcgtcccagagctgctaccgcgctctgcggggacaggcctcttgggctcctcgggctccaggctaggccgcggggggttacctgcgggcagaggcggcacaggtgagggtgtggctggtgcatattccgggtgagggcccaagacctctccgtggtcttggaacaaggactgagttctgccctctactagcatcttccctggtcccacaggtcccatggcctccccatcacatacccacattctggcctttcacaagatgggcactgggaggggagggcagtgcaggtggaggaagcggcagcaaagcccaatggcagccagcgaccccagacccgaaagatggatgggcagtcccagtggaggcaggctggggccaggtcacagtgggcctctgtggcctgccaggggcaacctccaggcccaggggcatggcaggtcccactgactgggaccggcgccctgtgctctgtgcccaccagcttcctggcttggcagccctgccccttctgcccacccacccccgctccagctgtagcttataagatgcacacagtcaactctaaggtacatggcagccctgagggcataaatccctgtctctattctagaaaggaggaaaatgaggttcagaggggtcagtaccttgcccaaggtcacagctaatttacagagtatgtatttgtgccaggcctgagctgaatggcataggggcattatgttgtctgattctcatgccccaggggttccaggctcagagaggttgagggcttgtgcggagctgtacagccagtgaaaggtggagccggcctcaccccaggcaagggcagtagaacctttgctctccaccatttcccagccagactctgccctagatttcaagacactagtgtcctaccttccagtctagggttggcctgactccattctagaccacttgggcagggatggggaacccctcattaaggacaagggactctaggatgggctctcacaagccctgattttgtcagatccctccttggctctagaaactgctgtggctctccactgtcactaggagaaagtctggcctccttggctggtcctctgaagccctccctggccttgtccctctgcctttcccctcctgcctggagtgcagcagcaggttggatgtcgggagggagaaatacaaggctgggaaaaatgagcttctactatgaaccaggacttagctcacagtcccttctgtcagccccaacccttactcagactctctgcctcttacctcacccaactcccaccccggccactgccactgaagggacaagggaatccttctaaaatgcaaacctgttaaagacaggtctctgcttaaaaactacccatcacttccagcttcattcactcattcattcaatcaacatctactgacccatgtgccttggcccctgtccgcagccccagtcctgagactcctcggctctcaactcttctcggagttcagccaggttgccttttccttgggtatggtgagctgcatgcctgcgcacacactattcactctgggtggctgacctttcccaccttggctttcagtgacctcttatgcaccatccaagaccaactgggatgtcacttcctctgtgaagccctcccagaatctccctgaacctacacagttattgctcacgttatgcctcatagaggtgctactggacttgtttatgagtctgcctgcttcatcatatgaggtcagggcagtgtttaacatgttgatgcctggctcttaaaatgcaaatccctgggccaggcgcggtggctcacatctgcaatcccagcactttgggaggcccaggtgggatgatcacgaggtcaggagatcgagaccatcctggctaacacggtgaaaccctgtctctactaaaaacacaaaaaattagccaggcgtggtggtgggcgcctgtagtcccagatactcaagaggctgaggcaggagaatggcatgaacccaggaggcggagcttgcagtgagccaaaatcacaccactgcactccagcctgggcaacagagcgagactccgtctcaaaaaaaaaaaaaagcaaattcttgtttgatgaagaatccatttttataatccttgcaccaaccacgaggttatcatatcacccccacttcgcaggtgaagaactgatcatttacagtgagtttaaacagaagaggggaaatcatgtttaaaaaaaagaaagagttggccgggtgcggtggctcacacctgtaatcccagcactttgggaggccaaggtgggcggatcacgaggtcaagaaatcgagaccatcctggccaacatggtgaaaccctgtctctactaaaaaatacaaaaattagcagggcatggtggcacgcacctgtagtctcagctacttgggaggctgaggcaggagaatcgcttgaacccaggaggcggaggttacagtgagccgagatcccgccactgcgctccagcctgggtgacagagtgagactccatctcaaaaaaaaaaaaaaaaaaagcaagagaggctgggagtggtggctcaagcctataatcccagcactttgggaggccaagtagggcagatcacttgaggtcaggagtgcatgactagcctggccaacatggtcaaaccctgtctctactaaatacaaaaattaggccgggcatggtggttcacgcttgtaatcccagcactttgggaagctgaagcaggtggctcacttgaggtcaggagttcgggaccagcctggtcaacatggtgaaacctcatctctactacaaatacaaacattagccgggcattgtggcacatgcctgtaatccctgctacttgggaggctgaggcaggagaatcacttgaacctgggaggtggaggttgtagtgagccgagattgcaccactgccctccagcctgggcaacagaatgacacttcatctcaaaaaaaaaaaaattagctgggcatggtggcacatgcctgtaatcccagctactggggaggctgagggagaattgcttgaacgtgggaggtggaggctgaagtgagctgaggtcgcaccactgcactccagcctgggtgacagaacaagactccttctaaaaaaaaaaaaagaaaatagcaagagcaagctgggtgtggtggctcacacctgtaatgccagcactttgggaggctggggtgggtggactacttaagcgcagcccagcctgggcaacatggcaaaaccccatctctacaaaaaatataaaaattagccaagcatggcatgcacctgtagtccctgctactcaggaagctgaggtgggaggatcacttgagcctgggaggcagagtttgcagtgagccatgatcatgccattgcagtccagcctgggtaacagaatgagactctatctttaaaaaaataaaagacagaaatgagacaaagggaagagaagatagggtccagcagacaaaatgagagtgaacagaagttcctgcagtcaatggcctgagaaactgaggttctgaagggtaagggacttggtcaacataatccagctaggatttgaatctgcctctaagcttcctggcagcaagagttagcaactctgttgtttaggagaaagctgcgtgactattcttgacccaaagatagatagatagaggcgaaactgcttccgtgaggtctcacagggaggacacagccacgtagttattggctctaaggcaacaagcttcacagggcagttgctatcagcgtagctgagtgcaccctgccaatgtgccactccttgcagccagctctccagggaccagaacagcccactggggacagggtgagggtgtgtgtgactctccagtggtatggcttatgccggggaccatctcacagggtctgggacctctgtgaagccccattatttgattcttagctgggtttcggggggtggctgtgaggtcaatgtcatgtactttcatggacccagatgatgcgtggagtgtgggattgggctaggggaaccagatgctcagccagccactgagctgggcagctgacatcctttcagggcaagtggcaatccatttcttcatcagccaggaagggcactggtgttgaggccgacatacttatcaagaacagtaactaccatggtttccagtgctttcatgaaacctcagacatgtggccttctggccacacatctgcaatttcatattgtgggagcattcactgtatccctgggggctgcggctctctcagtttgcaggggctggaccaagaaagaaggcatttcagatttctatgggcacagatgtctacagaagttatgatgccatgaaatacttcgaggagatgaggaaggctgctatctctcagaatgcaaagtgattttggaatatgaagaatttctttgggttgaattacttagaagtttgtcactgatctgaactattcatgaatatatgggctaataagtagtttctcttcataaataattaacaaattctttggataaaaaaacatggggcaagcttgagaacgatggggcccaggccccttgtgcccctgcttctgggagctgagggccagagagttctgtggaacagtcaggacctgcttcagcctacacacctgggttgacaggctctcaagttctcctttggcccatctggcctggtacaatttagagcaagtgaattcaagaagcctccttggccttccagctctcagttcagtccctgcaggacagatgctgggggcagtgcagctgctggagtagcaaatggcggggcagatggaggcccagggctctgcctctgtggtcagacaggcaagagcagatcaaatccctgctctactggttgccttacatcaaaccacttaatctctctgtgcctcagttttctctgttgtaaaatgcaggccaatactactactcccctcacagaactgcttggcacatagaagagaaccaacaaaggttagctgttgttacaactatcaagtgtagctcagggaatggaagaggcgatgggctgggtgggatgggaggagtgagtttaaacggcttgctgaacaggactcttctgagagcagctaagcgggtcctacattctggctgtgagcagcaggtgtgggggctctgaggatggtccctaggttggcacagggacccacaggcaagggaggccataactctctggcctcactcagagctgggcagtgttgagctgagtgagccctcctccctgcaatgctggagccctgccttctgcctgaccctctggcttcctaagcagtctatacgtgagaagccctttcttcaagtgaaagcttctgagctcactacgagagcattggagctgaagcctctctgggttcaaatcctcagctgggggtttgaggtaggttacttcacctctcagagcctcagtttccttatctgcaaaatggggtaatagtagcccctcttcatcaatgcttggagggaatgcctggcacagtagggcagttaccgtcatggagaacagaaaggccccgagctatcctggatgtggtgagaatgggtcctggatcctgcctgctcggccttctcattctcttcttcacctacaggctcccagaaggggctctgagaagcacagtgtggctgacacttgtttggctccaccccacacaggctgattccttcccccatctgggtccagcttcccttgggtaccaaatgccaggtgggcttcctgtctttcttttctccctggagcctgctaaaggcacaggggctgccatggggccagggaagaggcttcttgcaggccaggtctgagcaaggggatgagactctgggccccgagccgaggcctgggctgtatgccgcttgatcgtgggcctgtaggtcagacctgggttccaggatcggctctgtcttgtctcagccttggtttcctagtctctagaatgagagcaaccagggcaggactcctgctttgcctactagcctattgtggcctccccaaggtgcccacggaaggagctcagccagatcctgccgggggaggaaggccactcaccattgagtgctgggggtgtggaaggagatcctaagggggatgagtcatctgaatccaggtaccatgtggcttcgtccatgcgggaccttctcctggtgatgggagggcaaggaggggtgctttaggaatttcaggacttggggaaagcaaatgatgctgggtctggggggcactcaggtactcacctcccattctgggcttccccaggcttgggggaactgggaccccaagcccagcatgctcgccgctctccattgcttgagtcctccagacgtcggggggactggcggccccatgcctggcctggctctgcaggctccactgcaggggaaaccgatgaaatcggagataatctttattctccctccatcatcacagtcaggcttcagagataaactttagagtatggggagcaggctgggccctgtaccattcccagggtgagctttgggcaagatagatgggtttgggtcttggggccaacagtggggtggggcatctcatctagcccttgggctgaagtttgctgcttagtaattagtacagacactgacaccaactgcctgagtttgattctggctcttccacttattaactgtgtaacaagttacttttttcacttttctcatccataaaacttaaattaacaacaaaaataactaccaaatagaattattgcaagaaattaatattagcaaagcatttagaaaattagtagtacatagtgtcatacaattatttgactaaaaaaaaataagtaaaattaatgctgcttggggagttcagaggtaacaggctagacctaaggcagggagcctgggggcggggaggaagaggggatagtgagtgggctccgcctccaagaataaggtctgacagagaataaggagctggggggcggagaggggcatgagaggtgaagtttcttacactggatggctcggaaccggggaaaggtgggcgaatccccaggcccgacctcgaagacgtttctcctccggtcaaggccgggtgaggcctgcacggtgatgcggtgcttgaagtctgggatttgggttggggggagcagggttcaggtttgtgatgaagtagagccaggaccccaacctgcaggggcccaaggccagctcccaggccacatagggagcggcacgatggctgtgagactgtgaccagcctcactgctttcttgagcccctgggtctggataaggaaagctactcgtctgagtcggagatgccctggcgccggccggccccgcccactagaccttcccagaactttcgtgaaccccaccccttcccactcccagaccgacatgcaaatacttccgccagaacccgcccacagacagaaaaaaaacactcctggctccacccctcccagccttcatctcacgggcccacccacaacaccctaaaccaatcccagcgcggtgagcacacaggcctggctccacccccacccccgcagccaatggcgggggacgccccggggcccggccctcaccgagtggcatgctgatacgctcgccgccgtcgcgcgcccggagcttgctgcgcttgaatgtcccgcggcggcggcgcacgtgcggtcgctcgcggtccacctgctgcagcagcagcgtcagctcgcgctcgaacacctctagctcccactgggccagcaggtgctcgcgccgccgcagctgctccgcctgtgaccgctgctcgcgcgccgctcgcgtcagctcctcctcgcggctcagtagttcctgcgcccgagacagcgatggtggagaggtcagcctggcaccaatcccggcagcgcccgccccgactctgccccagggagatcggggagacactcgttccaacgctgggtcccttgattcctcgcaccttttccttggctcgcagctcgtcgaagagaccctggatctcgcgcttccagccttcctgcatggaatggaaggagtcccgcggcatttcccgtaggacctgtgcctccagcgcctccaactgctgcaggatggaggcgaagtcgggcctgcggtgggggtcctgcgcccagcagtctaggggcacggcgtgcagcggggacagaataagaaggggtccgtgggtggatgtgtcctgggccagggagctctgtacctcacctgccctccccgtcctcttaccggccataagctgtgcgaagggctcggggcaggtggatgggatgggcagtgtgagcttgttaacagctacgccataggccacagcaaggcagtcaatgccacggtatggcacctccccggtcagcagttcccacagcagcaccccaaaactgtgggcgagacaacaggtctgtgttcccttttctctcccaacccccacccccttactgccacttcacccaaaagcaactaggagccaagtggtttgggtccctgtccctggacttggcccagccctagatttaggcagccacctctgccctctgcagccccgtagcagcccgtccagccccaccaagggccgcacctccagacgtcactgcccttagagaaggtggaggccttgataacctcaggagccatccaggcgtaggtgcccgcggcactcatttgtgtggttttgtgccactctcgggccaggccaaagtcggtgatcttcagggtcttgtgctccatgtcgtcactctcaatgggctgcagcagcaaaactagagaagaggggccagattgtggatgctccaggatcaggtggtggggacagggtaagagctgggagcaaactcatctgacggacatcctggctgggtcctgggggcacagaggtgacttggtctagatcttgaggacctacttgaggtcagacatttcttttcttttccttttttttttttcttaagatagagttttgctcttgttgcccaggctggagtgcaatggcgtgatcttggctcactgcaacctccacctcctgggttcaagcgattgtcctgccccagcctcccgagtagtgggattatgggcatgtgccaccacgcccgactaattttgcatttttagtagagacagggtttctccatgttggtcaggctggtctcgaactcccaacctcaggtgatctgcccgcctcggcctcccaaagtgctgggattacaggccactgcacctggccgaggccaaacatttcacactcaaccccagcactcaaaaccatttatgagctaaataatatttttcatgtttcacagatgaggaaaccaagcagggaaatgacttggcagaggtcatacaacaaatacagcagagattacaacctggtctgtgtggctctgaaaccagtgttctagcttttccctaatattacactgaagcaaaactggcaaggtggcagctctggacatttatggctttgatttcaagagagatctgtgagtctcctgtcattttgttgaggcaggagcgtgaatcagaaccccccttagagtggggagcaagagggaagctcttggtgagaaaagaagcccagcaggtaccacaggcccctagtgcccacatcacactgtggcaagtgcagccactcccaaagcaaagactccaaaagatacctaccaatgcagctggaagggaagagaaagggtggggtccaagaaagtgatggttcttggccacaaaggaggagcttggggtaaatgtaggcgtggatggtcagacttggcaggggctcatggctttaacccaaatggggccaccgtacttggtacaaagaggagaagcagcaacttgcatatctctcaccaggacaggaatggctcaaatgagagaagttttcgaggaatagaaagaggacaaagtcatagagtcatgaagggtctgaagggcccctctacttttcaggttacagccaactgcactgtggaagagaagcaatatcaagtcaaccatgtttctggacccatgtcagggcacacctctcagctctcctgccctgtgtgacacggctgtcatgggggcagcatagggcacagggggtggggcagatgggaagggcacctaatacagcctggtgagtcagggaagacttcccagaggaggtggcagaaccagggtgctcatttttcagggcttaaagcaacaagccctgatcctgctgctggccaggccacctgggccttgaggaggcatctggcactgctgccagctgtccccgctgccccaccgtcctcagcccccacagcccctggctgcttggctctgtttctgtgtcctccaccttcagccatttcggcgctggtgcttctcagagcatgacctctcctcaacctctgcccactgcccctggctgactcagcctcttccaggtaccagctccctctccccactggcatcttccacatttgcaactccaggccagacaaattggttcagcagctctacctgatgtccaggtgccctccatgaccacctttactatcccggcatgcccagtagattttcctgcaatttttcctaatccagagaatggtctcaaaatctacccactcctctgagccagaccttggagctgagtcctgaacacttcatcaagctgaggatgacaacaaaaccctcctcagatggctgtcacgagcatgaaacaagaccacacttttaaagtttttgcatgggggctgccacctggcagaagcatcctaaaggccagttgtcctaaagcacttatcgtatctccgccctcctctccctcctctgtcactccttactgccaacttcaaaacagcctctggtctggctgctggaggcggggacctgagcatttagcaagcccccgacgacaagctcattccaaaggggaaacacagcaggctggggcagtgggtggagtggaaatgggcacctcccctggtgccagggcccaccttcccctttgaagaccaacacttgctgcttcttggcctgtctctagccacttgtggcaccccagactggcaaagtgctgttccagtatctcaggccgggtggccactctccacctttttcaggtggggaatctgaggcccagagaggggcaacaactcacccaaagtttcaggacttctttgtacttgtggtctttctgctacctccccgctcctggctctgccagctgctaagccccatcctctgctttctctccaagctcctctctgtgctttcaactgtcccaactcgaactgctgttctggtgtctgatgtagatcccaggcatgggaggtcaggggtcacccagaggagaatgggccagagaccccgaaactgggggaagctctcagtgcccctttagggctccctggcctctgatagggacctggccaccagctccctccctgggctggcctctgtggggcttgggagtggcctgggcagctcacacctcttccgctttcctcccgtggtccctacttctcctttctgggaggcctgggccaggtctcccacttgggagggggagtccttttggggagaactgggggaggtcaggcccaggccgggctggctggtcagtcctgtgactcgtgggcctggagaattccccctcctctccccgccaggcttcctcacaaggcccccattgtccaggaaaatcatgccattgtttcctgcctgtgccccccaccagcccagggactccccccaccccaatcctgcagacagcaacttgggcctaggactggggtctccgaggttaaatgccaggctcagggaggctgagggcaccttgcctgccctttaccaccacctcccagactctgagagggaagcaggggaactagaggggagtaggggagcagttccaggctccttcctcccgcaagtcctccaccccaagctctttcctcccctgcaggcagctgggctagggagggagcaggggctggagcagggacaggaagccggctcaggggcagcaggaaacgcaggaagcagtggggagggtggggagcaggggcctgggctattgttccattttttctggaaagaaaacggaggaaaaacagaagatgggagtcccctccccctgtgccttcggggaatccccctcagattggggcaggtagcgggggtccctagatagttagagcccagggttgaggctgagaggtgggaaccgcaccctaccagggatgagaagagtgggtaggatggttggcaggcctctcctggctcccccagtcctggcaagaacttggatatctggggctcagcactctgtttcctgcaagccccttgtccatggtcagcccaggccaggaggctcaaaatatccacgttgacccccctctaagaatgtctcatgcttttccagtgaccacactgagcctggcccctcctgcatttcctactgctgctctccagcctgcactctgggctctaggaggcccctgctcctggtccctgctgtgtgctgggtcctgcttccatgccttctctctctaaatgctgcgtgcaccaggaaaccctctgaagctgtcactcacttctcttgggccatgatgggcagcgtgtcgggggcttgaaatgatgggagatggagtctcccttagcccagcactcccatcccaagcactgatttcaggctaggccctcttggcgatccagccctcaaatgtccatctccatggctgaggacccgctgtgggttggggatcgcaggtcgggcttgcccaagctgttgagctgtttcactctccctttttacagattctgaaattgaggctccgagttggagtaaccagctagaggtcatgaagccagggagggctaggccagaattccagccctggccttagccttgactgccaaggagggcttccctctctgagatatctgttctggaggagctgcccatgacgacgggaggggaggacagagcaccaactccacgaacatgaatttaggggaggagaagatgaggagcacgagcttccagaggacttccttgaggtgggagccatggctgggcaggatgcttatggcccacctgagagataccaatttcttaacttgtccaaaccgcagctgcaggctggggtcaaggacttctgaagctggcgcaggaagactctgctgggtgcctggggctctgtttgggggctagcttgagcccatgggcacccctggtcagctgggaccccctagggtgggagctcctacctgcagtagaccctaagctaggctcagtggaaggttgggagcaggtgtgtaccagagccatgccacccccaaccatgcccccagaaactcactgttgttggacttgagatcacggtggatgacgggcaccagggcctcgcagtgcaggtagtgcatcccacgggcaatctgcacagcccagttgaccagcacatggggaggcacgcgccgcccggccagagctcggctgaggggcccaccggctgcatactccatcaccaggcacaggttgggctcctccaggcacacagccttgagggcaatgatgttggggtgtgccagcatggcgaagagccgggcctcctggcgaacgctctcggctgtcacactgatgtcctcatcggggtcctggcgagctgccttcacagccaccagctcacctcgccagctgcccctgtacaccttgccaaagcctccaatgccgatcacctcctccagccgcagctcctggaagctggccacctcgcaggggggcgggccgccaccccgagacacatagttggacgggaagatgcccacctggccacccacctggcccgcccaccagccctcgtctcctgagatggctgcgtcccgggacagcacctccacacggtcacccttcctcagggccagctcatcctgcccactgggctcgtagtcgaacagggctgtccacaccgggttggcataacccgctgcctttggagacccctcaggccggcctcctccaccgcccccaccacccccgctgccactgccattccatgaccctagagggctcttgaggaagaggctcttcaagggctccatggccgggagccggcgctgggatgtgtggaggaccttctctgggtgcccgtggtccccacccccgctggctgccaaggccctagtcccggaacctgggcatccgggccctggccctcagccccagacccacgcctctctggggagccaggagtgttgtctcccggccccccgcatctcgggcttctggaggagggcacccagggcagtgtggtcaggccgggggggtggggccccggggcctccggcgcctcaccatggctagcttggagggacccgagcttccctcggttctggagcagtcctgggagcctggctccggcccccgccaagtgtaaggtggggccttcaggggcagcgcctcaactccggttgggtctttttgcgcagggggtggagggagcgtccgcagttgggccgagactgcctgttcctggccccgtctcctttggccccgacggctccgaccccgctcccttcttcctcctccctttgtactttggccccgggggcgggaggcagaggtggagggtggagtttcacttttttccgctcttctccctcctgcaggaaacagcatcagatgacgcgggcggcctgcaccgctcccctcccagaggctccaggcggggagttcccgggtaggcgggccaggagaggcagagagggaaagggcagaaccagatcccccatcacagcaggcttttgagatctagaaagaaaagcccccagctgcgtgctctgctgcctagggtggaggttggtctctgctaaggatgggccatctctgccctctgcatccgcatcggcggcagcaaaacggggttacagaaccacacttgggaagggggtgaacccgagtctggtcttggctgcgaagttgtgggactgtgcgatccatcgattctgagcctcattattttctttcttttttcttcttttgagacggagtcttgctctgtcgcccaggctggtatgcaatggcgcagtctaagctcactgcaacctccgcctcccgggttcaagagattctcctgcctcagcctcccgagtagctgggactaccggcgcgtggcaccacggccggctaatttttgtatttttagtggagacgggtttcaccatgttggccatgctggtctcaaacccctgacctcgtgatcctcccgcctcggcctcccaaagtgttgggattacaggcgtgagccaccgcgcccggccattcttttcatatatgatatgaggacgagaaagctctgcctcgtagagctagttggatggggtggggaagactggaggacagacggaactggctgcacctcaagctcttggagtggattgcctaaggctctcttcttctcctcacctgggaaacaatccgcttcttcatatcccttccccattggcagaaacctgagacttgtccagaactttgcccaggattggattcagaatagctgagtcgccctcacaacttctggatagggctgccccaattgctttgagcctgtcactttaagaaagacgacgctatcctatttcgactattcctgcctgttacggaaggttgttctctacaccctaggtctgagctctgacccggaagtagacgccgctgggagcgaaatcggtcgtgacgtacgaggtccagcattaaagggggcgggccgagaggggcgtgcttcggtagtgcagaactctcgctgctactaggggagtccacgcctccaccttttccccgcctcctgtaactcattggaagagctgtgcgccaattactttgccgttacccaatggctactcaactgtctctttggttccgcccagtcgtctaccctgggttggcaacgcctgggtctacgcatgcgcccaaacgcttttacgctcgaacttgctttagtcctggagtctgcgcacgcccaaagggcacccctcgcgtcctaccgcgccatcacctttctgcgcttgcgcattcatgccgtcaagttttccttttccgggtcccaattggaatcgttgggcgcatgcgccactgcaggctggcggttcgcggctccttcttccggcctcctccttaggccggcaccagcagaagccgggcgagcgcggagccccaagcaagtgacctgcgaccccgaaagtggaccccagatcctggggttctccctggtccggagactagggagctgtcgcctgcaccccgggagcacccaccccacgaccacctctggatgccgccgacgggtacccggcccgtgccccgcgcctgcctgccggctcggcccctcggagcaattctgggccaggagtggggacccggaccccgcccctgatgcagccccacccccgcgtccgggccttgcaccactgactgtcccggccggccccgccccctgctcgcaccctcgcgcggccgagcccccctcccccgctgggggaggccatggcgtgagcgtgaggccgggccccggggccctcaggcgccagacggggcatgggccgggggccgcccccatgagggtcccgggagggggggcgcgggcagcagcggcggggccatggggtcgcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtgagacgccacggccacctgtaactccagccgggagagggagggcagcctggcagggattcagggcagtgccctgggctctgggacgtggagagagaggaatcactgcagagtttgggtctgtgtggaagaggggccaaagtcttcctttcttggatcgagtgaccttgaaccctacacttaatctcatccagctaagcagaatacagagccctttgtcgaggtctgtgtactggttgtgtggagaggtgatgaaattttcttgtgagtctgtgaatcccagctatgatgttgatggcaggtacatcctgtgggggcgaggctttgtgaaaagggacctggcttactttcatcttcaggtcctgcctcccagcttgatggtggccggcgtgtactgcctcgtggtggctgtcatctttgctactatcaagactgtcaattatcggcttcatgccatgtttgaccagggcgagatcgtggagaagcgcagctctaccatgggggagctggaggaagagcctgcccagggggacagcaatccacccaggtgggtggggtaggggctgtgctggggattgagggtttttggtgcctgggccggaaccttgcagggtggagtaggggcttagggaacattggctctctgagtgattgtgaacacttgtcctgtgttagccctggaattgtaaagtgacttctgaaaaagaagcagtgacaaagatgggaggaagtagcatacacagaggagaggttagctcaaagctgctgctctttttcaccgccagggaccccggagtggagatgacagtgttccggaaagtcagttccacacccccggtgcgctgcagctcccagcactctgtgtttggcttcaaccaggtctcggtgagtgggcctggacctcagcttgtcctcctgtccctctgcgagccagtccctactgtgggtgcatcctgagcctacttcttgccttgtttgttccttcatggctctctgtctactcaggagctgctgccccgaatggaggactctgggccccttagaggtaggtggctgctcttcagggttggagcatagtgctgtggaacaggggctggcgtgctgtgccagggggtcctgctgacacctctggggccatggttgcagacatcaaggagctggtgcgggagcagggcagcaacaatgtgatcgtgacttctgccgaccgagagatgctgaagctcagctcgcaggagaaactgagtgcgtgggccttatggggccgaggcttgtgggctagaccagctgtttcgttgttgaatcccctcaactttggctccatcctgggtctcctctgtattcctctgtgggacctccccagtgtgctgctgtggctgggctctcagggaaagtacagggcataagacctcccttaaccactagtttgttttgcagaaaacccttttttcattttctgtttccctttattttggcagttggagaccttccccagacgcctccaggggctgtcccagacccctctcttgccagtacagactcttcagagccttctcccctggctggagatggagcgccctggagtgggagcagcatggctgacactcccatgagccccctgctgaaggggagcctcagccaggagctgagcaagagcttcctgaccctgacccagcctgaccgggccctggtgaggaccagcagtcgacgggaacaacgcaggggggcaggtggctatcagccccttgaccggcggggctcaggggagcccacgccccagaaagccggctcctcagactcctgcttcagcggcactgacagggagacattgagcagcttcaagagtgagaagaccaactccacccatctggacagccccccaggggggccagcccctgagggcagcgacacagacccaccctctgaggctgagctgcctgcctcaccagacgccggggtcccctcagatgacacgctgcgttcctttgacacggtcattggagcagggacgccaccgggcctggctgagccgctcctggtcgtgcggcccaaggacttggccctgctacggcctagcaaacggcagccacccctgcgaagacactctccacctggccgtgcccctcgacggcccctgcttgaaggtgggggcttctttgaggatgaagacactagtgagggcagtgaactgagcccggcctccagtctccgatcgcagcgccgctacagtactgacagctcctcttctacttcctgctactcccctgagagctcccggggtgcagcagggggaccccggaagcggagggccccccatggggctgaggagggaactgctgtgccccccaagcggccatatgggacccagcggacgcctagtaccgccagcgctaaaacacatgcccgtgtgctgagcatggatggggctgggggtgatgttctgaggcccccactggctggctgcaaggcagagctggaggcccaggttggggtggagcaggctgctagtgagcctgttgtgctgcctgctgaggcgcgaaggggacccgctgccaaccagcccggctggcggggggagctgcaggaggaaggtgctgtggggggaggtgagtgcttgctctagaggcaggggctgggggacgtgagctacgggcttggggttgggcaaagggcaggtaagaatggacctggtcagtgtcagctcagcctcggttgtaggcagcagatggacgtgggcctggtggtgattgacattgtctgccaaacctcttagacatggggctcagccacctggctccacatccttgattagcacctgagtctctgtcccctgaggactctcatcatccacactcatcctcccaccaccagtggggtggggcagggccgatcagtgtcatccttgtttgcaagtaaggaaactgagcatggggctgtgtgacctggctgggcctcagagccggggcgtggttgtactaggcctttagctccctggcggaacaccgtccccaaccttactcccccagccttgtctgagcatctgtcacttacacttgggggcctctctctgggcagcggccgaggagactggcaggcgggaccgctcaagcagtgtgaggcggacccaggccattcggagacgccacaatgcaggcagcaaccccacccctccagcctctgtcatgggctcgccgcccaggtgagcaccttgccagctgtgccgaggggcaccgggggccggggagggcccgcaagctctagctggcgctgacctggggctgaccctctccagcagcctgcaggaagctcagcggggccgggctgcctcccactcccgggcgctgacgctgccctctgcgctgcatttcgcctcttcactgttgctcacccgggccggtgccaatgtgcatgaggcctgcacctttgatgacacttctgagggtgctgtgcactatttctacgatgagagcggtgagcctttcccaagcccggtggcccagtgcctccccgccttcccccaacagcctgagtcctcctagcagtggtgctcgctcggccctgtggcaggtacactgctaatgctgccagacatcatccttgcagcctctttgaggcacggtgtctctgtcatcttttgctctgctgatgaggaaacagaggctcagcttacagtacaggggagatctaaagctaggacaggtgactgccgcgcccaggctcttgacctgtaggccctttcctctccagaggctgggctgccctctcagaggacacagcacaaggttctgcctcatttgatgggtctggtgcccacgtgagccgggccttggtgcttctgtctctgccacgctgcctcatctcccataccctgccccaggtgtgcggcgttcctacacctttggcctggctggaggcggctacgagaaccctgtagggcagcaaggggagcagacagctaatggagcctggtgagttcccaagcctggcctcccaagccattgtcttggtggcctgcatctctgggaagttccctgagcctggagtttgctctcttcctgctgggcttgggcaggggcagctcagatctgcagggagaggatggggagcagcaaaggacagacctcctggggtccctggctccatgacactccgggcaggaagtttctaggaagcccagggcacagcctcgacactcgtgccagggtctgggagggaggcacttctgccacctgaccccagcacttgtcccttgagccctggttggtctcggcacagacagccctacctgcctggccttggcctcggcctcgaccccacccagccccagggctcgcccgtggggggatcctgatggctgctgttctcacagggaccgacactcgcattcctccagcttccactcggctgatgtccctgaggctacaggcggcctgaacctgctgcagccgaggcctgtggttctgcagggcatgcaggtgcgccgggtgcccctggagatcccggaggtgaggagcagccggggaagggccgtgccagtggggcgtgacggggcgggcagatcactgagtccggcctgcatagagagcttgcccaggtgccccaggagggacgggcagtgctgagtgagcgctccaggggccctactgtgtctgtcctgatctttgatgttggcagagactctgggtctgaatggctggagaagtcatttatttgcttactacgaattcctttggagtacattcctaactctggagggtcccacagtgaacaggggccatgggtgttaatgatgatacttgcggaagtggcagtgttctgttagcaagcagggaccctgtgatgactgtgctgccctgcatacactgtgcacgtgtggctgctggggtgctctctgttaacacttcctgtctcagtatactcattaccagcgctctgtcactcttaagaatatcacagtttggacagtaaatttgtatacttaatctattaacaccagaagcgctaaaaatgcgtgaaacgccatcttagagcttaaagaatgatcataaaagggtacccggcacctgaccctcaaggccacagataggttgggcagcccccagaagctcccacctgcccgcttctggttcatttcttccttgtaaccatgtggggtggaagcgtggccggcggccgcctccagagggaagggttgcgtgcctctggctcgccattttatccttggatcccagggcagggccgggcccatagctggggccccacaagtgcttgttgagtgaaggatacaacaaatgagaggtcaagtcatgtgcccagggcctcagggctggcattggcacctaggcatgtcctcaaggctgagccctgcatgcacgctcggatggggtagtcagagtgacagtgacaggccctgtctgggaggagggtagcatttgtgccaggtcccaaaggacaagtggacttccttgagcttcagaagaggtgggagagtttgcctgactggggaagacaggcgtgggagcgggtgactctaggcagcccctgcagccactgggcgacgtcctgggaacctggagagaggaggagccctttcagatgaagggttctggtggggtccagggccgctagacaggggcctttatgtgctgatggaaatggtcaaccagaccggtgtgctgaaggggggtaacagtagaccatgtggggggtggcggggctgacggccgcggctgtggggactgcagtttgacctgctggaccaggactccctgcacgaatcccaggagcagacactgatggaagaagcgccaccccgggcccagcatagttacaagtactggcttctccctggccgctggacctctgtgcgctatgagcggcttgccctgctggctctgctggaccggtgagtgtcccgcagccttggcccccaattcttggaaagcccctggaccttggctccccagactctgtacctgtggaggcagtcatggcagcagagagcctgactcgggggaagctgagggcctgtcgttggctggagtctgcagtggtggtttctatggttcatttgtggtgtaaaggggtggccaagtgggtggtgctgtattaaatctgtttattccaaagtcctgctgaaaaaaactttttttgagacggagtctctctctgtcgtccaggctggagtgcagtggcatgatctcggctcactgcaagctccgcctcccaggttcacgccattctcctgcctcagcctcctgagtagctgggactacaggtgcccgccaccacacctggctaatttttgtatttttttttttttagtagagatggggtttcacagtgttagccaagatggtcttgatctcctgaccttgtgatctgcccgcctcggcctcccaaagtgctgggattacaggcgtgagctaccgcgcccggccatcctattcactttttttttattagcttctgttgatttgaaaatcgagtgctgtaacctagaaaagctcacagaccagttatctcacttttcccatttctcagaggggacacagagtcccagaaaatccaatagagaagtcagatgacttctacccagtgtagagaacttgggcctagagcccatgtggcttcccgtccatctgggtttctctaggcacagggactgggtgctggtcctgtgtgcatagcgtggcacgcccaaggcagcatgcacgatgtagccacgtgcagttaactcagtctcagctggggatggatgaatcccgggagtaatggcaccctgagctctcagccctcaatgtccagagcaggcaaagattgggaaggagagagcaatacaatggtcgctggagcaggtgctgccgggccgcgtcgtcgcaaagttataggtgttcacatcttcagaggacaagggtctggcatgggcacagtcccagagctgggcctttagggcaagatccatcttccccactgccccactggaaggtgaggcaagacgggcacgccctgactaggctgtccctgcaggacgcggggagtgctggagaacatcttcggcgtgggcctgagcagccttgtggccttcctgggctacctgctgctgctcaagggcttcttcactgacatctgggtcttccagttctgcctggtcatcgcctcctgccagtactccttgctgaaggtcaggccgggctctctgtgtttccttccccacccgacttttcccaagattgcccttcccacaactccagttttaaggagtataagctgaaaggtagataatttgtctaaggttccctagagctggccagctcttttacaagcaagaaaactgaggctcaggacagttcgggggcctgacctggtcactcataactgcctagtggtggagctgaacaggtctggggcctctgaccatcccgtgggcatcggctctagttgccaacgtagccctgtctcttccagagcgtgcagcctgatgcggcgtcccccatgcacgtgagtacccatggagcagcgcctctggccaggaggccccgggaggggctgagaccaggtggggaggagggtagggtatggagggctggggctccctcaccacccccatcacccccacctggccaggctctccagcttggacccagggccaggcctggggcccttgagtgtgtgcatgtgtcagaggtgtggccagtcggggagacccagctcctcatgggctgacccctcagggccacaactgggtgatcgcgtacagccgtcctgtctacttctgcatctgctgtctgctcatctggctgctggacgccctgggctcagctcagcccttcccacctgtctccctctacggcctcacgctcttctctgcctccttcttcttctgtgcccgagacgtggccactggtgaggctggggcagggatgaggtggcccaggagagtgagtccccgagggtgggccgcggaaagccagcaggctgaccaggccttcgtgtcccctccctgccagtgttcaccctgtgcttccccttcgtcttcctcctgggcctcctgccccaggtcaacacctgcctcatgtacctgctggagcaaatagatatgcacggcttcgggggcacaggtatgatgcccacaggtggctcagggatggggcccgtgtggaggcccaggagggccctcggattgggtccttggctccacccttgcggaaccttctcctgcgtctgtactgcagactcaaggtttctgccttctcccctctccttccctccccaggcaagtggtttatatctgagaatcttggaagctctaaaggccgcttggggcttggggcagcagagaacaatgggctgggggtgcctttccagggaggccagcctctgggagttgaggggaagcgcggctagggttgaggtggggtacctgcaagtgagagctgggctgtacttctcccttccacacagctgccaccagcccgctcacggcagtcttcagcctctcccgcagcctgctggctgctgccctgctctacggtttctgccttggggccatcaaggtaggggtggcttgcgaggtgggggcatgctgcagtgcgtaagggtggttggggcggggctgtgaactgggctcagcagtggcttctcacacgggggcagcccgggccccatgcttacctcacctcccctgaccagcatggattctctccgcagactccgtggccagagcagcacgtccctgtcctcttctcagtcttctgtggcctcctggtggcactgtcctaccacctgagccggcagagcagcgaccccaccgtgctctggtgggtgtgctccgggtcgtgtgtttgtgtctgcccagtaggggtttgtggtctgtgcatgtgcccgtgactggggccggggggaaggaggggcggcctcctcctgactcttcctcacccccaggtctctgatccggagcaagctgttccctgagctggaggagcgcagcttggagacagcccgggccgagcccccggaccccttgccggacaagatgcgccagtcggtggtgagggggcggggggtgggggtctgtggggaggtggtgacaggtcctggggttcctgggaggggcatgtccagcttgggctgctgggcagctgagtgtctctcctggccgggcagctgaatgtctctcctggccctgcagcgtgaggtcttgcactccgacctggtgatgtgtgtggtgatcgccgtgctcaccttcgccatcagcgccagcaccgtctttattgccctgaaggtttgtgtggcatgggccgctgctgcctctcgctgtcttggcgggagcctgctcaatctgagtgccgtgggcagcccctccccggcctgtgccaggtggccctctgtggtcccttggcctgctcccatcagctgagtctctggcctctccctcctgcagtcggtgctgggtttcgtgttgtacgcactggctggggccgtgggcttcttcacacattacctgctgccacaactccgcaaacagctgccctggttctgcctgtcacagcccgtgctgaagccgctggagtacagccagtatgaagtgcgcggtgagtgcccacccctgatggccaggcctgggcagtggctcgggctgcagcctggctggtgggagctgtggtcctctcggctcaggagtgccagcagggggcactcgctgcccacactaccctttctgctccctccctgccctctgtgtccgtgttgcccggctgcgctctccaccgactcttctcctcgtgccctgctgtgcccttcccttgcctgtgttgccctggtcctgccctccttcctgtctgtgagaagacggaagaattagaaccccagggccctgaagggatctcttgtccagaattaaacactgatcaccagtggaccagagctgcctggagcacatcttcactgggctgcataatggtttttaaaaaatcctggagcctctattttagcatctcgatttgagatatgaagatccatgtttcttgagtttttcttaaacgacagaagattttgcttcccagactagcatccctctgtggctacaaccagcctgaaccgaggggtctgccctttagaagggcccagctcacgggctcactgtgcactcaggccctagccagcctgctgtacgtaggtgtttgcgatttcatcattggccttgttttaacagacagcagagcagagcacctgccataaagcaagcctcgatgtgctaagtgccatgtggagcccttgccctgctggggctcgctgctcccatttgagctgccacagatcagcccctccccccagggtctccgaggagtcaggaccgcacagcctgccctcctagggaaggacttcctcagggaaggcaggcatgtggaagccaggtgcagagtcctggcctctccacacaggtgccgcccaggtgatgtggtttgagaagctgtatgctggcctgcagtgcgtagagaagtacctcatctaccccgccgtggtgctcaacgccctcacggtggacgcccacacagtcgtcagccacccggacaagtactgcttctagtgaggaccaccccaccctcaacgatcccatcatccgctttcccttttgatccgtggggaaactgaggcctagagagggaatgaatcatgtctaaggttgtttagcaagctaaagcaggaccccagctcctgacacgccatcccaggaagtggttgcttcttcaaaggcaaatgtgttcccaccactccctttggaagagcagagactaagagtcacgggcccaaaagagcagggaccagcccagcagagcagaggccaggggttgctctccggccagagtaggcgagggatgggacacctatacccactgccccggtcccctaccaagcacccgatgcctgccccttgcccacagctgccgggcgctgctgatgaccgtggctgggctgaagctgctgcgctcagccttctgctgccccccacagcagtacctgacgttggccttcaccgtcctgctcttccactttgactacccgcgcctctcccagggctttctgcttgactacttcctcatgtccctgctttgcagcaaggtgagttggtggctgtggcccagaccccaggctgtccaatgggagcagagccaacttctgcctgggtgggaagagaatttcctgagggcctgtggccaccgctctgtatcagccccgtgggcctttgcagcagcctctcaaggaaggggttacttccaccctctacagagaggaagcaggctgaaggaggttgagggacttgcctcaggcttccagagaattggtggtcagccaggatttgaacccaggcctgtctgaccccacgaccacctcctcagaaatggttagggtaatcaggacctggccttatcctctggacgcagacctctgagttccacgctcttttgccaccctggatccagagcagtccgagctgagtttcagaagcccctagtgcctgggtgtgtataggtgctctgccggctgtggcattgccacggcttggggggctctttgaactaaggaaccatgctcctacactctactggaggccagcagtggtacctggaaccccaggcaggcctgagcctttttcttcctcacgtgggcattctgttcttgttttctggcctggcccaggatggcggtcatccacactgcgtaccctctgagggcagggcctgtggctgttctcaattttcagtactatagtctagcttcagcctcaccagtgacctagtggcgtgacctgaggaagtcatttatcttctctgtcttcactgaacctcaactttcccatctgtgaaaaggggccagcaataggaataagaagctcacagggtacttgtgtgaactaaatggccaccgccccctttgagctcaggcaggggttgctaatggcatcaggcgccttgagccatgtccagagcacaagggctggcagtgaccttgagtttggcccccgtgggccaagccagtgcgatgacccaagcctctgaatggggcctggcatccgggggcttccatgagtgaccctgcatgtcttttttcttctccctgttggccctgccagctgtgggacttgctgtacaagctgcgtttcgtgctgacctacatcgcgccctggcagatcacctggggctcggctttccacgcttttgcccagccgtttgccgtgccacgtatccagcctgtgtttgggtgggggtgtgcagggagggctgtggcctggggcagtggggggtggtggggggctgggaggtcctgttgcccgccgcctccttgactgtggctcagactcggccatgctgttcgtccaggccctgctctcggggctcttctccacgcctctcaacccactgctaggcagtgccgtcttcatcatgtcctacgctcggcccctcaagttctgggagcgcgactacaagtgagtctcacaggaggcgggagcatgcccagcagggcaggaagggagaggtttggagcccaggctggaggccacccacagaggggcccacagcaggtatgggagggcttggtcacagtggggacacatgaggcggcagatccaatgcagggagagcctgcaccaggccaaggcttcaggctcacagcttggggatagtggggtctggggatgagcttagcctcccagcttcttggctgtgtgtcctgtgtgagtcccttcatgtacctgagcctcagtctcctcatctgcctgcataacggggctgtcctggatggcgttgaccttgtggcacagggagagcatgagcagggtgcaccctctcttcaccttcttggccaaccgccttgttgcactctctctgaacagcactaaacgtgtggatcattccaacacccgcctggtcacacagctggacaggaaccctggtgtgtacccagccatccaaggggctttagggcagggcctccctggggagggagcctcgctaacttgtcactttgtccatttgcccgtctgttctgggtcttaggcgctgatgacaacaacctcaactccatcttctatgagcacttgacacgttcgctgcagcacacactgtgtggggacctggtgctgggccgctggggcaactatggccctggtgactgcttcgtcctggcctctgactacctcaacgccctggtgcacctcatcgaggttggcaatggcctcgtcaccttccagctgcgtggccttgagttccggggtgagccgcaggaccaggctcgggtgggcaggcacagctcgggcctgatgtgggagctgtgttcaatagcacgtgcgaaggaggtccagtccagctctgtccaggctggcgggtggccttgggcaaggcactcctcctccctgggcctgcgtttcccagtctgagcaatgaggtggcagggtctcttggccaagccctgtgcctgccccaactttaggtcccagtgactctacaggtcactgcagtgagggcctgggcctggaggtctgagttctcacacccagcctgctctgtggtctcaggcttggcccatgggttgggcgccatgagtgagccagctccttcctctcaggaagacgtgtgtgttggatgcccgagagtgcagaggggccagaccgtgtccctgctccctcccgccctgcccttggatgctgggagttgggaggagaaaggcaggcgctctttcgtgaatcttggcatccaataaggttgactcccctggcgtccaagggggtgaatggcagcaggcctctgatgccatgttggtcactctcccaggacagggcaggtagggattgttctagcagcccctgactgcacacccctcctccacaggcacttactgccagcagcgcgaggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaaggtacggtgggcaggtgtggccgggcagcagggcccttgcgggtgagcgctcgctgaccagaggccccagtaccccctttctgggttgttgggagcctgttttgtccaagggaagctgaggcctcagagagtttaagtgtcccctgaggtgccactgccagacctcaggttgcaggggcctctgtgcccatatggctctgataggtgcccaggcaaggaaggcttgctttgggcagtgagtatggggcaggtgggcagttgcagaggccagcctttgaaaccaccagcccctgcccccagctcacccagcacagagcagtggtagagctaacagttgtcacgttaacgatcatcatgggagcagctgcttgagcagtaacatttaccacgggtgggcgctatgctgggcatctctcctgagctgggtggagtcccccaccctttgagaggggccctgctatctcacagatgtggaagttggcttgcagaggttccagaatctgaagaaaatggccaagccaggccttgaacccaggctggccctgagccacagagctttcctgccttagcctgggggctctgagccaggcctgaggatcttgagacctcttgggggtgggagggggttggtgaggcaatgtggggtacataaggagccctggaatgggggttctgatcagcctggaatgtttcttccctgtgtccctcagcttaccccttgagaagtgggggttattgcagttctctgagatggcagaaatgttgaggcttggccaagcgtggtggctcatgcctgtaatcccagcactttgggaggccaaggcaggtggatcacttgaggtcaagagtttgagactagcctggccaatgtggcgaaaccccatctctactaaaaatacaaaataattagccgggtgtgatggcgggcacctgtagtcccagctacttgggacgctgagacaggagaatcacttgaacctgggaggcagaggttgcagccagccgagatcgtgctactgcactccagcctgggcaacagagcaagactgtctcaaaaaaaaaaaaggaattttgaggcttgtggtgctcagaataagcgtactgggagtggggtggcctgctgatcacagtgcaggctcccacgtgccttcttaggatctaccctggtgctccctatgttgggctcggtgggtggcctactggggcccaggtgagcctgccacctaggttctctctggagtagtttcacgaggccctggctgtccttctccaaaggaaatcctgtccacaccacatatcagaggagctgtcatttgtcattccttctgccctcccagccactcctaggcaaggatttgtgagaccacccccctttcatcaagaaggaggctgtgtctagagagggacattcccagtcccaggtcaccgagaggtcatggcctggtccaccttccggtcccatcttgagagaggtgcccttgcccaggttgccctgctgtgcctgctaggctagggccagcaggttgagatgcacctggccaggtctcttgtcccatggggaagctgactggccacatctaaggctgcctcaaaggctgggcagaatttgagtctggaggaagtgcttggaggacctggggtggctccgctgaggatgtggactgagggtgaagcttggaaggacaagtcagggctgccaggggtggggcggggggaggcgggtgtgctggggagcctggtgcatctggggaagtgtcccagctgcagggataggtcctttccagccttcgaggttggccagtcgaggcggagcccctcccgttagctttgcccttcccgtgggagttactgggctctcagacctgcttctgcagctgggaagggctacaagagcaggaaaaggcaccgtggcttgaggctgcacggagtctgggcagtgcttcccgggaagtaccttgggcagagcccagctcgcagtgagcgctcacaggcggagcggctgctggtattgccccccgtcttcattttcttcctaagatgaccgtgagtgttgtgtcagagaaaaggatggcactggtgaaggttaaccaagcacctgatatgtgccaggccagctcctctcccggtccctgaagcttttcttttttttatttttttttgaaacaaggtctcattctgtcacccaggctggagtgcagtggtgccatctgggttcactgcagtgtccacctcccaggttcaagtaatcctcctacctcagcctcccaggtagctgggactacaggcatgcaccaccatgcctggctaatttttgtattttttgtagagatggggtttcgccatgttgtccaggctggtcttgaactcctgggttcaagcgatcctcccacctccacctcccgaagttctgggattacaggtgtgagccaccctgtctggctgaagcttttcttttctgggtctttttagcagctctggtggtgcctggattgtagaggcgagctatgggcaagaaagtcagtctggagcgggtctgccctggcaaagggcctgccccattagctccatcttagggtggcacatggaatccccatcacctcactggctgccctgccggccttaacccgcccgtgcatcctggccatgccagctacctgtcttccaaagctcctgtacttttgcccaacagggccttttaacaagaggtccaggagcccccagctttgggtaccacatgtgcccgtggcttttttctgaggcgaggcctgatggctgtcatgcttcagctgcctaaagggacctgtgacccaggcactctgaggcaggcccactacttcagcctgcccttccggccccgagatctggatcccacaatgtcatgatggggaaggtccggggttcaggcggcagttcagtctgttctgccccactcgctccccgccccctgcccatgtgacatctggatgctcccgcgctcggggttatgtttgtgcaggaacaccagctcctgctgctacctggcccacgtgctgcacaggcactgaaggttcacctgagggccacaccatagtgtcggggccagccagaggcgggtgggggacagggttcagggcaggtggggccagctccaccttgatgacttggaagctgaggtggtaaatgttgagtgtgatgatcttgttctcgttgggggctgccatttgtttgagcctcaatttctcatacaaacggggcatattctagggcagaggcaggcagatgctgcttgtgagtgctagccccagcacaggacttcctgctctgtaagtgggtgcttcctggcggctttgtcactcctccctggtctaggggaaggagccaacttgcttggttgctcttgagagctgagatggctctaggagcggggcatcccagaaagcggacttcagctcagtcttggggaggagcctctgaacctccatgctttctcctccagtggccagggccgggaccccggcctgacgcctgcccctcctctcccagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccaggtcaggctccactacctgaggctgccacctggggctgtgggacctgggcttccctgctccccttctccccatttggtttcctctcactctgagcctcccttagcctgagccccagcccccactccaaggtccctgtcccaggtctgagctgggctctgggatgggggtccttatgccacagcccgtggaccaggattggaactccccgctggtcacgctgtgttttggcctgtgtgtgctgggccgccgggccctggggacagcctctcacagcatgtctgcaaggtgagtgctcgggtgtcccgcggggcctactgccgtccccaccccacctcttccacgaagagcactgtggtctctggccacagtggccacagaaactgcagtggcccttcctgttggggtacctcttctcccacgggcagggcacttcctggtcatgaccttgcctgctcctcagtgctctgtgagagacatgggcagagattggcctctttgtcaagatggggaaactgaggctcagcgtgaggaaaggcctctgcttggatcactctgaagccttacccctgggtcctcgacacccctctctcccctccctgtttttcctcccacttagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggttggggaggggtgtgcccagcagcatgggcaggtgggggatgaagcctctctccagggcaggggccactgacccctgttcccgtcttctctaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggcgctgcgccatgtcctggatgatgcctccgacgagtacaagatcatcatgctcaaccggcgccacctcagcttccgagtcatcaaggttgggccggccccacctgccctaagccctgccccaaacccccttgggccggccccctgaccctggcgtgtggctctcaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggtgaggcctcgggaaggggtgacgtgtggcgcgggaggaagctgaggtgcagtacgtccctcctgggtctcagagggaggacgtgctggagccagggcttgaatcccgagagatgaccccctcccagagctgacctgcccctcctagatgtcaccttacccccagagctgacagtggcctttagtcatcaagcactgttgacaacgcaccctcaaaagactctgcaaagtaggtggcagcttcttagaggggaggatcctggggctcagaggtgttagatgacttgtcctggggctgaggactcatgcttgtgaggcctctggcctcagccgtgtccctcctgatcccttttctacctctccacccccaggcttcacaagggctgtggcgccggctgcaatagtggcgggaacgtggatgattcagactgtagtgggggcggtggcctgacctccctcagcaataacccccccgtggcacaccccacacctgagaacacggcaggtgagcaggcgaggctgggctgaacccgtgggtgaggagtgcagcccagctgaggcctctgctgtcttatctgtctcctacaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttggttggcagtttctttttctacctgggaatgggtacatgatagtacaggcggctaagttgggatggacaagcacgcagaggggtgaaggatgtggggctgaagtctagtagagatcaagggcagaccaaggtggggttcaggtagaaccgggtcctcttcaccgcatggctgctcccttttcaagcctttatctgaagggtattgtctgccatttcccaccatatggtcagacttccaggtctggtggctcctacatttatcaggcttgttcttggccaaagcctttctctgcacctcagctgctccagggcgtaaagagatgacacctatctaaggtgtttttagaataaatgagagcgcgctagtggaatggttgcccagggcccagtgcttagcaagtgctccataaaatagtggcagactcttgagcacctgctggccgggagctggacgctaggtggcctccgctagccctcccggttggtctggaaggcaggcacaagtttctcaggagaggaaatggccttagaatgagcactgctcggtgctgacctccgccaggcctggaatccccgctgctgcgcttcccgccgcagacagctcccggccggccccgcctcccggcatggccccgcctcccagcatggccccgcccccaggcggagccggcgccgggagcggtagcgggagagcggcagcgggaccccagcgcgggcggcggcggctgggcgggagccccagaggtactggcgggagcaggggacgggaggcactactgtcgggcccgacaggggagaggtggcctagccgtgggcccgggtgatgtgtatgggagtggggtcctcgccacgttcgccgccagcaccctcccaacttccctccgggctccagctcagtcccgagtcaatatgtccagccccctgtctctgaccagccgttcctactctctctgtgtgacggcttagcctggccagccagccggtgagtggaagcggcggctcctgactcctggtggcggcactgtgaccccctccccctcaacactgcaagtgtgtgcggggctcccccttattctgaggctcctcttcttcttaggcggcctccaccccagtccctggcctggcctgggaggaaacatctgtcgcgccccctggcagccgaaatggggtcatgacctccagatgtgctgggaagtggccagctcctcctcctggggcagccaggccttccggatctgtgggggcggggccggccctttccccccacccctagtgacacaggcccggaggaatgtcctagcctcaatggaccctgtgtgaagcttcagggtggggggcagagcccgagaacacccctcaaggcagcgccagagcctggcactgggccacagcaagaggcagcgcacaggctgggtgcacacatgcacagatctcacttccaagcgtgcagagctcagcccacaaggagcggggcttgcacagaccccctccctcatgccctcctactccttcacacactatagcccaggcccgagcgctgaatgtgcccagagcttggctcatggagccaggggctacacccgtcacacacacacatagctagcgacactcacctcattcttctcagtctctcagcagccttgggaggggacagaaataattaaacccaatttttttctttgtttttttggagacagtctcactctgtcccgcaggctggagttcagtggcgcgatctcggctcactgcaacctctgcctcccaggtttaagcgattctcctgcctcagcctcctgagtggctgggactacaggtgcgcaccaccacacccggctaatttttatgtttttagtagagacagggtttcaccatgttagctaggctggtcttgaactcctgacctcaggtgatccccccgccttggcctcccaaagtgctgggattacaggccacagccaccgcacccggccagttaaccccattttagagatgagaaaacagaggctcaaggtcagcatgggagtttattcaggagaaatcaaggtagaagcacctgggctggggagccgactcttgcttggttctggaggccccagacgaagggtgtgtggagcccctcctccacccccctccggcccagccccgcatgatgttgctggatgctgcatgaagacccaccattagatgcctgtacccccagtggaggttccccagctccctgtcctcactgcctactccatccagggcttgcctgggtgtggcttccctcaagttctcacaccaccatttgcacctgcctctggcgtcacgtttccgcacttagcaggtccctggggctttgggtgtctcaatcttgcatcctgtgagaccttgaacctcagcccaacacccaccccccaaaacctacgcacacagacagcagtgggcaggtgcagccctgcttagggcctggagatgggcagacccaggctcacatcctagctctgacacggaattgcttcaggcaagagcatctcctctggacctcatctgaccatctgtcacatggggttcagacctccctgtctgcatcagtgagaccaggtaggcagaggtccctatgggtccctgtcattgtgactcctcttgcccccaagcctgggcacagtagcctgcaagaaggtgagttggcctgtccttcagggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggtattgaggccttgaggtccagggcactgagatcagacctctctgggtgatcagctctccagggaccctgaaggaagtgggaggggcaaggaggaaggtctctggggacaggacgtcctccctttgttaagtgggcaggacccagacaccagtggcccctgggtttcccgtcccagccaatacaagtcatctgtccggttgggctaggtcctggtgggacccttactctgggcccaggccaaagctaaggtgtgtgggtggcgactgggggaccctggcagtcccagggctgcccaggctccaggaccctcaggaccaagacccaacagcccagcctctagccttgcccagctaagctggggagggggctggaaactttagccctaggcagacaaggaagtggcctggaaagcggaagcagctttgatggtctcggagggggccggaagccaacacgggtggtggaggaccaggctgggggcctgggttcctgttttctgcccaggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaaggtgaggaaaggcagttccagggagtggaggaggggggctgaagaagaggtccctgtcacctgcagtgcacacagtagggctcatgaactgtccatttcctgtaaagtccctggccctgggagggctcaagagctgagctggggtcctcctggacctactttcaaccaccttcttaaggctaatccctggctcctcacccccagccagggctggtccctctgcctccgtattggttcatcctccatctggttcaacctgccaggctggggagagattccctatgggcttttctgtggggtgaaaactcaggcctcaaatccctgcatccgtgaaccttgttcgcaccagcactgcggagagagggctccaggacatagaagggagaatgagggcgtggtgggtggagccaaggcaggatttaggcctgggagctggccgcgtgggtctaggtctgggtctgggtccacctctgggtcagggttgagatcaagatattgagctcggggctacagaggggcgggacttagtctagggtcaacatttggtggtgagatgaagcctagggcggggcttagtgatgcgcgtggtcgagcgggggcggggctgccagagggcgggaccaatcgttttcttcggcgcggtcccccagaacatcagaacttcttcgggatggacgagtcgctgggcccggtggcagtgagcctgcggcgggaggagaaggagggcagcggagggggcaccctgcacagctaccgcgtcatcgtgcggaccacgcaggtgggccgggatcgcgggatcaggacgtgggttgcctccccgacaccttgtatgcatcctgagtgcccttacaccccttcctcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtggtgagtggcgggccgcggagcccccagccatacagctggccccagtctgaacccagcctgcccagctcccaaacccctagccttgaccctgatcctgggctgggtggtgaccccagaagagctggcttttcagagacagggcatcagagttcatctggagccttgcgtctcaaagtgagctctgtagaccagcagtatccacatcatgtagaaatgcagattctggggccccaccccagaccatctgaatcagagtttgcactttatttatttatttatttatttatttattttgagatggagtctcgctctgtcacccaggctggagtgcaatggtggaatctcagctcactgcaacctctgccttccgggttcaagagattctcctgcctcagcctcctgagtagctgggattacaggtgcatgccaccacgcccagctaatttttgtatttgtagtagagatgggggttttaccatgttggccacgctggttttgaactcctgaccttgtgatctgcccacctcggcctcccaaagtgctgggattacaggcatgagccactgcccttggcccagagtctgcattttaaaaagatatttgcagccctagatgccctggtctgactcaccccactggtcctgcagttcccgcatcattcctggccaatttcccccacagcccctgctgggtttcctctaacatgtggtgctcacagcttcctggagcggctccttccatcccccactccatgctgaaagctgcccattggctgagtcttctcctctgtatcattcaacccatcagtcattcaacaaacatttcttagacctttttggtgccaggcctcagactggatgctggggacaggtctagaccaggtgctttgcttgagtagctcacagctgggtgggagaaagagacccacagagaactgctgaaacacaggagcagtactggaacactgaaagggaatgttgagggctgcctgggccacgacggtagtgatgagagcccttccttggccagggttttccagcatggagaacacaaaagggctcaggcccggataagcaggtgttttctggtcagaaggaataacttgtgcaaaggcttggagaatgagagcatggcacattaggcagtcagttcagcgtggctggggttgggattgtggggaggggcgggggagaagcttgcatttgttcccgtggacactggggagccatggagggatacggtgcagatctgagaggggcagctctctggctgcagcatggggactagactgtacggggcggggatgccaggctgaaggctattgcagttgcccaggctagacacagtggcagcgatagtggaggtgaagaggaggtgacagtccaggaaggactgggtagtcatgtggctgactggaaggggtgaagtgctaggatttcccagcttcttggcccccaggagtggtggtttaaggaggaggagcagggtgggggagtcacagcaaggtgagacattaggcagccggagaaaaaggcccggggtttggtaggccggtctgaatgggaggcggagatgggggtgtcatccttgctgcagccagggagggggaggagcatgggtggagaagaggcccaggcagaagagggcggggttcctggggccctaggcaaggtgagtttccagctatccccagtgccacctatggctgagagggtaccaggatgaggccacatctggggaccatatggggagtggggggtgcagggggttgggaggaatgaaatcgaagtggggactgtaagtgcagacaagtttagttgtagaaaagggaggtgaccgctggaggggagcctgtgctgtttggaggagttcagagcaccttgagctgggcatggttatccagttatccgcagagggaagagccgggaagagggcacagaaatgggagcatggggggcagaggtggtgcctggcctgcaggggctggggtgggggtgccttggattcaggggtgcagaggacagtccagccttgagataaggaggatgataatgtgtatgtttattggaagggtcctttctgtgaatcaccttctctactgccacatgggaaccagcctcctcccatcccttcctacctgtgcactcccaagcacgaggagcacaacagactgtactcacctgacaggcaagggcacaagtggctcagagagggctggtgctcagccccaggccagcgtcccatccattccctaagagctggtggggtggggctgcaggggactgagacctatgccttctgtctcccacccacagctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaagtgaggcccaggggcaggaggggtgggagcagatctgtgctgaaggggtgagcacaaattgccttgtcactcctttgtccgtacaatcctggggctggggactggagagttctttgggtgagctaaggatctgagtcagggctatgagggccaagctatgggctgaaaagaggggctgggactgtccctcaaggcccaagtaccctactgcctgagctggggctaaagtggtttgggggcactacccctccaccaaacacattccagcagctcagcctcgtggaagagaggtgcccctacctccctggtggaaggggccccaggacccctgggaggtgttgtactgagcaccccctgcctgcttttcactttcccagcatgccacacatgcttgggcctggagtgacacctgtcctcctaggacacctgaccctgccctccctctgagaccacttctcatttctgtcttcattctatttcaactctcccatcctgaccccccttcactctggcatggggctggagcctgtggagggagaggaggaggggcacccagggctgaggcccttgaatctcgctggctgggcattggctggtggcatgactggttgtccacctgctgtttggggcacagaggctcctgtgtacaggcaggaatggcaagttcaagccacttagattccccttgttttctccttctgtgtccctaacttcctggccacagcggattccacaggcacgcactccctctacaccacataccaggaccacgagatcatgttccacgtgtccacgatgctgccttacacccctaataaccagcagcaggtgtgagggggaccaacgtgggggtggggcttccgggaaccatggagggccctgcatggcccatgacgtttgagctttggccggagctctgttggccccaacagcccgcccctctggtggccccttcccaaagacagaaacaccctaggtcttcaccaggggcagtgggggagccattggtgccttggctttctcctgcctgaatgaggaggggtttggggcacagaagacctcatcacgagcccctactatccaacccctagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacaggtgggcaccggagtggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcaggtgagctggagtggtaaactggggcccctgcgcgcggcggggcggagcctgctttggacccctccctcccgccgcctttgtcccctactcctgcggaagggaaagtcgaggagggcagagccagccccggggcttggcaaggccggaactggtgccctcgggtaagcgacttctggtcttcatccctcgggcggtggcacacgcggccctcggggactgtggaaagttccgtgtggcctgggacgcagtccagggggcgggcgctggggcggccccacctcccggcagccccgcccactcgtcccgccccgtccgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagactctgcccagcctccggcccgaggccgctgcccagctcctgcgctcggcgcccaaggtctgcgtcaccgtcctgccccccgacgagagcggccggccccgcaggtcagggtgccggggacgcggggaggtgggagggccggcagttggccaccgcgcagtctgcgcctcccgggtcgccatcagcagtttcaggaacccagtgtggatacctttccttctggaaagaatctcccgtctcttagcccgtctgagcctgtctcttcctgtctctgtctctctctctttctctgtccttccttcctctctctctcctctctcttttttttttttttgagacgaagtatccctcttgttgcccgggctggagtgcaatggcgtgatttcggcttactgcaacatccgcctcccaggttcaagcagttctcctgcctcagcctcccttgtagctgggattacaggcatgcaccaccacggccggttaattttttctatttttagtagagatggggtttcaccaagttggccaggctggtctcgaactcctgacctcaggtgatccacctgcctcgccctcccaaagttctgggattacaggcgtgagtcaccgcgccctgaacctctatcttcatatgtagaatgggaccagttaagcgcgttgctcccactgcttaaaagatcaaatagcagcccccactatctttttttttaagtattggcacccgcccacccaacacacacactacacactattgataacttcctgtgctaagccaggggtaggcaaacattttctgtaaatggccaaataataaatattttaggctttctggaccatctggtctctgccgcagctactctgtcgtaggtaaatgaataaataaatgtgcctgtgtctcgctaaaactttatagacactgaaatttggattttacatgattttaacttatcatgaaatattcttttgatttttccactagttaaaaatgtaaaatccggaccgggcgcggtggctcatgcttgtaatcccagcactttgggaggctgaggcgggtagctcacctgaggtcaggagttcgagaccagcctggccaacatgctgaaacccgtctctagtaaaaatacaaaaattagccaggtgtgatggcaggcatctgtaatcccagctacttgggaggctgaggcaggaaaatcacttgaacccaggaggtggaggaggttgccatgagctgtgatcgcgccattgcactccagcctgggcaacaagagcaaaactccatctcaaaaaaaaaaaaaagtaaaatccatgcttagctcgcagtacagaaactggcacatctgctttagaaaagaaaaggaaaaggcacaggctggatttggctacagacagtagttttgggatttaagcaatttacacgtgttatttaaatcctcacagcacactatgaggttcgtactattatccccatttcacagatggagaaattgatgttcagagtgatttgcttgggatatacaggggcagcactggaatttgaaccatggtctggaaaaatggccagtaaccaggcagacatttttcactgttgtcaggatgccggggagctctcctgctcctggaagtgagcctggcgggctgggggtggggctagtgatgcaggacgctggggactggagaagtcctgcctgaccctgtcccaccccacaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcaggtgcacactcttggccttccctctcctccaggcctctgggaaagcggcttccctttctgagccacccctgctctccccagctctctgtcggatgaggccccagtcctgcccaacaccaccccggacctcctcctggccaccacagccaagccatcagtacccagtgctgacagtgagacacccctgacccaggtgagcagaaaccaggctctggagcccaacagcacagtggtgacagtgggcatcactgaatctgtatccacttctgtggcacaggacaggccaggcagtcccagtggctctgaggacaagggcaacccggcgccggagctgagggcctcctttctgccacgtaccttgtctctgcggaactccatcagcaggagtgagtctggacccaggagagcaggggaggggttggggggtgctcctgggcttccctagctcagcctgctccttgtgcccacagtcatgtcggaggcgggcagtgggaccctggaggacgagtggcaggccatctcggagattgcctctacttgcaacaccattctggagtcgctgtcccgagagggtgaggccaccagggtgctgcggtaagcctgggcagtgctcttgccccctttctgacctgcccacctgatccctttgtccccacaggacagcccatcccagagagtggagaccctaagggaactccaaaatctgatgctgagtaagctccccaactccccacagccgctttacctgcccacatgacccccccttcgtgcctgtctgctggggtggagctctgtcctgggctctgctgccacatatgcctagaagaccagcggggcccctctcattagctggggctgggagtcagctggtgcactgccccctgccttggtcctgctgagtcttgacccccatgtcttcaggccagagcctgggaacctctcagagaaggtctctcacttggagtccatgctcaggaagctgcaggaggacctgcagaaggtgaggggtgggctgagcttggggggagtcacagggctgccccaggaaaggggctggcggctctgactcctgtctccccggcaccccaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaacatgtgtccaagacagggcagggcaaggggttttgcctccagaggccccagccaaactcctcggaccagtcaggacaggccctgggaacactggctcagagatgggctggcactcactgaggggtccctgaggccaggccactgcttggcttctctcccataacgtttatttggttctgcagggaagcaggtggccacaccccacagctaccctggccgtgcatcacaaggccctgtgcctcagtgcaggcctcactcttctctctgaagccactgagcccccaggccttgtcctctctctacccacctggccacttcttgcagggcccaattccagaggcggtggcatctccgcctcagttgactggggctgtttctatgtcctggaggaaacgggcccttgacccacttccctcctcaccagcctatggtcctctctgttcctcgcgaggccaggcctttccccgaagtggcatcatcaagtccaaacttgggactttgtctaaatcctttggtttctggacctgaggcccagatagggcagacttgcccagcatctcatgcctattccagtcccttccctaggctggctgaagctccatggtgagacctaggccctgggtctgttaacttaggtgctggcaggatgagctaggctcggagaaacagagcatctgaggatcaggaaggcttcatggaggaggtaatatgagggctgagttttgaaggctgggtaggagttcaccaggcagagacgtcagaggtatcctggtaggaccagtctggctgaggcctgctggactagagccaaggcacacccaggaacccagcgtcaaagaagccagatcagaaagggttgtgaaggtgcactagggatcctgggttagcagttcccaagactgccactttttcctggttgtggactagtgtggaaggctgtggtcactgagggtgtgtctgcagaaaactcggatctggtcttgtggttgatgtttgaagggagattgatggggtgagatctggatgtcagagctctttggctgcagggaggcggctgtagccgcagtccagtgggaggtctagtggtgacttaaactcagtgatagcagtgacagtggggagaagtgggcagattttccaggacctcgtggaaggactggacgcaagttactaagggaagaggcggcatctacggtagtggccaggtttccggctggagcccttggaaggtggcagggccagggctgacagggaaaaggagaggcaggctggggatggctgaggtcatttggaacaggatgagtttgagaggcccgaggacgtcagagtggagatgtccaggggctggtgcgcaggggagagagatctgggttggatacgaggacttggagctgctgagccatgagcatgatggggtcattcacgaatgagagaagaaccaggagaggtcttcgtgggtcacgggaggtcgcgggaccgagaaagccaagaggagggaggcgcagcctgggctgcagggccttggctccctggtttccctctgggcctcgggtcgcggacctccggtcggggtccctgcgcagctcagccgtcggcttcctcagcgttaggagccttctcaccccgcccgcttcctccccgaccccgcctcccaggcgctccccggcagcttcgcccgggtcctgacctggccaccgcgagcccgggctccgcccctcgcgtgggagttccgccgaggcccgccctcgctccaagccccgcccctggccgcccccccggagccggagccccgtggaaaacgccacttcctcgacggaattggcctgccgtctcgccggcgccgcccgtcggagcctgcacccagggccttttctgttcctaggagactcgctgaattttgggacgcgtcccgctgacgataactccttttcccctgctattgtcctcccgcgacggtgcgaagcccaaacgaagacgccatcggcctcggcggggattttccccagacgctggacccggcctccggttgctgcgggctccttgtgcgcctgcgcagtcgagaagggggcccacgccggccagcgctttttgctgctgcgcttgcgctggggcaaagcggaagtacgtccagctgtagcccttgtgggctgcggctgggcctttgttttggcttcctgaggctgtggattgaagatttcaccgttcctcccagaacagagtatcaaagcatcggtgggccgggtagatctttacctggcaccacacattccccaagagaagcacacactccctgggccacccaaggaatttggccccatcacatctttcgaacatcgtttctcttacctctgacgctggctagtccctctttgacatccactctcagctgatctaagacctggagctaatggggcctcttggaagactcctgaaactgctccatccccacagccagcgggctctactaggctctcagtgtgctaggactcttgccttagctgcccgttttcatccactggacggtaactcggggtttccaagggcattctcagactgcaagctctcagaggacagtgcacgcattcacccagctctctaccaccaatgtctggcctgatgtgactagcaaaatgtgtgctcagtgtttgctgaaaaaaagcggatctctagccagcttggcaacagatttattagttcagagtagaaagagcaagagtccaagtgctttgattgttcagtaaaaactatgcctcctgactggagagctgccagcctgctctcccccactcttaacaacttaccctactattaaggcacttgagaagagggagagcaaggaagtcccagaccaaaccccttctggatcctggagagagccagtgctgttgcactggtttccttcagccatggttgagcaaggaaagagccggcagagacctctgtagggcaggaaggccagcccctcaaacgctggtgttaggcacagggacaatgccagtgccatacaggggctggtatctggggcgttattttgattaagctgtaatgaatccatgatggaagacacttgataaggctttgtgggctcaaaggccttacctccagcctgcttctgtctctaggagagtaccagaagctggaggatggggatgggggaccccagagttccctacagagaagggagctgaccatcaggacaggggaaaagtttgagtttccccagctcccccctttccagagaagttaatgcttctgcttaagcacctccaaaaagagagagagatacagatactgacaataaaagaataaaatatggctcccccctccaaggaagacatccacaaagttgggggcagttggaacacaccccaccagaatccgtaagtgcttttggagggcttcaatcccctgcaacccagtgctctggggagggcaggcgtcacccccttaggagctgatctgactcagcagggctgagaagtccatgtccgcaatggaggagaagtcttcatctcctgaaaggaggccattggggagccccggggcccccagtggagcaggagctgggtcggggggcctctgggcccctgtcactaggcgagttatagcctcagggtactccatcagcatgggctcagttgtgtggggggccacaggtatgccctggttcagcagctgctgaaactcggagttgtcgacggatgccaggtctgtgaacacagctgggtctgtgctgttgccaagcaaggcccccaggtcttcatcatcaaactgcagctgcagcagggcctctgacagcgttccttccccagcctgggtgggcttgggggcaggtggggccacagcctgaggagggcctggggctaggactgggacaggggctggggcctgggccagagctgataccatggctggagcaggggcaggggctggagcctggggcaggacttggggaggggccggggccaaggccgaggcctggctgatctgcccagaaggaaacaccatggtgggaaactcatcatagttgatggtgctcagggatgacgtaaagggatagggctggggtgctggaggagagagacagagaggcaggggtcagagaaagccctagagatccaccccgtcctctgtaccccagcccctcttcatggtgctcaggctcaatccctctctagggagtcactgccaacaccctatctccttcctcttaccccatctgacccagcctgtagggtccagttctagccacacctccaccttggagtcctccctgactactcaagcccacgaaactcttccagccttttagaggaagggacacttggagagataagctggactcctcagtttacagctgaaaaactaagtcctgagaggcaatgagcccatggagcaccaagtgagcagcggcctgaagtgcagagcttgtcagtttttgagcctcgcacaggcacacacatcttgctaatttagaggtgatttttgttcccccaattcaagtgagagatgagagcagagattctgcatttttaacttctgattcccaagatacccaatatagaatttaagtggcacggtggttcccaggcttcagtgtgcattagcatcccaggaagtcgctggttcctgcgccatcctttcaaagcctctgattcagtaggtctgtaatggggcccaggagtcttcatctccactgctcctcagctgaacagagctgaacctgtcgttccagtgggacaaaaggaaatccttacctggcttggggacagaagctgagctgcgggaaggcacagcaatgcgtcgaggtggaggccgggggtcggtgggtcctgtagggcaagggctaggtcagttctcagccccagggtgtcccctccctgcccgctgccttcctctctggctttcccagtccccatctcaccgctgaaaggactcttcttcatgatgctcttgaaggtctcatatgtccttttacgtttctcctcaatccggtgacgatcgtctgggaaagtaagggggagaagtgggacttgctctcctcaggtgggtccccgacgctctcaaaggtccctcaggaggaaggggaggagccaggctttcccaagacccattctcccaaccttctctgccaatgagaagggatgtgtgacactcagcagttctgagaatcccacagcttttggaggcctctgttggctgaatctgcccctctaagaccacatggtgaggccgagtacaggggccatgctctgggcaaagaggagacctggggggccccagcctccagctcacaccttcctgcactgctcacatcctggctcattgtcagcctccacccaggcctggcgagaatttcttggcactctggggcagctgaggcacaactgccttaagacttcagcagagactcttattcttatctctaatggtttcatattttagtcagagctttcagaactgtctttctaattacagtggtatttcagtagctccaaagcacttcaattccatcaattcaaagacaacctcatcatccctcaaaaactaggttctttctcctgcattccctgaccatccgccatctgccctgtcaccaaagctagaaaccttggaatgattatcttcttttctctcactccccgccagtaacttgacatatatttatcaagcacctactatgtgccagcctcccttctagacactggggatgtggccgtgagtatgcacacaaggtgtctgctcccaaaaagttggcatcctagtgaaaaagtgagagggacacaatcatatatacaaaccagaaaatctcggccaggcgtggtggctcacgcctgtaatcccagcactttgggaggtcgaggcgggtggatcacgaggtcaagagatcgagaccaccctggccaacatggtgaaaaccccgtctctactaaaaatacaaaaaattagccggatgtggtggcgggcgcctgtagtcccagctactcgggaggctgaggcagggagaatcacttgaacccgggaggtggaggttgcagtgagccgagattgcaccactgcactccagcctgggcgacaagagtgagactctgtctcaaacaaacaaacaaaaccaaaccagaaaatctcaagtgacggtggtccagggacgatatggtgatgtaacaatactggaagtgaggtcaggacagtctaaatgtagagggaagggctaatttagaggtcagggaaggactggcatgagccacttgcattaaaaccttgggcattccaagcagaggcaacagctagacacaggtcctgaggtgagactgagcttggtctgtaagacgcaaaacggctgcagggctgaagggtaactgaggacagtggtggagatgtgatcttgctctgctattccttctgtaaggtttgtgccgcatcttctcttcctggactacagcaacatttccagaatggcctccctgctttgagtctgtctgtctctgatcttctacacgtggcctcctgagtcaacttccaaatctgctcctgtcacctctctgcttagaggccttcagcttaaccaggccctccaatctctgagcctgctcactgcccaacatcagctcaaaccacgaaggtggccctgaataggccgtgcagttgccaacaccccttcccttccaggtgctgggccacctgcctggagaacacacttctgtgtctttctccagcttcaatgccaccttctccatgcagctgtctccagctccccggaggccactgtgcccccgtgcttctctgcgcacacctccatttcacatgtcattccgtgacttaaggatctgttttgcacatttgtcttcctcaagtgactgagactctgaagggcagggagcatgtcttactcattttttgtattcacaatacctggcacaggccctggtaccaagtggacactcaaacctcgaccaaaatgtggctgggctgtatggtagtgacaagacaaccagtgtggcaaaaggatcctgaagccagatggcctgggttccaacgctgactctgctagactctgctacttactagccacgtgaacccaggcaagttggacactatctcctacttcaaaagggtcatgagattaaaatcaggtaatccagtgaagtgcctggaataggggcagatgtgtagtactagctcaatgtctgaggtatcattattattaaatgaggcaagaaatggattccagtttcttggatcccaagctctgactccagcttctggccctcaaccacagccccagacatgcagtcttggcctctctctcacggcacagagcccagctgccctgatgctgccaccccagctgtgtacctgtatctggcaggtactggaattccatgggctcactgagctcccggtcggaaggccgccgcagctgcatggagacacgcacaggagcctgcaggctggggtctgcgtagggaggggtccggaacacaatggccacttgtcggtgcacatcagcttgcgaaaaggagcctcgggcctcccagcctggtcccgtgaaatacacctcaatgtcctctgcaggagatgcggtggcagtgtgggtcagtgtgtctaaccctccatggtctccccctcaacttctgatgcttgtcttctgatacatcacccttcggcccacctgaggcccccgaggcacaggaggaagtatccaaagccagttacctgacactccacttctctgctcagcttcaccccttgctcccaagagcccacccctgcctcctgatgtatacctttctgcaccttgtcacacagtaggaagatctcatccccaccgaggcagctgccagagtttcggttcactcggcagatcttgagctcggcagtgttgggggcacctgaggcagtgaaaacaagggaggatgacctgagccacgagaggtccccagggtggcctgcaggagatgcaacttccctgcccagcccagagtcaaggttgcccagagcttgccacctacacctttgtagccaaagtcagaccttcttattagctcctcaccccaaccgattcaacaagtatttgcctactgtgcactcaacactgatctaagcaagaatacgaccacacacaaaacccaaacctctctgctctcccggagcttatagtccagtgggtgccaatctgatcacactctttctccacctgaccaaagcaatctttaaggccagtccatacccaccttggcaatgagcccttccctcctgacccccagtttatcctggtttcccatccttggggctccagattcgttttatttccattcatcctgctggttacttaactaaagactgcagctgatcagtcagcccaattcatctgtgggcttccatcactgaatcatcattctcgaacactatcttgttcctgggagttcatttcctagagtcattatcgcagttgtgggcacaccaccttctcatcacacaatactgaaaatgcccatctcccatcagactctctgctagacttcctgccaggccagagctacacctcaaggacagctctgggtcttctttgccctctctccccagccaacaaagagctgggcagagaagagtagacaaatacgcaagatgattgaatgaagccagagcgcctcttgcaggccacactcaccccaacccccttcctcctattcaggcccaccctctccccttcctgcgtctccctcgctactcacgattgtcaaagatgggatgagaaaggacaggcggcaggcggaggggcctgcctgatgggtcccgcactgtcacctggaagcagagccgcacagcattcaggtcgtagtccccacgctgctcttctataggaactgccaagaaaacaggcgatcaggagagcaggggaagtggggatataggtgctatcagtgggggcagggagctctgcgctgggagggccgctggtgcgtgtgtgaaacacaagtcctagaggaggcagaacccagcactgactccactgtggcctgaatgtcatgtcccctcctgggactcagtttcccagtggtaaagtgggagagtactgaatgggcaccaagattccagctttactgtgtcttggccagtgagggagatgcaggaaaggcgggctggggagggtgacagagggtgcgggtgtggcaggcaggtttgccctcaccttggaaggggttgttgttggtctggatgcgctgactgatagcctgctccaggtcccgcttcttcacacactggattcccaggttctggaaactgagcgcccccagtcgtctgtcccactgtctctcacagagcccagaccttcctgccttgcccagcctgctccttcctactctgcccacccctagatcatcgctccatgcctaaccctctccagtggcttcctactgtgctgcaacgaaccctgtcccttcactcagctgacaagcacctccgtgcccctgcccctgccagcctccctgtgggctccctgcttacagccaccggggctccttttccactctctaaacacaggacactcattcccacctcaaggcctttgcacttgtttggtcggcttggaatgttcttttcctacttctctcctccttctcaccattcaagtcttagctgagggaggccttccctgacctcccaatctaaagtcatcacacaccagctcccctaactcccccaccccaggttatccttctatcctatgacctcgttttattttcaggactgaaactgttactctgacagcaccttgtttatttatctgtgtatttatttatttttaagagacacagtgtcgggccgggtgcggtggctcaagcctgtaatcccagcactttgggaggccaagacaggcagatcacaaggtcaggagattgagaccatcctggctaacacggtgaaaccctgtctctactaaaaaatacaaaaaattagccaggcgtggtggcaggcacctgtagtcccagctattcgggaagctgaggcaggagaatggcatgaacccggaaggtggaggttgcagtgagctgagatcgcgccactgcactccagtctggggacagagcaagactctttcttaaaaaaaaaaaaaaaaaaaaaaagacaaggtatcgccctgccacccaagtgcagtggtgcaatcatagcttgccgcagcagtgacctcctgggctcaggcgatcctcccacctcagcctccctgggactataggcgcatgccaccatacccagctaatttcttattttttgtagacatggggtctcactatgttgccttggctagtcttgaattcctaggctcaagagatcttcctgccttggcctcccgaagtgctaggattataagcatgagccactatgcccggcctgtatatttttttacagcctgtctctgtcaactgcaatgtcaactccaggggagagtgctggttcaatggttttcttcctcaaacaagagacgtgactctgagggacttgtccttccagctacaggggtcaggaattcagaagtgattagggacccatccgtatcccctggaactcatctgctagagtaaacgtacaaatagataatttcaagacaaaggcagtttacttgcagagctgagtcagggcaaggagtgaggaattctgccctgggtccagaaaggagtaacactgtagcggctacttcatagcccgcctcctgtcccctcatgctgggcctcctagcctgcagggacctcacctgtggatgcagcggtccgggcagagctcagcctcatagaagccatcccggcagtcctttcctacaagctcgtgggggtgaggccggtgaggagggtccttggtgaccagggagatgcgcactgtccctggtcctgtgtagccattgatctgtccaaagtacagaggcccagacatccaaacctgactcccaaacacagagggctggggttccacagtcccttccccgcacaccctggcgcagtgctgaccttgatggtggggtgggtcttggtggtatctgtgctcctctcgcctgggatgctgcccgcggagcgcccctcgcacttgtagcggaagcgcatgccccgctgcttgggctgctcaatgatctccacataggggccagaggcctgggctggctctgccaggggacaccgcagccccattaggcggctgcccccactgccctaccccagggagcacctccccgaccgccgcgggggccacttacctgccgggaagatgagggggaacagttctgaaaggggagggagatcagggtcagcacacacccaatgcccattctcacaaggaggaatctgctctccacggagaggagaagccaggctccctcccaggggaactgagtcaggacctgctccctagaacctgcggtgaaactaaggggtggaggaaaggaaccagaaacacctgcttcttgagggaaaacggggtaaggaatccttcttctccagagggaagctgaatcagggcctgttgtactttcttaaggaaaattgagggagggcacgccccacctccctccagagaggaaactgaatcagatgcgttctcccctaatagggaaacgaagccagagctgcccccatggacggtgtggagggaaactgagtcaaggttccctctgctcccccacccagggaggatgctgagtcaagggccaccccctccacccagaggggaaactgagtcagacccctccccgcctgccccgccccgcgccaccatccggcaggccgaccgctccctgcgcagcgcccgtcggcgcaggaaggggcggaaagcggcgcgggggctcccgccacagccgcggcggccccggcgatgccaccccgcggggtcagagggcgacctcaccgtccatggccggggtcccgggggcggggccggggtcgcagctgggcccgcggcgtgcactacagacgagccattcgccagaggcggaaatgcgccgcgcggcccgccgtcgcgtcactgcccggaatccggccgcgcctgcgcgctgccccgccgccgcccggcgcaggggccgggagcaagtgcacgccgcgcggaggacgaagaggctgcacgcacagccgctgccgggggtcggggccaagtgcgcgcctcgccgaggacgaagaggctggcgtgcccggtggctcggctagctcccgggtcccggccccgcctggagggtgggtccgccgattactcactttgtttttaggggatttcagggccccctcccgccgatcggcggagtttggtgatgtcactctgggccgggtctggagcaaagccagggctactgggctgcggccgcccgccccgcgcagggaaaagcccgaccgggccttctgctccgcagaggccgggtggttgaactccgcgcgggtttcctaaccgctaaaggtgcctttcggtggtggctgtctcagaagcacgttaaaatgtcctacccaccccaatctagatgcggctgtgggggaatgggagcggccggacctcccagcctgacagtgcatcaagagctttgcggagcctacagcccggatgggacgactgaggccctcccgctggcgagctggccgagggctcgtccctctccagctaaagcgccagcttacgatacagccaaactgccggctctcatcggctgtgggagcaggaggcccccaggggtaaatcccggagcctcgtctctgaagcctggcgcttgtgtctcagaaggtgcgggacccacagggacacttgaatcagcaggctcacgaccccccacccccctgcccccgcctgtgtttgccctggacctccagctagggctgaccactaattctgtcatgtgaccccacagtgcaggtagctcccccaagaccaagcccaaggcgcgtccgtgtggaggctggggctgacgcacccccaccccaggcctcatccccaaaggaggatgctccactgcagggggcggagtcttctccagatggagaaagacttttttattttctctgaattcgtcttaaattaggaaatcatgtgggaattggaaaagattggaaattctgacttgtttcccaggctctgaagaaacaggaagagaaaagtgaaaatagagttagcaccccgcccactcatttcagtttctccagtggctggccctgattagaaaagtgtttacttttggcagggggcgggggaggccgacttcaggtgacagaatggattaattaaaatctttggttaatgatatacaattatcattgaaccttgcatggatcctcttcttaaaattcatgtatatttataacttttaaattaatacgataaacacccatgtacccattgcaaaactcaaggggccaccaccatccagaattctgtattgtattgtattgtattgtattgtattgtattgtattgtattgtatttatttatttatttattttttgagacacggtctgtctctgtcgcccaggctggagtgcagtggcacaatctctgctcactgcagcctctacctcctgggctcaagcaatcctcccacttcagcctcttgcatagctgggactacgggagcacaccaccatgcccggctaagtttttgtattttttgtaaagaagtggtttaaccttgttgtccaggctagtcttgaactcctgagctcaactttcctccccgcttggcctcacaaagtgctgggattacaggcgtgagccaccacgctgggccagaattctgtattttttaaattaattaattaattaatttattgtaaatagagatgggtctcactgtgttgcccaggctggtctcaaactcctgggctcaagcgatcctcccacctcagcctcccaaagtgggattacaggcatgagccaccacacctggcccagaattctgtattttaaagaaaaaaaaagttatatctgcatgcctacacaatatatcttttggttttccttagttttgaacttttttttttttttttttgagacaaagtctcactctgtcgcgcaggctggaatgcagtggcattctgcttactgcaacctctgcctcctaggttcaagcgattctcctgcctcagcctcctgagtagctgggattaaaggggccaaccaccacgcccagctaatttttgtatttttttagtagagacggggtttcaccatgttggccaggctggtctcgaactcctgacctcaggtgattcgccagcctctgcctcccaaagtgctgagattacaggtgtgagccaccgcacccagccagttttgaacttttatgaagagggcatcatatgatttgttgtcctttgttacttgcttttttcactcaacctgttactatgattcatgtttcacagttaattcactttttcactgctgtatactattttgttgtgtaaatataccacagtttgtttattcatcctgaagataggcatttttatttttatttttttgagatggagttcctctcttgtggcccaggctggagtgcaatagcaccatctcggctcactgcaacctctgcctcccaggttcaagtgattctcctgccttagcctcctgagtagctaggattacaggtatgcatcaccatgcccggctaattttgtattttttttttcttttgagacagagtttcgctcttgttgtgtgcaatggcacaatctcggctcacagcaacctctgcctcccaggttcaagtgattctcctgcctcagccacctgagtagctgggattacaggtgcctgccaccatgcctggctaactttttgtatttttagtagagacggggtttcaccatgttggccaggctggtctcaaactcctgaccttaggtgatccacctgcctcagcctctgaaaatgttgggattacaggcatgaaccactgcatctgactaattttgtacttttagtagagacagggtttcaccatgttggccagggtggtctctaactcctgacctcaggtgatctgcccgtctcggcctcctaaagtgctattacaggcgtgagctaccgtgcccagccatgggcatttggacttctaattttttgctgccataagctttagagcactgagtaatatataaaaacagcaatcatgtagtttttaaaacttagtctggggttaaagaagtatgtaaacaactatgttttcttaaagatttataggagcattgtgactggaccaaggacaaagaagttcccaacctcctcagaccctcgctgctgcccagatgtctgccatggggtacttcttgaccacaccctccttctcttccctgcccttaacatagaaagagcctaagattgtactgacttaaaatggtactttagaacgctagtacaccgtcctctcagtcttgctggctttcagaataaatcagtaaacctactttttctcccaccaacgcccctatcagttgggatcctcttacctcggcctcccaggtagctgggactataagcactcaccaccacacacagctaattaaaaagaaaacaattttttgaggcagggtctcactctgtcgccatgctggaatgctgtggcatgactcgttgctcactgcagcctcaaactcctgggctcaagcaatcctcccaccttagcctcccaagtagctaggactaacagcgtgcaccaccacactcagctaatttcttttttttaatttttagtagacacaagatcttgctatgttgccaaggctggtctcgaacctctgagctcaggcgatccttctgtctcagcctcccaaagtgttaggattacaggcatgaactaccaaacccggctgagttttttaaaatcttaatgaatgcatggatttaaatatattagctgtgttttaatcaagtatagttattgaaattcaaattattcgtctttggttagggagaacttcttcaagttggttgttcttcagtccttttgacacaattccaatatatgagtcttggtggctcatacctgtaatcccagcactttggaaggctgaatggggaagactgattgaggccaggagtttaagaccagcctggtcaacatggcaagatccctatgtctattaaaaaaataattttaaaaaagcaattacagtagcctgtgatagcttctttgctgtttggtatgaaaagatatttcttttctttttccttttttttttttgagatggagtttcgctcttactgcccaggctggagtgcaatggtgcaatctcggctcactgcaacctctgcctcccgggtgcaagcaattctcctgcctcagcctcccaagtagctgggattatgggagtgtgccaccacgcccagctaatttttgtatttttagtagagatggggtttccatattggtcaggttggtctcgaactcctgacctcaggtgatccacctgccttggcctcccacagtgctgggattacaggcatgagccacagcgcctggcctgaaaagatatttctagactcatctagtaaattttctgccccagatctggaatcagacagctttccaaggagtcctgatttctcttagtaggaaatgatatttaaagactacagcttgagtacttcggatacttattgctactgagtcagtcattgtagatgttttcggtgaatagttagtactttttttttttttttttttttttgagacagagtttcactcttgttgcccaggctggagtgcaatggcatgatcttggctcactgcaacctccgcctcccgggttcaagtgattctcctgcctcagcctcccgagttgctgggattacaggcatgcgctaccacgcccggctaattttgtattgttagtaaagacagggtttctccatgttggtcaggctggtctccaactcctgacctcaagtgacctgcccgcctcggcctcccaaagtgttggaattacaggcgtgagccaccatgcccagccagtaattttttaaaaaatgggagtcttgctctgtcatccaggctggattgcagtggtggtgtgatcatagcccattgcaggctcgaactcctaggctcaagtgattctccctcctcaggtcccccagtagctgggactacaggcacacaccaccatgctcagctaattttttattttttagtagagaagaggtctcactatgttgcccaggctcatcttgtactcctgggctctagcactcctcttgcctcagcttcccaaagtgttggaattacaggcatgagccattgtgcccagcctagctggtaatttttttttttgagatggagtcttgctcattcgccaggctggagtgcagtggcgcgatctcggctcactgcaacctctgcctcccaggttcaagcaattcccctgcctcagcctgctgagtagctgggactacaggcacgcgccaccacaccctgctaatttttttgtattttagtagagacggggtttcaccatgttggccaggatggtctcgatctcctgtcctgaccttgtcatctgcctgccttggcctcccaaagtgctggaattacaggcgtgagctaccgcacctggctgtaattttttttaaatacgaaatgcatcaggagttcatactaatgtttcatattcaaatttagaattatagggtttttaaattttatttatttattattattatttttttttgagatggagtcttgctctgttgcccaggctcactgtaacctctgccttgtgggttcaagcagttctctgcctcagcctcctgagtagctggaattacaggcacctgccacaatgcctggctaatttttatatttttagtagagacggggtttcaccatcttggccaggctggttttacactcctgacctcgtgatccacgtgcctcagcctcccaaagtgcagggattacgggtgtgagccaccgcgcccagctagaattacagggttttaacttaaccttagtcactttacatgtttctcccatgtcaaaaatcttgattttcttttgagggaatagaaaagtccactcttaaattaagtccatatggagtctcaagggacccaaataaccaaaacaatcttaaaaaaaagaaacaaaggtggaggactcatacttcctgatttcaaaacttactacaaagctacagtaatcaaaacagtgtgattctagcataaagacagacatataggccgggcgtggtggctcacgtctgtaatcccagcactttgggaggctgaggcaggagttcaagaccagcctaactaacatggagaaaccccgtctctactaaaaatacaaaattagccgggcatggtggcccatgcctgaaattacagctacttgggaggctgaggcaggagaatcgcttgaacccgggaggtggagattgcagtgagccgagattgagccattacactccagcctgagcaacaagagtgaaactctgtctccaaaaaaaataaagacagacatatgaccaattgtacagaatagggagcccataaaaataaaacctttccatatacggctgaatgattttcaacaagggcgccaagaccattcactgggggaaaggacaatcttttcaacaaatggttttgggaaaattgggtatccacatgcaaaagaatgaagttgacccttacctaacactatatacaaaaattaactcaaaatggttcaaatggctggacctggtgactcacatcagtaattcccgcactttgggaagccaaggcgggaagatcacttgagcccaggagtttgaaaccagcctggtcaacatagtgagatcctatctctacaaaagaaaaaaaaaaaaaagaaaaaaattagctgggcatggtggtgcatgcctgtagtcccagctactcaggaggttgagacggattgcttgagcccaggagttcgagttcacagcagtgagccatgccactgcactccagcctaagcgacagagtgtgacgctgtctcaaaaaaataaagaactggggccgggcgcggtggctcacgcctgtaatcccagcactttgggaggctgaggcgggcggatcacgaggtcaggagatcgagaccatcctggctaaaacggtgaaaccctgtctctactaaaaatacaaaaaaaaattagccgggcacggtggcaggtgcctgtagtcccagctagtcaggaggctgaggcaggagaatggcgtgaacctgggaggtggagcttgcagtgagccgagatcgcgccactgtactccagcctgggcgacaaagcgagactctgtctcaaaaaaaaaaataaataaaataaagagctaaaaagggaccaaatacctaaatgtaggacctaaaactataaactcagaaaaaaacatagtgccccatgtttttgattgcttatatgttattatttacgtttttattgtttatatgttatcatttatgttgtataatattcatgacattgaatttggcagtgatttcttggatacaacataaaagcacagaccacaaaagaaaaaaataaattaggcttataaaaattaaaaacttttgtacatcaaatacaatatactgaagtaaaaaatcaacccacagaatggtaggaaatatttcaaattacatatctgataaggattaatacctagaacatataaagaactaataataggccgggcgccgtggctcacgcctgtagtaatcccagcactttgggaggccgaggcgggcggatcacgagatcaggagatcgaaaccatcctggctaacacggtgaaaccccatctctactagaaatacaaaaaattagccggtcatggtggcgggcacctgtagtcccagctactcgggaggctgaggcaggagaatggtgtgaacccgggaggcggagcttgcagtgagccgagatcgcgccactgcactccagcctgggcaacagaacgagactccatctcaaaacaaaacaaaacaaaaaaacaacaaaaaaaaacacacaaagagataccacttcacacccattaggatggctgttatcagaaaaataaggtaacagctgtttgctgagaaatatggagatgtggagaacacgtggagaaattggcacacttgtgaattgctggtgggaatgtaaaatggtgcagtcgctctggaaaacagtatggcggttcctcaaaagaattaaaccagaattaacacatgatccagaaatttcatagtactcaaaactactgaaagcaggaactcaaattgatatctgtacaccagtgttcatagcggcattattcacaatagccaaaaggcggaaacaacccaaatgtccattgacgcatgaccagtgtgatagttaatttcatgtgtcaacttgaccagcccagggaatacccggatagctggtagaaaattatttctgggtatgtctgtgagagtgtttctggaagaggttagtatttgaatcagactgagtaaaaggatccaccctatccaacataggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtatctgtttggttctgttctggagatcccggattaatgcaaatggattaaaaaaatgcggccgggcacggtggctcatgcctgtaatcccagcactttgggaggccgaggcaggtggatcacttgaggccaggagttcaagaccagcctggccaacatggtgaaaccccacgaaaccctgtctctactaaaaaaaaaatacaaaattagctgggtgtggtggcgcacgcctgtaatcccagctacttggagggctgaggcaggaggattgcgcgaacccaggagacagaggttgtagtgagctgagatcacaccactgcactccagcttgggtgacagagtgagactccatctcaaaaacaaaacaaaacaaaaccccaaaatgtggtatatacatgcaagggaatattattcagccttaaggaagggaattctgatacatgctgtattgaggagccttgaaggcaacatgctgagtcaaagaatccagacacaaaaggacaaatgttatatgattctacttatgtgagatacctacaatagtcaaattcatagagaaaggaagtagaatacccattacaagaagctggagagaaggggaaatggtgagttaatgcttaacaaatgcagagtttatgttggggatgatgaaaagattctggagcaggatggtggtgattgatggtagcacacagtgtgaatgtactaagtgccattcagtggcacacttataaatgggtaacatggtagattttatgttatatatatttaaccacaatttaaaaaatctcaattctttctctgtttttttatttaattttagaaatggggtcttgctctgttgcccaggctgatcttgaactccttggctctgggctcaaccagtcctcccacctcagcctcccaaagtgctgggattacagatatgagctactgcacccagcctcagttctcagtgacaccaacccattactcatttgctttatctcacactgtatacaaaacagtttcagaataatgataccaactctacctccataatgatttcttttttctttttttatttttcataaaacttatgactcaacataataagatttctgaaaatatatttttgtagttcttgtccttaggttatagcccactagggatgatagtcagataactttgttttgaatctctttgaatagttaatctccataaagttataccagcaaattgatacatagttttattttccctttttaggaattgctttttaaagttttatttttcttcataatgatgtgaaatattatatcgttccaaagtcaaatctatataacaagatatattaaaagaagtcttgtttctatccctgtcctctccaacctgctgtctcccttcccctataggtaactaattttttttttttgagatgggatcttgctctgttgcccagactggggcaatagtgcaatcatagctcactgtagccccaaacttctgggctcaagggatcctcacccttcagtcttcagaggagactgaggagactgaggcctgagactacaggcactcactataacaccccactaatttttttatttttatttttatttatttatttatttatttatttatttatttatttatttgagatggagtctcgctctgtcacccaggctggagtgcagtggcgtgatctcagctcactgcaagctccgcctcccaggttcacgccattctcctgcctcagcctcctgagtagctgggactacaggtgcccgccaccatgcctggctaattttttattttttatttttttttatttttagtagagatggggtttcaccgtgttagccaagatggtctcaatctcctgaccttatgatccacccacctcagcctcccaaagtgctgggattacaggcatgagccaccacgcccagctaacaccccactaatcttttaaaaaaattttagtagagatgaggtctcgctttgttgccgaggctggtctcagactcctgggcccaagtaatacttccacctcggcctcctcccaaagagctgagattacaggtgtgagccaccacactgagactgataaccacttttttcttttttttcctttttcttttctttttctttttttttttttttgagacagagtctcgctctgtcgtccaggctggagtgcagtggcgcaatcttggctcactgcaagctccacctcctgggttcacgccattctcctgcctcagcctcctgagtagctgggactacaggtgtccgccaccatacctggctaattttttgtatttctagtagggacgggatttcaccttgttagccaggatggtctcgatctcctgagcttgtgatctgcctgccttggcctcccaaagtgctgggattacaggcgtgagccaccgcgcccggccacttttttctgtttcatcatgtgttttcttccttctccttcttttttttttttttttttaagatgaagtctcactctgtagcccaggcaggagtgcagtggcatgatctcggctcattgcaacctctgcctcccaggttcaagcaataatcgctcctgcctcagcctcccaagtagctgagactacaggcgtgcaccaccatgcccagctaatttttgtatttttagtagaggcggggtttcaccatgttgaccaggctggtcttgaactcctgacttcaggtaatctgcccctcttggcctcccaaagtgctgggattacaggtgtgagtcaccgcactcggcctcttctttcttcttaaaaaatatattttatatccagagtttcttagataaattgtagtatgaggatgtcttttgaggaacagaaatcctgagttttaatatggtaaaattattcaattttaaatgaatttttgtgggctgcacctggcccacagtttattaatccatttgcattggtccagggtctccagaaagaaccaaacagatatagatatataagaggtgatttattatggaaattggttgacaaggttatggaggctgagaagccccacaatctgccatctgcaaaaaattttaaatgaatgcttgaacctgggaggcagaggttgcagtgaaaattcttctataagagttctctaatcaagatcagaaagaccgatcttgattgaatctcctagacttaagtgatcctcctaccttggcctcccaaagtgctagtattacaggtgtgagccaccacacctggccaatttctttaatatacatgaatatttagtatttataggattattccatttttcttgagtcaatggaatattaccattccggctgctataacaaaataccttagattaggtaattaacaaacaacaaatttattgcttgctttccagaggctgggaagtccaagtcaaggtgccagcaggttcagtgtctggtgagggcttgttctctgcttcaaatatgatgccttctttttttttcccccacaagacggagtcttgctgtgtcgctcaggctggagtgcagtggctcgatctcggcttactgcaacttctgcttcctgggttcaagcaattctccctgtctcaggctcccgagtagctgggattacaggcgcccaccaccacagccggctatttttgttttctttttttcttgtttgtttgttttgagacagagtttcactcttattgcccaggctggagtgcaatggtgcgatctcggctcacttcaacctctgcctcccgggttcaagcaattctcctgccaaagcttcctgagtagctgggattcaggcatgtgccaccacctccagctaattttgtgcttttagtagagacagggtttctccatgttggtcaggctggtctcgaactcccaaatttaggtaatccgccctctttggcctcccaaagtgttaggattacaggcgtgagccactgtgcccggccaatatggtgcctttttactgtgtcctcaagcggtagaaggggcaaaagtatcttctattaatataagggcactaatcgcactctcaggacctaatcacctcccacttctgatcaccttggggtttaggtttcagcagggcactaggttttcaaatttatttgtgttaaggacagttctcatatgtttttagcatcttcagctagacatggtggctcacacctgtaatcccaggactttgagaggccgaggtgggaggatcgcttgaggccaggagttcgagaccagcctgaccaacgtggagaaaccccatctctactaaaaatacaaaattacccgggcgtggtggcgcatgtttataatcccagctactcgggaggctcaggcaggagaatcacttgaagctgggaggcggaggttgtggtgagccgagatcatgccattgcactccagcctgggctacagagcaagactccatctcaaaataataataataataataattagctgggtgtggtggtgcatacctgtggtcccagctactcaggaagctgaagtgggaagatcacttgggccaaggaagtcaaggctgcagtgagttatgattgtgccactccagcctaggtaacagagtgagaccctgtctcaaaaaaacaaacaaacaaacaaacaaaacccaacacacacacacacacacacacacacacacacacacaccccatctggccgggtgtggtggctcacgcctgtaatcctagcactttgggaggatgaggcaggcagatcacctgagatcaggagttcaagaccagcctggccaataccacaaaaccccgtctccactaaaaatacaaaaattagccgggcaaggtggtgcgcacctctaatcccaggtactccagagtctgaggcacgagaatcacttaaacctgtgagtcggagtttgcagtgagctgagacgacaccactgcactccagcctgggcgacagagtgagactccatctcaaaaaataacaacaacaacaacaaatctgctatgtctgtgattacatttccctttcattcattagagtattgatttgttcttactctttttattgtcagagatttgagggtttttttgagaatcttttcacatgttatttcttatccatgtatcttttttttttgagacatacaaccttgctgaactcacatattagttcttgtacctccattttttgtaaatccttaggattttctacatagatgatcgtgttgtctgtaaataaaagcagctttaccttttcctttccaatctgaatgccttttaattctcttttaaaaacaaaacaagctggatgcaatggctcatgcctgtaatcccagcactttgggaggccgaggcgcgggtggatcacaaggtcaggagtttgagaccagcctggccaacatagtgaaaccttgtctctactaaaaatacaaaaattagctgggcatggtggcaggtgtctgtaatcccagctactcaggaggctgaggcaggagaattgcttgaaaccggaaggcggaggttgcagtgagccaagatcacgccacggcactccagcctaggcgaaagagcaaaactctgtctcaaaaacaaacaaacaaacaaacaaaaaaacccaaaacaaaactactccattggttagaacttctagtacaagtttgaaaagaagtggtaacagtggacattcttgtcttttccagatcttataagaaaagcgttcttgttcctcattaagatgttaattgcaggtgtttcatatatgcctttaataggctgaggaattcctttctagctctagtttgctgagagttttgattgtgattactggattttgccaaatgccttgtttattttattttattatttatttatttatttatttatttttgacacggagtttcgctcttgttgtccaggctggagtgcaatggcgcaatcttggctcaccgcaacctctgcctcctgggttcaagtgattctcctgcctcagcctcccaagtagttgggattacaggcatgcgccaccacacctggctaattgtgtatttttagtagagacggggtttctccatgctggttaggctggtctcgaactcccaacctcaggtgatccgcccgcctcggcctcccaaagtgctggcattacaggcatgaaccaccgcgcccagcccaaataccttaatatgttcaatatggtcttactatattacgataatattgaacatatatatttgactcaataaagtcttaatgtaagacactatcttaactgctctactcacatccctacagcaaaagggactttaaaaaacagtttggctttgagaatagaaacgttatctgaaacgttagtcctttcaaataatcaggcccattggctggctgggcatggtgcctcacacttgtaatgccagtgctttgggaggctgaggtgggagattgcttgaagccaggagttcaagaccagcctgggagacatagtgacctccatctcctgaatttttttttctttttgagacggagtctcactctgtcccccaggctggagtgcagtggctcgatctcagctcactgcaacctctgccttctgggttcaagtgattcttatgcctcagcctcctgagtagctgtgattacaggtgcctgccaccatgcctggctgatctttgtatttttagtagagatggggtttcgccatgttggccaggctggtctgtaactcctgacctcaagtgatccatgggccttggccttccaaagtgctggaattacaggtgtaagccactgagcctggcctcaggttgacagtctttatcttaacactcatgatctacatagacttgtagctgaattttgcagattcacttttgttttaattaaataaattagacattggccaggtgcagtggctcacactttttattttaatttttattttttaagacagtctcgctctgttgcttatgctggagtgcagtggcgcaatctccgctcactgcaacctccgcctcctaggttcaagtgattcttctgcctgcctcagcctcccgagtagctgggagtacaggcacatgccaccacacccggctaattttttgtatttttagtagagatggggtttcactgcgttagccaggatggtgtccatctcctggcctcatgatccgcccgcctcggcttcccaaagtgttgtgattacaggcgtgagccaccatgcccggccattttttttttttttttttgagatggagtttcactcttgttgcccaggctggagtgcaatggcacgatctttgctcactgcaacatctgcctccgagttcaagcgattctcctgcctcagcctcccgagtagctgggattacaggcatgcgccaccatgcctggctgattttttgtatttttagtacagacggggtttctttttttttgagacagagtctcgctctgtcacccaggctggagtgcggtggtgcagtctcggctcactgcaacctccgcctcccaggttcaagcgattctcctgcctcacccttccaagtagccaggactgtaggcatatgccaccacgcccagctaatttttgtattttttagtagagatgaagtttcaccatggtggccagactggtctgaaactcctgacctcaagtgacccgcccgcctcggcctcccaaagtgttgggattacagacgtgagccaccatgcccagccaaatattgggcttgattaaagaaggtttcactgacagtaacaaaacaaaacaaacaaaactaagaaaataacactggctgggtgtggtggcacatgcctataatcccagcactttgggaggccaaggcaggaggattaacctggacaacatactgagacctcatctccacaaaaaatttgaaacattagctgagtctggtggcctacaaaaaatactaaacttagctgcgtgtggtgtcacacatctgtagtcccagctagttggggggtggaggtgggaggattgcttgaccctgggtaacaatgtgagaccctgtctcaaaaaaaaaaagggatgaaggcactctttattgcagaaattccctctgtttgcattgctagcaatgtttcctagccagtcctggagcgagaacaaattcttccctccattcacctctccttccctatttctcttaattgattttttttttttttttttgagacggagtctcgctctgtcacccagactggagtgcagtggcgcgatctcgactcactgcaagctccgcctcccgggttcacaccattctcctgcctcagcctcccaagtagctgggactacaggcgcctgccaccacgcccggctaatttttttgtatttttggtaaagacggagtttcaccgtgttggccaggctggtctcgatctcctgacctcgtgatccacctgccttggcctcccaaagtgctgggattacaggcgtgagccacggcgcctggcctctcttaattgatttttaacaagttttccaaggaaacttaatgggggaaagtttaatctttttgagaaatggtgctggaacaatagggaaaaatagtgaaacttggtctttcccttatgccatatacaggaagttgtttcttgtttctgctgatatgcactcatggtcgtttaccttcatgggtttggtgggtggttgtgaggtcaaataacagttctgtgggttcaccttgggaacgcttccttccacagagggcttgtttccgcttctgctccatcttctgccattaggactggtagggtgaggaggtatgggagcactggatccattttggaactaatttgacctctcttgtgagtttagctctaaataacagtctcaaagtcagcatttcatcattgttcttgttctgggaatttacaaacattggcctaaggttaactacatttgctcttttatttatttattttttttttgagacagagtcttactctgtcacccaggctggagtgcagcggcatgatttccgttcactgcaacctccacctcctgggttcaagtgattcccctgcctcagcgtcctgagtagctgggattacaggtatgcgccaccatgcccggctaattttgttgttgttgttgttgttttgttttgttgttgtttttgagacagcgtctcgctctgtagcccaggctggagtgcaatggcgtgatctcactcactgctacgtccgcctcccaggtcccggttcaagcaattctcctgcctcagcctcccaagtagctgggattacaggtgcgtgccaccatgcccagctaattttttttggattattagtagagacggggtttcaccatgttggccaggctccacctacctcggcctcccaaaatccgaggattacaggcgtgagccaccacgccggtccaacccggctaatttttatgtttttagtagagacagggtttcaccatgttggccaagctagtctcaaactcctgacctcaggtgatctgcccacctcagcctcccaaagtgctaggattataggcatgagccactgtgcccggcccacatttttttttttttttttttgagatggagtcttactgtgtcgcccaggctggagtgcagtggcgcaatctcggctcactgcaagctccgcctcccaggttcatgccattctcctgcctcagcctcctgagcagctggtactacaggcgccgaccaccacgcccggctaattttttgtattttttgatagagacggggtttcatcgtgctacccaggatggtctcgatattctgaccttgtgatccgcctgcctcggcctcccaaagtgctgggattacaggcgtgagtcactacgcctggccccatttgctacttttttttcttttttctttttttgagacggagtctcgctctttcacccaggctgagtgcagtggcacgatctcggctcactgcaagctccgcctcccgggttcatgccattctcctgcctcagccttccaagtagctgggactacaggagcccgccaccacccgcggctgattttttgtatttttagtagagacggggtttcactgtgttagccaggatggtctcgatctcctgaccttgtaatccgcccacctcggcctcccaaagcactgggattacaggtgtgagccaccgcgaccggccttttgctacattttaaaaaactgttggccaggtgcagtagctcatgcctgtaatcctagcactttgggaggccaaggtgggcaggtcacgaggtcaggagatcaagaccatcctggctaagacggtgaaaccccgtctctaccaaaaatacaaaaaattagccaggcgtggtggcgggcgcctgtagtcccagctactcgggaggctgaggcagaagaattgcttgaacccgggaggcggagcttgcagtgagctgagatcacgccactgcactccagcctgggcgacagagactccatctcaaaaaaacccaaaaaacaaaagcaaacaaacaaacaaaaaataaataaataagtaagtaagtaaaaaactggtgagccaggcacagtggctcagacctgtaatcctgtaactgaaacacaggttcggttgctcactgcttgcagagtccaattaataagaatgaggtctgttataaagaaactgactttttattccaaagccagctaggggaagaagtacaggcttcctgccttaagggtaccactttgccttcagagcagaaagctgatgcttttaaagatgggggtgctggcatgctggcatgaaatgcacgcaggggaggaagcaaacaagtaggggttcgcgtactcgcttcagtgccttatctaccaggtggtcaagctggtggctgctggtgcctttgtgggcaggactagattgtaaaagtggcccaaaactctccaaatgggagagatttttgtagtgggcatactttgggttgtagatggactattgttgtaatgtaggttcttgaggcaacctcctggtgggagagatttcatagcgggtacactttggtttgtaaattgactgttatctgttgaggcagtcccctgatcggacagagttctgtcctggagcttctaagcacctagttagatgaacttgccctgtagggagtgtgtggtgaagtggaggtaaaggtttataattgcatttctaaagggctacataggaagtggggaatgggggaaatggagaaaacagaaaataagataaaataatttaaaaatagtagtaattcattatctttttctttgaaaactgggggtacttggttacaattcctcaccgtcaagttccgttccatttctttgggatttagacaccatattcattctggctacttcctggtgaaaggggttgtaggtcattgggtgtcaaagaggaactgaactatttgaagttggaaatcttcacaaatgcccggtcttacagatgatatttgctggaacattatggtgcgaggtgtggaaattctctgggaaagcctgtcatgtagtctcatacagaggatgccacagcagtaaaatccacactggagaagtgtacctgtttttgcaactagggctagagtagtaagtagcttccatccccaggatggtcctgacccgaaccaggatgccatccatggatctaacgaccatgtgggggcagacatagctttgatttgctggtgcatatcttgcagggctatctgagacatttccaaattatctgggatgtatacacagcagttagtcttaattataaggcaggttccccactatccattgtaaccagatatgatgacaggttggctaaatatggatttaacaggttacaggaaaagctataaacactcatgaaggtgatcataagtcctgtctagttcttgagaatggatcagtttggttaaatagttgcatcccatccaggaggtggcattgcagatgggctaggcatttacatgtgatgaaagcaaacggatttttaataagaggcatttctggccaggtgcagtggctcacacctgtaagcccaaagtgctggggcactttgggaggccgaggtgtgtggatcacaaggtcaggagttcgagaccagcctggccaatatggcgaaaccctgtctctactaaaattacaaaaattagccgggcgtggtggtgggcacctgtagttccagctacttgggaggctgaggcaggagaatcacttgaacctgggaggcagaggttgcagtgagctgagatcaagccactgcactccagcctgagcaacagagtgagattccatctcaaaataaaaacaggcatttctatgaaaacagaagaaaaacaaaggttaattttgggcacaatttttccagatgttagcctctatggaaacagaagaaaaacaaaggttaatgttaggcacaatatatccagatgttagattcaaagcatctttaatcacagaggaggaagggggtggccatctgatgtgtttttctcacctgtattacaaggaataatgtagtagtactttcattgagttcaaatcagaacaatggaagaataatttgaaagcattaatttaataacccgtagcctagaaagaattcaagatttaatccaagttgtggaaaattataaaaactcaaaaacaacagacaagactagaatctaacaacaggtttactataatttttttttttttttgagacagagtatctctctgtttcccaggctggagagcagtggcacaatctcggctcactgcaggctctgcttcccaggttcaagtgattctcatgcctcaggctcctgagtagctgggattacaagcgtgtgccaccacacccagcaaattttttgtatttttagtagagatgaggttttaccatgttggccaggctggtctcaaactcctggcctcaagtgatctgcctgccttggtcttccaaagtgctgggattacaggtgtgagccactgctcccggcctatagtttttttccaaaacataatttttatctctctaatcccaattttgctaaagacaaatcatagtaggacaaatttatttgcaaaataagttttaatcttattttacgaagtattttaacttcagacctcttgtttgatggagagacacatagaatgctcactcatattatcaacttaggccaggttcaaaagcccttcaagctatggaaataaaatattgcctccttccacaagagaaataattacccccaccccttcaaccaggaggctgtcttactaaaaatgtggaaagaaggaacccctaaggatcaattacaaccaaaatggaagggaccctaacaggtgttgctaagtatccccactgctgctaaacttcaagaaataacttgctgggtacacctatccaggattaaacctggttttttttgtgttttttttgggaaggagtcttgctttgtcgctcaggctggaatgcagtggtgagatcttggcttactgcaacctccacctcctaggttcaagcaattctcctgcctcagcctcccaaatagctgggattacaggtgtgcgtcaccaccactggctaatttttgtatttttagtagagacagggtttcaccatgttggccaggctggtctcgaactcctgaccataaatgatctgcttgtcttggcctctcaaagtgctgggattacaggcgtgagccaccatgcccggcctaaacctgttccttatgagttgcaggcacaaaagccaagatcatgccactgcactgcaccctgggtgacagagtgagactccatccccccacccaaaaaaagaaaaaaaaagaatcaacactcagccagaaatggtaatgtgatgctgtgggtgggaataggagcattcatttttctcttcttcctgactgtaatacttcttttctactgcttttgccaactgcctcctcctaggaaacaactactttgtcttcattgggtatagatgtcactctaaggctttgctctcctagttaccctgattgactgtgactgggaacaaaattccatagtaaatatttcaaaaattatagcatcagggaatcatcttcacggttgatggatttgtcatcaacatccccaggagagagagttgtaccttctgtcccatccagaaaatctatcatctccccaggcttcctaactaaccatagcaatcccaaggtacctagaaccccaacttgttaggtggaactctcctccacttgacagattccacctgaatccccctaccactattgcctggacctgggaagttgggtatgtctatctccagtgcactaatgattccatcttttgcactcactgttgtgttaatgacataaaagcagaagtttccctgcaatgctctgatccaactgtagttgccaagttcccaagttcccaaggcctcagcgagataaatgggattccacttgtaagtgaggaaaccatatatggtgccttctcccagatgagaccacacaggggaaaaacaactgcctggtctaggaagggggggagtactggccgggcgcggtggctcacgcctgtaatcccaggtgctggcactttgggaggctgaggtgggtggatcacgaggtcaggagttcgagaccatcctggccaacatggtgaaaccccatctctacaaaaatacaaaaaattagccaggcgtgctagtgtgtgcctgtaatcccagctacttgggaggctgaggcaggagaattggttgaatctgggaggcggaggttacagggagctgagatcatgccactgtactccagcttggcgacagagcaagactccgtctcaaaaaaaaaaaaaaaaagaggggcatattgccctttctggaaaacagagattgtttggccactcctatcacagcaggggaaaaatatctctatagacccactgggcagcaaagggttaacatcacaccccatagggcttctgtttgtgacccaactggtttcatttttgtgtgtcaatgactgggaagaagtcaatcctgtaaccactcctgagtcccagggagtcacctgttcttttgggagtagctttcctttgtatatcaaaaacttggaagagagaggaatgtacattggctacccctgcccctccaggggtcacagtctatagccccatgagacctaggaataccagaaataaatgagcaataggattaattctggtaggaattgggtggcaataagactagtggcaccctggcagctttgcttaccacgagtcaaccctaaagaacttaactcaggccgggcgcggtggctcacgcctgtaatctcagcactttgggaggctgaggcgggcggatcacaaggtcaggagatcgagaccatcctggctaacatggtgaaaccctgtctctgttaaaaatacaaaaaaattagccgggcgtggtggtgggcgcctgtagtcccagctacacgggaggctgaggcaggagaatggcgtgaacctgggaggaggagcttgcagtgagccaagattgcgccaccgcactccagcctgggcgacagagcgagaccctgtctcaaaaaaaaaaaaaaaaaagaacttgactcaaactctagaatccccagttaccaacacaggtgaggcattaaagggaaatcaagagtccctaggctctttggcaaatgtagttcttggaaacagactagcattggattatttactagctgaacaaggtggagtctgtgcaactatgaataaaacctgctgcacatatattaccaactctggacaggttgagattaacattcagaagatctatgagcaagctacctggctacataaacagggcactgaccccaattctatctggttgactatcaaaaatgctctcccaagctcacctggttcttacctctcctaggacctctgatagctgtcttgttattactaatctttggcccttgcttgtttaacctcttagtaatgtttgtgtcttctagattacagaagttccaggtaaagacaatgctggcacaaggcttccaactcatccaacttctgacctggagaataaaaacatcctgccttttggccccttagatcaggtatctggagatttttacccttccagtactaggcagggcctatgcccatcaactcagcaggaagttttaatagttacagaagatggacctctacccttctgtagcccccttaagagtaaagaggagtatctaatctctgaggggggaatgaggtaggagtcaggacttgactcccgaggtggggcttgaactctggaccaggctgaagaccagctgaaacagggaggaggcaaaagcacctctccataagacacactcaccagtgccatgtcactttaccattgccatgactgcacctggaagttaccacccctttccagaaataccaccccttttctagaaaattccaaataacttgccccttaatttgcatataattaaaagtggacatgtatatgtctgcagaactgcctctgagctgctgctctcgacacactgcctatggggtggccctgctctgcagagcagttatggagtggtaacactgccacctcagtaaagctgttttcttctaccactggcttctcttgaattctttcctgagcaaagccaagaaccttcccaggctaagccccagttttgaagcttgcttgctctccaacggtttaatataccaactaggccgaatatgtctctttaggtctttagggtacctaatatcaaaaagcgttaaccagataaaaacaagacttaatttagaatttgactttggaaactttgtcatatatcaaaggtttaaacacttgatattacaaaatagaatcccaggtcattagaagtcatttatgtagccaaaatgataactcaaaaaaattttaaaggcaaaaatctttacttcttgactgatggtagactcaactttccaaacaagactctaaagacagcacgaggccaaccagatctgtctcttttccctcccctttttttctgttgtttattcaaatgacaaacaatgttttggttttttttgttgttgttgtgacagggtctcactctgtcacccaggctgtagtgcagtggtgtgattttggctttctgtagcctcaacctcccaggctcaagcagtcctcccgtatgagtggctggaactataggtgtctgccaccacgaccagctaatttttgtatttttggtagagacagggtttcaccatgttgcccaggctagcaaaatgttttattaccttttaatattacacaaaaatttgttcaaaagagcaagtcaaatttcacctttgctttagtgtactattaatgttaaacccaattctttttttttttttttttttgagatggagtttcgctcttgttgcccaggctggagtgcaatagtgtgatctcggctcactgcaacctccacctcccgggttcaagtgattctcccacctcagcctcccaagtagctgggattacaggcaggcgccaccatgcctggctaatttttgtatttttagcagagatggggtttcactatattggtcaggctggtctcgatctcctgacctcaggtgatctgcccacctcagcctcccaaagtgctgggattacaggcgtgagacaccgcgcctggcctgttaaacccaattcttaataaaaccttataaacaaatctatctaatattaattagttttaataaaataaaattttgggccgggcgtggtggctcatgcctgtattcccagtactttgggaggctgaggcgggtggatcacttgaggtcaggagttcaagaccagcctggccaacatggcacaaccccatctctactaaaaatacaaaaaatagctgggcatggtggtaggcacctgtaatcccagctactcaggaggttttggcaggagaattgcttgaacccaggaggcggaggttgcagtgagccgagattgtgccattgcattccagcctgggcgacagactgagatgccatcccaaaataaacaaacaagcaaacaaataaataaataaaaagaggaaggaggaacagacaggagtaaatggagaatcagacaggattccattgactgaggagtttttagagggacagcaggggcttcaaagcactatctgtacacatatggcccaaatatcagctttaattaagtcagtttctaactatagagctctcaaaagaaaaaccctttttaaatcttttattaccagattttagccagcacaaatgactgatatttctgacttttgaacttttttttttttaactaaatgtaacctcctacatgaaatcaataagacttaactaagggtatgacttaaccacaggtgcacaaggtattttcaaagagatggcaagcgttttttttgtttgtttgttttttttttttgagacggagtcttgctctgtcgcccaggctggagtgcagtggcacgatctcggctcactgcaagctccacctcccgggttcacgccattctcctgcctcagcctcccaagtagctgggactacaggcgcccaccaccatgcccagctaattttttgtattttagtagggacggggtttcactgtgttagccaggatggtcttgatctcctgacctcatgatccacccgcctcggcctcccaaagtgctgggattacaggcatgagccaccgcgcccggccatggcaagcattttttccatgatctagagttgccccagaggtagctcagagaaagaaaaatttcaagacaggaaatcagaatctgtccacggagggaaaatgaatcaataaatggcaaaggtcaacaaataacaaaccagaaaagactcattccctaaatcatgaattggacccaggctgccattgtgaaaggctgaaccttagctactgagctacagcatgggggagacaccattgttcttcccagaaggagcctagagcaggcactggtgagcttgcaaaggattttaactcctcaaaagaatgaaggcggaacatgacattatcatgtgctcttttcagacccaagagtcaaagccctgtgacttaacagcacaagggatttaaaagcaatacagaagttacatggatgtaataacctttccaagtccataatttaaattagactttttttgagacagggtcttgctctgttgcccaggctggagtgcagtggtgcgacacggctcagtgcagcctcgacctcccaggttcaagtgattctcccacctcagcctcccaaagtttgaggattacaggcatgaggccccacacccagcctgaatgaccttctagataacttttgaattagacaaaattattcttcttctcaataagaatatatcttttttttttttttttttttttttttttttttgagacggagtctcactctgtgcccaggctggagtgcagtggcatgatctgggctcactgcaatctccacctcctaagttcaagtgattttcctgcctcagcctcccaagtagctgggactacaggtgcgccccatcaaacccagctaatttttgtatttttagtagagacggggtttcatcatgttggccaggatggtctcgatctcttgacctcatgatccacccgccttggcctcccaaagtgctgggattacaggcgtgagccaccgcgcccggctaagaacacatcttctttggcacattttatataaacttgggaagcaagaaatcctgaactgcctatcagatattagcattttatagatgagaaccattcaacaacttttggaacattttccatacgattaccctttcttaattggaaatgacatagacatacgataagcgtccaacatgattttaagattttaaattatacaaaagtttacttacaagaatgtatctcatttgtatgtacccaattttcccatttttaatcgtttatttagattacttctgaaaactgagatattacacaaaggtggtcattatttaaaattatttccctgttaaccatttttaaaggctgtgagcattgggtgtttaagaatcttaaagtcaaacacataggcattctgttgataactcagaagatttagctgttttcattgaactagtaataacaaattagtctcatttgttaaaaaaaaaaatacagactcaccactttataaaagatagctgaatccacactattctttcatgaaattgggatgtttacatggctaaataaactttgttcatcctggtatataatccaatgaaagctatgaactaaaatttgggtaggccaggcgtggtggctcacgcctgtaatccaggccatttgggaggccgaggtgggtggatcacaaggtcaggagttcgagaccagcctggccaatatggtgaaaccctgtctctactaaaaatacaaaaaccagccgggtgtggtggcatgagcctgtagtcccagctactcaggaggctgaggcagaagaatcgcttgaacctgggaggtggagattgcagtgagctgagatcgcaccactgccctccagcctggtgacacagcgagactctgtctcaaaaaaaaaaattaattaaaaaaaattttgggtaaagcagtctctgtggcggtttggtctttaaaaacacctcttttgcccgtttttccttcagtttcaaattcgtttctagcattcacattctagctagtccgcaaacaatgagtcttatctcagcaccagcagcttagtaacagcagatgtaaagcaggcagaaaagaagacagagaaagccaacctggcaggcctctgcataggagccgggattcacaagtgggacacgagaaagaaaggggaggaagaaaaaaaggtaaagtgaccgaaaggaaactcatgagccttccagccaccatagttagtagacgttggctcagcctttcgcgagcgcctcacttctcacttcctggacaggaagcacagcaggtttatccagatgaactgaggtcaggtggtgcggggaggggcagggagatggccatccagaataccactgccccccaagcccggggctgagatgagcgaagatgtgcctctgttggggaccaggaggcgggtattcaggaatgctacctggcacctggctggaaaagaaaagccagttccctgtaaggagtgttcccaatgttctgtctatgatggccttgttattttattacctttagaaattgagtcctgttcttgttacagcagtcacactgctgggaagtggctaaatagtaatatcaataaatagatgaggccgggtacgtggctcacgcctgtaatcccagcgctttgggaggccgaggtgggcagatcacctgaggtcagcagtttgagaccaggctggccaacatggtgagtccccgtctctactaaaaatacaaaaattagccaggcatggtggtgcatgcctgtaatcccagctactcgggaggctgagacaggagaattgcttgaatctgggaggtggaggttgcagtgagctgagatcgtgccactgcattccagcctgggtgacagagtaagactctgtctcaaaaaaaaaaaaaaaaaaaaaaaaagagtcctcttggaaaacaaaacaaccaaaacaatacaaaaaccccaccattcttgtttgtcttccatgagggaaagtctccgtagcccatgtgggcagctctcctggataatcaggagggtgaaattgaaggtagagagtcaagaaaagggccagagcccacacatggtcatacattcacatttgcaaacaaacaatgtgcttcccaatgagtctccaattgacgggctgggtaaggccctgaatccccctcctcagatccaaatggcttcatgggtagttgagtttgagctaagcaaagctcttatggttccacatgcacaaacaaatataaatgcataaaatgctcaaatggtgtcaatagcagccaaatcttaagtagagcagggcccccagtgacactgcaaaagaggtagagggtggtcagatgcactccaaataactcacccagttccaaagtttgctgtcttcttcagaggtcacttgctttgtaccagtgaaacactgaaggtggcagatgtcatgctgggaggtgaaaggaagactcttccaaaaacaaaagcatttttggcagctgccgggaagttccatgatgttcctgtcgctagctatgagcggctggcactcacaggtgaccccatgcctcacccaggagcataactaggctatccagctcagactcacctagggcgggcagcacttccccatatgggtcaccaaaattgtaactgaaatgcaggttcagttgcttgctgcttgcagagtccagttaatgagagtaaggtctggtataaagaaagagactttttattccaaagctaacttaggggaagaagtacaggcttcctgccttaagggcagtactttggctttggagcagaaagcgggctcttttaatgtgggagaggaagcaagcaggtgcgggatctgctgactccctttggtgccttatctactgggcagtcacgttggtaactgctggcatcttcatgggttgtaaaagtggccaaagactttccaggtgggagacagtcttgtagtgggcatacttgaggtcgtagatggactgttgtctctggaggcaacctcctagtgggagagagtttcatagtgggcatactttgggttgcaaatggactgttatctctgagacagtcgcttggtgggagagcgttctgccctggagcctctaagcacatggttagatgaacttgtcctgtggggagtgtctggtgaaggggagctgaaaggttataattgcattggttaattaggaagtggcgaataggagaaatggagaaaagagaaaagaagagaaaagaaaaaaataatagtaacttattctctttttctaagaaaaatgggaatacttggttaaaatcacagcacttttttgggagactgaggcaggcttggtggcacgcagctgtaatcccagctactcaggaggctgaggtgggagaatcacttgagcctgggaagttggggctccagagagctgtgattgtgccactgcaccccagcctaggtgacagaattagaccgtctcaaaaaataaaataataaaaaaccctgaaagtttattgtcattattgatgtacttactatttccacaaatgatccagtttaacacagagtttaggttaataaaacaatgtaaatattgtcagtagcacaatctagagagcttctttttttttttttttttttttttttgagacagagtcttgctctgttgcccaggctggagtgcagtggtgtgatcttggctcactgacacctccgcctcctgggttcatgcgattctcttgcctcagccaccctagtagctggggttacaggcgcctgccaccaagcctggctcatttttgtatttttagtagagatggggtttcaccatgttggccaggctggtctggacctcctaacctcaagtgatctgcccgcctcagcctcccaaagtgctgggattacaggcatgagccactgtgcccagccccagatagctttttttgttggagatgtttgttctaagagggaagaaactaggcctgaagcctttctgtgtgcataagcgacttggaatcaagatatctgtcattttgtatttaacacaaatgagaaacatcggtaccagttatggatttaatatctgtttctgcagctcttttaaaaataccaccttttgcatctctggatattgctctccactccccatgattatttggaagtatatgaatccaaattgtatgaaattgccgggcacacccccatggtggcaaacgtctacagttctagctactgggaagcctgaggcgggaggctcgcttcagccctggagttctaggctacagtgcactatgcccattgggtgtctgcaccaagttcagcttcaatagggtgaccttctgggagcaggaccaccacgttgcctaagaggggtgaacctgtccaagtcggaaaggagtgggtccaaactcctgagctgatcagtagtgggatcgtgcctgtgagcagccgcagtactccagcctgagcaacatagcaagaccctgtctcttaaaaaaaattatatcatactagaaaagtgcactttgggtatctaaagaagcactcacacacctttctgtctgccaaccagtttgtttactttacatgtggtccgtcctggttcactgggccctaggaaccagccccctctggcccatctccagcacagtaacaatagccaatgtttattgagtctaggctgtgtgccagatgttgatctaaaatagatgttgctctaaataataggctattgtttgaggctgagtgcagtgggtgatgcctataatcccagcactttggaggtcgcagcggtaggattgcttcaggtcaggagtttgagaccagctggggcaacaaactgagaccctgtttatacaaaaacaaagaaacccagaaatgagcagggcgtggtggtgcacatctgtggtcccacctactcgggaggctgaggtgggaggatcgcttgagcccaggagtttgagtttgcagcaagccactgcactccagcttgggttacagagcaagacccggactcaaggggaaaaaaaaaggttattatttgaatctaatgcttacagccagcctttgaggtgataccattagtaccttcacattgtagatgaggtaacaggtttagagacattgagtagcatgcccaaatcatgcagattaatggaggacccaggatttaaacctagatccgtctgactgccatctctctctctctctttcacattaaaaaaaaaaaaaaaaaaaaaaaaggagacgggggatggctatgttgcccaggctgatcctgaaatcctaggctcaagcgatcctcccacctcagcctgccaggtagctgggactacaggcccacaccactatccctggctaatttttgtattttttgtagagatgggggtttttaccatgttgcccaggcgggtcctgaactcctgggctcaagcgatcctcccgccttggcctcccaaagtgttgggattacaggtgtgagccactgctcttggctgagagctgccatctcaattgccattacctactacaatgggacccagaagcctagttctggacacagtggctgcaaggaccctcaggggcccttcaggtctgcttgaagtaagccattttccacagtgtcattccgggtccacccctggccccagcatggtcagctcaggtgactcgatgctgtcagcagctctggctgatcaaggccctttctgttgtagggtggaatccatccccctttagcttccatgggatggtcagccttctgccctttggggctgtagagaagacacgtggctccttctcaccctagggaatcccttcagatcctggctcgttcactcagcagatatttactgtgtgtccacaatgtgcccaggatagaggagtggacaagaagaagtcataaggcctggtggagttgacattttaaagagacagaaagtaagtcccatgttggcagagacaggccccacccccttgatctagagcctctctggatcattccagctttctagatcggagacccattggaaatgtggtcccagataaggtagccacatgaagaatagggccatggggctggctggggtgaccccacataagaagccttggctggtccagggtttggagaggccatatgtccagggcagtcctagagcttaatctggccaaattccagtgaaaaggaaaaaaaaaaaatcctgcttccccatcaccaaacactaaataagcagacagcgagacaggcctccccacctcctcccaaactccagagctccctccctgtctgctgcctcctttagccagcgcccgtgggcatttctgaccaaactcacattctgccttctccagcctgaaatctggcttatctattctctctgcctctctcttttttttttttttttttttttttgagacagagtctcgctctttcgcccaggccggactgcagtggcgcgatctcggctcactgcaagctccgcctcccgggttcacaccattctcttgcctcagcctctcgagtagctgagactacaggcgcccgccgccgcgcacggctatttttgtgtttttagtagagacggagtttcgctgtgttagccaggatggtctcgatctcctgacctcgtgatccgcccgcctcggccacccaaagtgctgggattacaggcgtgaaccaccgcgcccggccatggcttacctattctcaagacatattcctccccactctcagactctccccctatctcaggcctcttttacctcccaaatctctctccacccctgccagggtccaaaatcaagcatcagcgctgttccccgcccgacttccaccctccctcactcccctcaacccgattctaacagacacccaaacaggagaacacagtgtgagattacatcacagctcacacacacacacacacagacacacacagacgcacaaacacacagacacacacacacacacacacagacacacacacacacacacacagatttcctgttgtcctgtgaccctcccactccagtccctgactcaggacacagtagaacaaaagaactcacgatgccggtttcagtgtcataaacaatagatatgggccggcacagtggctcatgcctgtaatctcggcactttgggaggccgaggcgggtggatggctcgaggccaggagttccagacccacctaggcagcatggccaaactctgtctctataaaaaatacaaagattagccaggtgtggtgacatgtacctttggtcccagatacttaggaggctgagcggggaggatcacctgagccctgaaggttgaggctgcagtgagccatgatcacaccactgcactccagcctgggagacagagtgagatgctgtctaaaaaacagaacaaaacaaaaactcccccaaacccaaaaagatttggaagaataaatgctcagatattgagccagtcaccttaccactgcccaccaaggtgattatgaaaggatgaggaaaggggaagagaggaacagcagaggttgtagaaaggagcagaggagttggggtgtccccaggaagagcccatgtcccagcccccaccacctcactggccaatgagagtcctcacaccaaatgtcaaaaaccctggaccatctggggggtggccaacagtgaatcccaaagaccaagtcaggggcatagaacaactttttgcagggtcaatacaacagagacctcccacaagcgagtgtcctgctttaaacaattgcccaaatatagttagtggggattcaaagcaaacactacaaaagaaatatatatttcagagtggaaaataaaatgaaataaaatggccaacagaaaaattaaatggcatgagaggagaagggaccaagagaaggggcaacaaggatgcaattggtcaggcacgctttgagggactttgaattgactatttagccaacagccttatttcctggatcacctgatatggaggagaggaggcaaaggggacagtcacctgtccgcaagagccaaaatggtgctggccagtctctaacatggggcccagtgaaggtctcctccccagatttccccagcttgggcgagcttggctgccaaagggggatcagcaggtatactagcaacatgccagctggaatattgggtcccacagaaggcagtgctgctatggctgctcgtccatctgcttggctccacgggttgccaggaaagacagtggctctttttttttttgagacagagtctcattctgttgcccaggctagagtgcagcggtgcaatctcggctcactgcaacctccacctcgtgggttgaagtgattctcctgcctcagcctcctgagtagctgggattatagttgtgcaccatcatgtcaggataatttttgtatttttagtagagatggggtttcactatgttggccaggctggtctcaaactcctgacctcaggtgatccactggccttggcctcccaaagtgccgggattacaggagtgagccactgcgctcggccaagacagtggctcttaaaaatgaacctttgggctagtgctacacctctgcagtgttagaagctctgcagctttgattgcttgtagcactgatcacctgctgtctcttgctgatcaccgtcttgacatctctcgccacctctctccaactgccacctcctgccatctctctgttgtctcactgtcttgccagttgctctcaccacttctctctaattgctatctattgctatctttctgtcctgtctcaccatcccgccaattgctgaccaacaattgccaattttctcctttctagtgtcttgctgcctgtctgctaattgccagtcgctgccatctctgttgtctttgtggtcttcatggtcaccaggtgatgcagaacaggtgagccccaaaattggggcttagcctgggagggttcttggcttcacacaggaaggaattcaagagcaagacagtggtattagagagcagttttttaattgaatggtactgctctttgtggagcagggataactcaggcagtgcacctgcagcaggcaacctatgggctcttggcaacggtatttatattcgcttatactcatttttaattatatgcaaatagaagggtgagttaatgcaaattgatggaggggttatttagaaccttttaggaaaggggtggtgacttctgggtcattggtgtggaaagatgtggtaacttctgggtctttgccatggcatttgtaaactgtcattacactggtgggagtgtcttatgctaaggaacaatgagggcagctagggattgcttttgtcaccatctgctgattctttccaaacaagacctgctggtctcctctcttgattttaacactattaattctctgatttcatgtgtatgggatgtcttcccattcgtttgtgtcctcttcaatttctttcatcagtgttttgtagttttcattgtagagatagttcaccttcttggttagatttattcctagactttttttttttttttttttttttttttttttttttttttttgcagcaagataaatgggcttcttcatttctttctgagctagctcattattggtatgtagaaatgctattgatttttgtatgttgattttgtatcctgcaactttactgaatttattattaattctaggagttttttggtggagtctttaggttttcctaaatatatgatcatatcatcagcaaggagggatagtttgactttgtctttttcaatttggatgccacttatttctttttcttgcctgatttcgctggctaggatttccatcactgtattgaataggggtgatgaaagtgggcattcttgtcttattccagatcttagagaaaagactttcagattttccccattcagtgtgatgttagctatgggtttgtcatgtcaataaattgttatgaagtaagttctttttttttttttttgagatggagtctcgctgtcgcccaggctggagtgcagtggcgcgatctcggctcactgcaggctccgtcccccggggttcacgccatactcctgcctcagcctcccgagtagctgggactacaggcgcccgctacctcgcccggctaattttttgtatttttagtagagacggggtttcactgtgttagccaggatggtctccatctcctgacctcgtgatccacccgcctcagcctcccaaagtgctgggattacaggcgtgagccaccgtgcctggccgaagtaagttttttctattcctagtttgtttagaggttttatcatgaaaggatatggaattttattaaatgcaatttaataattgtttcaattgagataatcatatggtttttgtctgtgtctcctgggctcaagtgatcctcttgcatcagcctcttgagtagttagaactacaggtgtatggcaccacacacggctaatatcttattttatttttgtagagatggggtcttgctacattgcccaggccattctcaaattcctgcctcaagttatcctcctgtctcagcctcccaaagtgctgggattacaggtgtgagccattgaatttctgtataccatttagaatcagcttgtcaatttctaccaatccagtctgctgaaattttgattggtattcttgtttgaatctataaaactgaatctcaattctcaaaatgagaaaggcttcttggaagcagtacatattttaatcaaatgtatatctagaatatgtcattaactgttgccatggagcaatgtgatataatctgaacaactgttaaaatcaaacccttaattccaaaaaacgaaagataagctgtggtgagaatgtgaagaaattggagccctagtgccttgctggtgagcatgcaagaaggtacagccactgtggaaaacagcctggcaattcttcaaaactttaaacacggaactatcctatgatcaagcaattccaattctaggtatatatccaaaagaactgggccgggcctggtggctcatgcctgtaattccagcactttgggaggccgaggcggtggatcacgaggtcaggagttcaagaccagcctgaccaacatggtgaaacctcatctctagtaaaatacaaaaatcagcccagcgtggtggtgcgcgcctgtaatcccagctcctcaggaggctgaggcaggagaatcacttgaacctgggagacggaggttgcagtgagccaagatcatgccattgcactccagcctgggccatagagcgagactccatctcaaaaacaaaacaaaacaaacaaacaaaacaaaacaaaacctgaaggcaagaacttcaacagatatttgtacaccaatgttgatagcaacattatttacaatagccaaaatgtggaaacaattcaaatgtctatccacagatgaacggagaaacacgatgcagtgtatacatacaagggaatattctgtggcaatctgaaggaatgaaactttggcatatgctacagcatcgatcaacctatgtcacattatgccaagtgacataagccagacacagagggacacatattgtgtgattttacttatacgaagtacctagaataggcaaattaataaaaacgaaagtagaatagagattaccaggggctgaggggaggggaatgggaagttttgcttaatggatacggaatttatgttggggacaatgaaaaaattccagagctggaaaatggtgatagttacatgacattgtagatgtgctgaatggcagtgaattgcacacttaaaatcagccagagaggccaggtgcggtggctcatgcctgtctgaaaggaatttctcctttcagttctgtcagtttttgcttcatgcgttttgaattattgaatgcatactgttatgactttgatgttttcttaatgaaataactcctttataaagataaaatgtctcttttaattctcagtagtattctttgtttctcatatggtgctcacccatcaagtcaaatgactgatgtatctccaggtcatcctgtccttgccctccagctccaccttggatgggagtctacatctcaaaagttcctgagattatgttccctaccgccctaggcatgatggatctcaaatcagagattaagtttagttatggagaaaataaagaaataaaattaagaaagtaaaagttctctgctttgttgtgttatgactactggctggaggctgcatgctctttaatgtcacagacaagtgccactctgttcctcccatgctccctgcatgccagctggtcccacagtgtctctttctttcttggcttcctttttttttgtgaggcagggtctcactctgtcacccaagctggagtgcagtggcacgatctcagctcactgcaacctctgcctccccggttcaagtgattctcctgcctcagcctcctgagtagctgggactacaggcatgtgccatcacacccagctatttttgtatttttagtagagatggggtttcaccatgttgcccaggctggtcctgaactcctgacctcaagtaatccgcctgcctcagcctcccaaagtactgggattataggtgtgagccaccatgcccagccacatgtggcattttaattcggcaggaaagggtggaattatgtaatgagaggcgctgcagtcagctcactccctatctggaagaaaatgcacctgggcctgtctcttacactagcccacaaaacaaattccagaagagatttattaaataaaaaaaaaaaccataatatgaatcttgtaaaaaaaatgtaaaatatgagaagaccttctcaaccaagactggaaacgcagaagttatgaaatttgacaatttatttatttatttatttattttgagacagagtcttgctctgtcgcccaggctggagtacagtagcccaatctcggctcactgcaagctccgcctcccaggttcacgccattctcctgcctcagccttccgagtagctgggactacaggtgtctgccacaacgcccagctaattttttgtattttttagtagagacagggtttcaccatgttagccaggatggtctcgatttcctgacctcatgatccgcctgcctcagcctcccaaagtggtgggattacaggcgtgagccactgcgccggccgaaatgtgactatttaaatgtatgcatgccaaaagaggatggagacaaactatagggacaaaggagaaactcagaaaaaatgtttacacagctgaaggcaatagcagcttaatatcaccccataaaaggggtttttgcaaatcaagaagtggacaacgcaacagaaaagtgggctaaacatacagaggagcaattcacataagaaaagttccagtggccaacaaacaaaagaaaaggtgctgcttaatctggctaaaagattggggaatgcaaagtaaagttatactactatacccatcagcttggcaagaattaaaaaggctttgtggccaggcatggtggctcatgcctataatattagcactttgggaggccaaagcaggagcattgctcaagccaggagctgggctacatgttctcaggacctcttgagactgcgcctcaggacaaaaaaaaatacatctatatctatatctatatatgatatctatatgatatatagatatagatatatgatatggttatatatgtatgatatatatatatactatatctatctatatatcctatatataatatatggttaggctttgtattcccacccaaatctcatcttgaattgtaatcaccaggtggaggtaattgaatcattggggcagcttcccccatgctgtcctcatgatagtgagtgatttctcatgagagctgatggttttataagaggctctttccccttcgctcggcgcttctccttcctgctacctcttgaagaaggtgccttgcttccccttcaccctctgccttgattgtaagtttcctgaggcctccccagccatcctgaactgtgagtcaattaaacctctttcctttataaattacccagtctcaggctgttctttatagcagcatggaaatcgactaatactatatatatacttatatatataagttgtatgtataatatacatatatatatgagctttaacatctattaatgatggggatatggggagatggaaattttcatacttttttgtggataagagatgttaattttttaaaacttagctgatatctagtaaaatagaacgttcttacattttcagcccagcaatctcattcatgcgactccatcccttagaccctatgaggaatttattgttcacgttgtcataaaactgggaataaagcaaaggcccacagagagccacattccacactgtggagtattaaagccattaaaaatagcagagaatgttccacaagctactgttgaacaagaaaagtgcatttggtaaaagcaattgtgactaaaaacaaaacgctagacacatcccatgtatatacatttacagagactccaattagatataggttttttcttacttataagagtatgggtaaaatacagaagatacatatcagggtgttaatctgggttacctaggggtagagtgggaaatatgggtggagagaaggagaagtcaagcaagaaagacaaagaaaaaatagactgcattaaaaaaacatgtattatgagctgggcgcagtggctcatgcctgtaatcccagcattttgggaggctgaggtgggcaaattacttgtgtgggtggcaagccacccaggcgacgaggcaagagacagaggacacaaactgttccagcataataaaatataaaacaagaacagttataccagatatagatcttaaatatgattatatatatcattaattagtttgtagcaattactttttattccaatattataataatcctcgctctataatcatagcctaggaaaaaccaggccatacagagataggagctgaggggacatagtgaggtgtgaccagaagacaagagtgcaagctttctgttatgcccggacagggccaccagagggctccttggtctagcggtgacaccagcgtctgggaagacgcccgttgccaggcagatggtggtctagcggtagcgtaagtgtcaagggaaaacacctgctacttagcagaccaggaaacggagtctccttttccccggaggagtttagagaagactctgctcctccacctcttgtggagggcctgacatcggtcaggcctgcggaccgtggtctagcagtagcgtaagtgtcaagggaaaacacctgctacttagcagaccgggaaagggagtctccttttccctgcaggagtttagagaagactctgctcctccacctcttgtggagggcctgacatcagtcaggcctgcccgcagttatccagaggcctgtctccctgtgatgctgtgcttcagtggtcacgctcctagtccgccttcatgttctatcctgtacacctggctctgccttctagatagcagtagtaaattagtgaaagtactaaaagtgtctgatatgcagaaataatggcataagctgtctttctctctgtctcctctccctctctgcctcggctgccagggagggaagggcaccctgtccagtggacacgtgacccacgtgaccttacctatcattggagatgactcacattctttaccctgccccttctgccttgtatccaataaataacagcgcagccagacattcggggccactgccggtctccgcgcattggtggtagtggtcccccgggcccagctgccttttcgtttatctctttgtcttgcatctttatttctacactctctcgatgccgcacatggggagagacccactgaccctgtggggctggtccctacagcttgagtctaggagttcaagacaagcctggccaatatggcgaaaccccatctccacagaaaatacaaaaatgagccaggcatggtggtgcatgactggagtagtcccagctactccagaggctgaggtgagaggatcacttgagcctgggaggtggaggcttcagtgagccaagatggcaccactgcaccccagcctgagcaacagaatgagaccccgtctcaaaaacaaacatgtattatgaccatatattcatcagagttcagagaaacagaagcaatgggagattttatatagatatatatggagagagagagagagacatatatgaaactggtccatgcaatcatggcggctgaggctggggagtcccacaatctgttgtctgtagctggagacccaggaaagctggaggtgtaagttccagtctgaggttaggagattggtgtcctagctccagcagtcagacagagagagaaaacgctctcttccttcacctttttgtgctattcagtctctgactatgatgctcacctgcactggggagggtcctctgctttcctcaatctatccattcaaatgctaatatcatctgaaaacaccccaaagacacacccaggaataatgtttaatcaattatctgggtaccccataacccagtctatacttaaaattaaccatcaagactatatatgcatttatagaaaaatatatatgaaatgtatctaaaaacattttaaatttaaaagtcagccctccctcagagtggtctcaccccacagacaagggagtttaccctccaactcccatcaggcattggctgagagttgcttcaggaggtgttaactcgtcacacttctggccttccagatgcataggctggacgtactcctgcagccaggggaagccccaaacaaagttgcaggtatatgtgtgagataccttgatcagggatgtgggggatgggggcagagcactatcagacatgttgcgtttttgcaacaatgggcataagaaggatatttgaaaatctttaagcacactattagtggttaagaagacctattgatttttggatgcccatcatgtgctgaataccatgcccgacccccaagtgcatcatctctaggtgttaccatgattgtccctatgataaagcaacccatgtgtctccgtgaattctgcaaactctgctgaaaatggcaaaatggagttggggtcctctgtgctggtgacatttagaatggaaagcaagtgctattttgaagatgactcagtctgaggaggcgctagttttctcaagcaaacacttttgtaacacccttccagccaaaactctgagctaacgtagaagggtgagtcctgtctttctctttgctatccactttgcatgtggcccagcagggatggtgacattgctgagggtggacaatctatacctgtcctcttctctcccaaactccaaaaatgtaagcgccctaagggcaagaggtctttatttattttgagacagggtctgtctgtcactcagggtggagtgcagtggtcggctcactgcagcctggaactcctaggctcaagcgatcctccctcctctgcctcctgagtagctgggaacacaagcgagggccaccgccacgcctggctaattaaaaaaaaaaaattttgtagagacagagtctcgctctgttgccgaggctggtctgtaactcctgggctcaagcgatcctcccacctcagcctcccagtgtttggatcacagccgtgagccactggaccaaaaaaaaaagaaacctaatatacaaaacaatggcagggtgcggtggccctagcactttgggaggctgaggcaggcggattgcaggcaggagtttgaggccagcctgagcaacatctttttcttttctttctttattttattttatttattttttgagatggagtctctgtctgttgcccaggctggagtgcactggcacaatcttggctcactgcaacctctgcctcctgggttcaagcgattctcccgcctcagcctcctgaatagctaggactacaggcagatgccaccacgcccagctaatttttgtatttttagtagagatgtggtttcactatattggccaggctggtctcgaactcctgccttgacctcccaaagtgctgggattacaggagcgagccactgcgcacggcctcttttttttccttctgagacacagtcttgttctgttgcccaggctggagtgcagtggcacgatcttggctgactgagtagctgggattacaggcggatgccaccgtgcccagctaacttttgtatttttagtagagacggtgttttaccatgttggccaggctggtcttgaacgcctgacctcaagttgtccgcctgcctcggtgtcagagttgcatgaaccagagcaactctatcttgaatagaagctgggtaaaatgaggccgagacctactaggctgcattcccagacggttaagacattctaagtcacaagataagataggtcggtacaagatacaggtcataaagaccttgctgataaaacaggttgcagtaagaaagccaactaaaacccaccaaaaccaagacggccaccagagtgacctctggttgtcctcactgctgcactcctaccagtgccatggcaacggcaggaagttaccgaatatggtctaaaaaggggaggcatgaataatccgccccttgcttagcagatcatcaagaaataaccagaaaaatgggcaaccagcattgagttcctttactttcctaacaaacttgctttcactttatggcctcgccctcaattctttttttttttttttgagacggagtcttgttctgttcccaggctggagtgcagtggcctgatcttggctcactgcaacctccgcctcctgggttcaagcaattctccagcctcagcctcccgagtagctgggattacaggcgcgcaccaccacgcctgcctaatttttgtatttttagtagagatggggtttcatcatgttggtcaggctggtctcgaactcctgacctcaggttatccacctgcctggcctcccaaagtgctggactcgccctgaattctttattgcacgagatccaagaaccctctcttggggtctggatggggacccctttcctgtaacactgggattataggcgtaagccaccatgttcagccacctttgaggcaggaaaatagggtctggaggcagggaacatataaggctgattcacacttcagttatgacaggaaatatcctctccttagggagtacaccctaaatgactttgtaactttacttcatcctcttcatttacatatggcatatcccaaataaccaatggaatcctccaaagggtatttaaactccaacaaattctgtaactgggcccttgagcacctatgctcagccggccccaacactggagtgtactttcattttcaataaatcgttcattccttccttgctttgtgcattttgtccaattctttttttttttctttttctttgagacagagtcttgctctgtctggagtgcagtggcgcaatctcggctcactgcaagctctgcctcccgggttcacgccactctcctgcctctgcctcccgagtagctgggactacaggcgcctgccaccacgcccagctaattttttgtatttatttttagtagagacagggtttcaccgtgttggccaggatggtctcaatctcctgacctcgtgatccgcccgcctcggcctcccaaagtgctgggattataggcgtgagccaccgcgcccagccgttttgtcccattattttagatgccaagaacctgtacaccctccaccggtgacaccttcacagttttgaggagtattcatggggtattttgtaaaatgtttctcaattgggatttgtctgatgtttttctcatgattagactggaggcagctgggattacaggtgtgagccaccatgcccagtctccaaaccctgtttacacaaaaattttaaaaaactagccaggcttggtggtgcgcgcctgtagtcccagctactagagagcctgaggtggatcacttgatcccgggagggggaggctgcagtgagcggagattgtgcctcgctggctgcactccagcccgggcgagagagccagaccttgtctcaaaaaaaaaaaaaaaaaaaaaaaaagcctaatatggctgagggcggtggctcacgcctgtaatcccagtactttgtgaggccgaggcgggcggatcacgaggtcaagagctctagaccatcctggccaacatggtgaaaccccgcccgtactaaaaatacaaaaattagttgggtactcgggaggctgaggcaggagaatcgcttgaacccgggaggcgggggttacagggagctgagatcgcgccactgcactccagcctggcgacagagcgagactccgtctcaaaaataaatatatacaaattaaaaaagcctaatatacaaaataaagctaggaatcttccctgagtcctcttgcctacggaatgaagtccacagacttgggggagcgttcgaacccttctaaggccacttcctttctccagcctctcgcgcccagttgactcccggcaacacctcccgccgccacaaggagacgcccgaggacttccctccgacaaagccaaaaacggtattgccacgtgacccgctccgcatacacgtgaccagcttcgcacccggtgggcgtcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcgtgagtgacgttggggggcgggactaaggaacctgagggcgaggggcgggagtcaactgaaatcccgggatggggaggggcgtctggaattatggggcgggcgaggcgcagatactttgatgaaggggcgtggctcttagctgctccgagaggtacagggcggggcctggaaaggggtggcacttgtgactgaaggaggcttaggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgactgtgagttctgggcctgaggtggggcatcagggtagggttgggggacagtctttggcattctgtcctgagccatccccactgctacagtcaacaaacgtctggatgaatgggtgacgcatgagcggctggacctaaagaagatccagttccccaagaaagaggccaagacccccactaagaacggacttcctgggtcccgtcctggctctccagagagagaggtggtgagtaggtcccccacttcaccttttctctcctgcctcctatttctcttgtctgttggcattaggagctcctggatgggcaggaggcggctccctctcaccctgacttcatcttgcaaaggatgggggccaaattgcacatgtagctcccagagtccagtagctagtcctgtgtccttcagaaggcgagggtggggtttgataattttgaggtgagggacccctcttccccttccccatcccactgccatccccgccccaaaggaagaccctggacctatctctacagccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacggtaccctcagcaattccagggaccttgctttcttctcaggtcccaccttctctaccttctgacccacctttgttggtttctctctgcagaaacggaaggtggaggtggtttcaccagcaactccagtgcccagcgagacagccccggcctcggtttttccccaggtgagttccccaaaccatctcttgttctcttcctctcttctactctctggtggcttttttcaggctcatttcacagccatcccttcttttcctactatctcggcagaatggagccgcccgtagggcagtggcagcccagccaggacggaagcgaaaatcgaattgtttgggcactgatgaggtgggtctggggagcagcagaagggaactgggtgaaaaggaagggatgcaggcagggtggagagttatttagtgatgagtttaaaaataaagaaggggtggtgggcagagctagtgttggtgggattaggagacaggcagaacattgttcaaatgagtcattggggccgggcaccatggctcatacctgtaatcccagcactttgggagtccaaccaaggctggtggatcacctgaggtcaggagtttgagaccagcctggccaacatggtgaaaccttgtttctactagaaatacaaaaattagccaggcgtggtggcgggtgcctgtaatccagctcggaaagctgaggcaggagaactgcttgaaccccggaggtggagattgcagtgagccaagatcgcgctactgccctccagcctgggcgacagactgagactccatctaaaaaatggggtcattgggtgatcttttccacatcatcgatcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaaaagcaattcctgggctgggcacggtggctcacacctgtaatcccagcactttgggaggctgaggcgggcggatcacaaggtcaggagatcgagaccatcctggctaacacggttaaaccctgtctctactaaaaagtacaaaaaattagctgggcgtggtggcgggtgcctgtaatcccagctactcgggaggctgaggcaggagaatggcgtgaacccaggaggcagagtttgcagtgagccgagattgcaccactgcattccagcctgggagacagcaagacttcgtgtaaaaaaaataaataaataaaaagcaatttctggctgggcacagtggctcatacctgtaaccccagcactttgggaggccaaggtgggccaatcacttgagcccagaatttcgagaccagcctgggcaacatggagaaacccccaggtactcgggaggctgagttgggagaatcacctgagcctgggaagtcaaggctgcagtgacccacgattgcatgattgcaccactgcactccagcctgggtgacaggagtgagaccctgtgtcaaaaaaaaaaaaaaaaaacccacaatgtctgaaatgcaggagaaatcgtgtgcagaagtaaagcagcaggattcataattttgctggggtaaaccctaaggcagttattttgttaaattccagaattccttaactctgttgtagagtagcagatcagttcccaggaggtgtgactgtggatgtagaatgttaggttttttaacagctagactcccaagactgttagatagggagtcagtggtcagagtctcactttggacacattagtttgaggagccgtggtcagagtctcactttggacacattagttcgttggctgctgttaaaaaacattaaaaggcagtggtctctcctggtcaggcttagaatggaggtgtgcggagcaaggcgggaaacttgcctgactgagcagggaggcactcagacaccatcacacatctggcacacaggcttttcaacactgaggagcagccctgcctaagctgcgggctggtggagtgggtcaggcccagccagggaagaacactcatcacctagcagcctggggcatagcacgaacagtgaagctcctggttgaccctgaaccactggccaggctcaaggcgggatacccagagtggtgacaagccttttctcttgcagagttattcccagaacctgtgtcttttggccaagtgtttccttgaccataagacactgtactatgacacagaccctttcctcttctacgtcatgacagagtatgactgtaagggcttccacatcgtgggctacttctccaaggtcagtgcctgcccaagctgtccctgtgccctgtcctgagccagatcccttccctgacactcacctgtcccccttctccaggagaaagaatcaacggaagactacaatgtggcctgcatcctaaccctgcctccctaccagcgccggggctacggcaagctgctgatcgagttcagtgagtatgtgtgctgcggccagggggtagtggacccactatcggtgcctcacaggcagatgggccaggctactgtgattctcaaccctggctgtgcagcccagcctctaggggaaccagccagaaataacagtggcactctcccggggttctctccgttcaggctgactgccctgcttatctggggtaggttctcagccccccagtttgctccttggccagggttctaagtgccactcagctttccccaaatctgacttacgtgctcctgcctggagccatgggcagaaggttagtgagccgctggtgctgatgtatctggtaacgtgtgccatgatacgagtactggggcaaggaccagtggctaatgtccccagttgtcccctgagccttgcaggcaggtatccaaaatgctgtcagcagatagacataagcatgttgtccctcgctccttgtgtccagtgaggtcagtctcttaaagccagaagggactctgaacttcatcacacatgggctcttcagtgccctccccaaccctgaggccccttcttcccagcctcttactccccatcaccccccattctgtctgtctcaccactcacttggaataaccaagctctgacctgagaaacaaggaggaagttctagctgttgacctggtgaagacacagaggctttacctgatcaaggttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggaagggcttctagaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggatggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagagccatgcaaagttcttggtggggagggggaaagggcccatgctggcttaggggctctaaggcgcccagactcacaggtgctgtgaagagctcctttattggggtgatggaatcggttccaaagagctggtttactgctgtgaagggatcgcagctttgaatttcaagctctggttctcagtcctcgggcacctgtgcgtgaatctgcaacaggagtcgcctctactgttggacttgtaagacagggcggcaagctggcccccatacccgaggaaggacccagctgttcagaataaccgcttctagacatgctaggaagagtggtcagggagctacgcttcccacacactacccagtagaatcctccaggctccgtctgcgcaattgtgctccccagcccatccacccgggggcaagacggaactcctcgtctactcaccgctgccgcaaggctgggccaagttaaggccccacgcactttggcatccgggccagggatggtctccagaccccacagggtgaagcggctgaagttggcagtggctccaatgaagcggtcctggggaaggggcctggctcagcatcgggactacagctcccgcccgcaccccctttcaaccctatccctttgctcacgaagtcccgctccagcggctcctcctcttggtcgtcagtcccggaatcccgcaaggggtctggcttccccatcgacaccttcttctcttctgtcaccatcacgtatcccacgaggccaggcggcaccgccacctcctctccccgtagacagcggccccgaaacgacacttcgagtcctggagcgggaggcgcaaagggcctcaggcaggacccacgctgggtcgagcccggagctgccctcccgccacctccggacggaccacgatccccaggagcccaggcgatgagaagcgcgcaggccggcgcgggggctgccgggagccgtagtccggccgcagggctcaccctcggggccctggcggatggcgggcgtgaagaagcgccccaccggggcgggcccgtccaccgcaacctcgcagggcagcagatgcagtgtggcgggtacggcgtcgcgcaatgtggcggagcgcaagtggacgcggtgcctctcgatggccgcttcgtcgccgctctccatcctccctcctacgcgacgccagggctcgcgagctgacactgaagctggcgcggaaagcgcgcaggacctctcaggaagcctccgcggggcctcacgggaagccgccgcggagcttcacgggaagtgtagtccccttaccccctaacgctttccctgggttcaagtcctagggttttccagttgtgttttgtttttttccttccttccttcccccctcccctctttcctccctcccctctccccctctccttccccctcccccctccttccccctcccccctccccctcctccctgcctcccttccttccccccttcccttcccttccttcccgtccttccctctttctttctttttcttatttattattatttttttttgacagagtctcgttttgtcgcccaggctggagtgccaggcacggtctcagctcactgcaacctccgcctcccgggttcaagcgattctcctgcctcagcctccggagtagctgggattacaggcgcacaccaccatgcccacctaatttttgtatttttagtagagactgggtttcgccatgttggccaggctggtctcgaactcctgacctcaggcgatcctccagcctcggccttctgaagtacttggattacaggcgtgagacaccgcccccagccgggtttttttcttttattgtttttaatggcacatgtcgttgtaaaaatctaaaacgattctgaaaagtactctttttatattgattagtaggtaggttattcatttttagtttattagggacatcaacccttttcttaaatgcattgaaaatgttttatctgtggtctgtcttgcaaacctgtgtaaaggtgatttttgctggacaaggacttatttttgtggttgtttggtcttttagacaaggtctcactcgcctaggctggagtgcagtggtttgattggctcactgcagcctcgacctcccaggcttaatccatcccccatcctcagcttcctgtgtagctggaaccacaggcctgcgccaccacgcagctaatttttgtatttttggtagaggtggagttttgccatgttgcccaggctggtcttgaactcctggactcaagtgatctgcccaccttggcctcccaaatcacgctggaattacaggcgtgagccactgcacccaggacaaagactaattttttgtagtcaaatttatcaacacttttcagtcttttagatttcacaattttctctctttggtttctcagctcttctctaatgtttatttgttcagacacccaacttagatatattttttcaagttctcacataaaacaaacacaaaactggaaatttagatttaaattgcgtttaatttatacatccctgcacatctgggagctggccttggtattctgttgaatataaacaatttcagagaacatcagcatcggacaaggtcactctgtgaccgtgagggagcaagacagaaacagaaccactccatcgtcacatctgaatgctggcaaaggtgaacactgtccaaaccacaaaaggcatgaaacatccctctttctcccataagagagtgactgttgtttccttaccaattacagcattagcctccaactaatcttctctccttctgggcaagactcattaagatagtccgtcatagacatacccccacctctgacagcatccaagccagagagaagcctggcttccctaaaccctgactgaaatcactgaacatgggcacaaatcctcctataagtcctttctagcaccctcttattgaaattccccagagtgcaggagtaatatacccaatttgttcaactgcagatgtattcctggtgctctttcactagagtggcagattaatttagaaaaaggcttgctttagttttctatcaggaaagacataattcaatttattcacatctccttggatatctgtacagttgtgaggttttgttcatatataatagctattaatacatattgtaaagtttatttcttcttagcttatattaataattgtttctattaagaactgaggggctgggcatgatgattcacacctgtaattccagtgctttaggaggccaagatgggggaggattgcttgaagccaggagtttgagaccggcctgggaaacatagcaagactccgttcctacaaagaaaaaaatttttttaaacatgagtggggcacagtggcatgtgcctgtagtcccagctactcaagaagctaaggtgggaagatcacttaagccaaggagtttgaggctgccgttcgagtcacgattgcaccactgcacaccagcctgggttacggagggagaccctttctctaaaaaccaaaattggggcttttatttttttcattttattttctaactgattttctttttaatctatagcaggggttggcaaactttttctgtaaggggtcaaatagtaaatattttaggttttgtggactttatggcttctgtcgcagctactcaacttcaccgttatagcatgaaagcagtcatagacaatacataaatgaatgagcgttgttgtgttccagtaaatctttgcagaaacagacaaggggttggatttgaaccacaggccatagttttcagaccccttgtctatagcaaacctgttgatttttatatgtccatttttaaactagatatcgactgaattattttgttcctaatgatttttattttattttaagatccccagaattagtcacctctctttcaaataataatttttacctcaccattacatcttctttttgttttttgttttttgttttttttttttcattacaccttgtaatttgttttcttttctaattgccttggccagtacttgcagaacagtctctcaaatgttactggtatcagaggacaacattgtctttttcctgaaactttcacgggagtgcttctgctgtttcaccaataatcatgaaactgccttttgacttgttatatatgtctcattaaagctgtactactaagagcttttaaaaattgggagtagatgttggatcttattttttatttttatgtttttggttttgcaagtttcctgtagtctggatattagtaattgcattcctatagtgtcaaggtaatctatacctgtattttctgtaattacatctagaagcttaattcgattctttggggaggggagagggcaagactacttcatgggtggttttgtgtttttccctctttttgtgaggttagcagccatagatgatcattgcctagatcctttaattcattagaggttaaaacgcgtgtgtacgcgcacacacacacacacacacacatatttttgggacagagtctcacctggtagcccaggctggagcgcggtggcgcgatcttggctcactcagctcaacctctgtctcccgggttcaagcaattctcctgccttggcctcctgagtagctgggattacaggcgcatgccaccatgccaggctaatttttgtatttttagtagagatggggttttaccatgttggccaggctggtctccaaatccttacctcaagtgatctgctcccctcccttgggctcccaaagtgctgggatcacaggcgtgaggcatggtgcccagcctaaaactgatattctaagtcctctcatttcttcttcatttactagctgaaataggtctataaagaaaaactctccccatcagccatttgattgcctgttggtacagtgaggataagaaagacaaaataattaggccgggcacagtggctcacacctgtaatcccagcactttgggaagctgaggtgggtggatcacttgaggtcaggagttcgggaccagcctggccaacacggtgaaaccttatctctactaaaaaatacaaaaattagccgggcgtggtggcgcatgcctgtaatcccagctactcaggaggctgaggcaggagaactgcttgaacccgggaggtggaggttgcagtgaactgagatcgagccactgcactccagcctgggtgacagagcgagactgcatctcaaaaaaatccttttattttccagttcttaaaataatgatttgttgccctagcatattccaatggtgaccttttaaaaatgttaaataaatattaaataaataaatataaataaaaataataaataatggattaacacttttatgtttcacataattgtggttattattcttactgaggtgcaaatttccccatcttctgccagtggaagcctcttcaagttatctcctgaatctttcgatatgaccctagtgatcttttatacatatctttgttttccagtaccacaagatgttcctggctcatcttgtacatttcctgccccagacttggaattatacatctctccaaagatcgctggttcccttcagtgggaaatgatatttagtaatccaatctgatactagatgtattcattgctactgagttagcctttgtttctagatatttccagtggacaaagctaggaaatacgcatttttttcctctccttttttttttttttttttttgagacagagtccgctctgtcagccaggctggagtgcagtggcacaatctcggctcactgcaacctccgtctcctgggctcaagcaattctcctgattctcctgcctcagcctcccgagtagctgggattacaggcgcccaccaccatgcccggctgatttttttatatttatttatttatttttgagacgcagtctcactctgtcagccaggttggagtgcaatggtgagatctcggctcactgcaacctctgcctcccaggttcaagcaattctcctgcctcagcctcccgagtagctgggactacaggcgcccgccaccacgcccggctaattctttgtgtgtttagtagagacggggtttcaccgtgttcgccaggatggtctcgatctcctgacctcgtgatccgcccgccttggcctcccaaagtgctgggattacaggcgtgagccaccgcgcccggccaggaggcttagtcttaataaaaacttggaaagaaagattcccctgaggatcaattacaaccgaaatgacagagcccctatcaggtgttgttgagtatcccctctgctgctaaacttcagggaataacttgttgggtacacctgtctaggattaaacctgtttcttatgagtcacaggcacaaaagcaggataccacgacctacatctgtgaacctttggaggacctctgctacctatttaaaagaatcaatattcagccataagtggtaacgtgacgccgtgggtgggaacatttttctcttcttcctgattgtaatacttcttttctgtcgctttgggcaactacctcctcccaggaaacatctcttgtccttgttgggtgtagaggccactctaaggcccaggtggataccatgtgccactgttaatcctgttgctctcccaattaacctaatcctgtgtaagtgggaacaaaactttatagtaaatatttcaaaaattatagctttaggaaatcatcttcatggttgctggatttgtcatcaacatccccaggatagagaatttcaccttctggccgatccaaaaactctcttggctaactccctagccctcttcaccatccatagcaatctcaaagtacccagaccccgaccattaggtggaaatttctgtcgtgcacttgatggattctacctgaaatcccccaccactattgcctggacctgggaaggcgtatgtctagatctccagggcactcatgattctatcaaggcatgtatctagatctctagggcactcatgattctgtcaaggcgtgtatctagatctccagggcactaatgattctatcttttgcaaccactgttgtgttaatgacacaaaagtggaagtttccccacaatgctgtgacccaactgtagttgccaagttcccaaggccacagcaagataaataagattccacttgtgagcaaggagaccatatacagtgccttctcccagagcagaacatacagagaaaaaaacaactgcctaatctgggaaggtgagattaccgcccccttctggaaaacaagggctgacctagaggaagcttctccatccttgaatctacatctggttcggcctgcctacctccactcctgcctccatcgtgtccatcacggtgacccagaagccctacaaggcatccatctctggcccctgggccttcagcagccgctcctacaccagtggtcccggtgcccacatcagctccttgagcttctcccaagtgggcagcagcagcagcttctggagtggcctaggcaccagcatgagtctgggtggtggctatggtggggcagtggtatggggtgggggtgggcgacacagccatcatggtgaaccagagtctgctgagcccccttaagctggacctggaccccaatatccaggctgtgcatacccaggagaaggagcagatcaagaccctcaacaagtttgcctccttcatcgacaaggtgcagttcctggagcagcagaacaaatgctggagactaagtggagcatcctgcagcagcagaagacagctgggagcaacatggacagcgtgtttgagagccacatccacagccttgggcagcagctggacactgggccaggagaagctgaaggtggaggcagatcttggcaacacgcaggggctgctggaagacttcaacgataagtaccaggatgagatcaacgagcggacagagatggggaatgaatttgccttcatcgagaaggatgtggatggagcttacatgaacaaggcagtgctggagtctcacctggaagggctgactgacaagatcaacttccccagagagctgtgtgaagaggagatctggaagctgcagtcccagatctcggacacgtctgtgtgctgtccatggacaacagccactccctggacgtggatggcatcatcgcggaggtcaacgcccagtacgaggagatcgcccactgcggccaggcaaggctaagagtctgcaccaggtcaaggatgaggagttgcagacactggctgggaagcacggggatgacctgcgtcgcgggaagatggagaactctgagatgatccgcaacatcagcggggtccatgctgagattgagggcctcagaggccatcgcggatgctgagcagcgtggggagctggtggagctggaggctgccctgtagcaggccaagcaggacctggcgccggccaagcaggacctggcgccgcagctgcttaagtagacagctgagctcggcctcccggggcctcacaagccctggcctcagctacggcctgggccccagccttgactctggcagggatttcagctccttcagccgcaccagctcctccaggaccatggttgggaagctggtgtccgagtcctctgatgtcctgcccaagcgaacaactatggcagtccctcccagcctaccccctcttgcagctgccccagagcttgtgggggaggctgctgtgcaggaaagcgcagggaacaggagacccacttgaggctcagccctcctccacagcccacttgtgtggggtaactcccttgcccatgcctccatcacaaaacaattccactgttttgttttgttttgttttgttttttcaagataaagcctcagctagctctgtcaactgtcaaaaagcaaaaaacaaacaaaacccagaaaaccctaccagggttgtttggtcctccccgttggaatggggggagatatcttgtatctccacagacccaacttagtggctaaagataggcatcacacctcacagggcctctattgcaccccaaatgggttcgttttcatttgtggtcataagtgggaagaagtcacatcccataaccactcctaactccccagaggacctcctgttcttttaggagtagctttcctttgtatatcaaaaacttggaacaggggtgagtgtatgttggccaccctttggccttccgggggtcaccatataaaaccctgtaagaccgaggaataccagaaatgaatgatcaataggattaattctgacatgaactggagtggcattagaactagtggccccctggggtggctttgcctaccatgagttggccctaaagaactgactcaaaccctggaatcattagccaccaacacaggtcaggcattaaaaggaattcagggattcctagactctttggcaaatgtagttcttgataagagactagcattggattatttactagctgaacaaggtggaggctgtgcagttatgaataaaacctggacaggttgagattaacattcacacgatctatcagcaatctatctggtcacatagatgctgggtcactgactccagctatatctgctcgattatcaaaaatgccctcccggccgggcacagtggctcatgtctgtaatcccagcacttgggaggccgaggcaagtgaattgcctgaagtcaggagttcgagaccagcctggccaacatggtgaatccctgtgtctactaaaaatacaaaaattagacgtacgtggtggcgggcgcctgtaatcccagctacttgggaggctgaggcaggagaattgcttgaacccgggaggcagaggttgcaatgagctgagatcgcgccattgaactccagcctgggcaacaagagcaagacttcatctcaaaaaaaaaaaaaaaaaacccctcccaagtctcacttggttcttacctctcctaggacctttgatagctgtcttgttattactaatctttggcccttgcttttttaacctcttttttttttgagatggagttttgctctttgttgcccaggctagagtgcaatggcacgatctcagctcactgcaacctccccctcctgggttcaaacgattctcctgcctcagcctcctgagtagctgggattacaggtgtgagccaccacacctggctaatttttgaattattagtagagatggggtttcaccatgttgtttcaccatgggctggtctcgaactcctgacctcaggtgatctgcccacctcggcctcccaaagtgctggaattataggcatgagccaccactcccggcctgcttgtttaacctcttaataaagtttgtgtcttctaggttacaacagttccaggtaaagacaatgctggcacaaggtttctaacccatccatcttctgacctagagaatgaaagcatcctgcctttgggccgccttgggtcaggtatctggagatttttactcctctagtgctatgcagggcctattcccatgaactcagcagggagcagttacagaacatggacctccacccttttgcaacccctttcagattaaggaggagtatctgatctctgaggggagaatgaggtaggaggcaggtgggactcgactgtgggccaggttgaagactggttgaaactgggaagagtctgtgtgtggtggctcatgcctgtaatgccagcactttgggaggccgagccgggtacatcacttgaggccaggagttcaagaccagcctggccaatatggtgaaacaccgtctctactaaaaatataaaaaattatacaaaaattagccaggtgtggtggcgggcgcctgtagtcccagatactcaggaggctgagacaggagaatcacttgaacctgggagacggaggttgcagtgagctgagatttcatcactgcactccagcctggctccatttcaaaagaaaagaaactgggaagagacactgaaggcacctttccataagacatgcccactaacgccatgactgtttaccattgccatggcaacacctgaaagttactgcccatttttgagctattttaaaataaccgaccccttaattagcataccattaagagtgggtataaatataactgcaaaagtgcccctaggctgctactctcagcacactgcctatgaggtagccctgcatggcaggagcagtcacggagctgtgacgttgccactgcttcaataaagctgttttcttctacccccggcttgctcttgaattccttcctgagtgaagccaagaatttgccctgcctcaccttgagataccataaacattttaggatggttatttaagaaatgtcagtgaaaaacatcatcatgactttgatagggattgcattgaatatgtagattgctttgggtagtattcacatcttagcaatattaactcttccaatccacaaacatgggaagtgtttccattaatttatgtcttctttaatttctttcagcaatgttttgtagtttctattgtataagtcgtttacctgttggttaattcctaaatattttattttatttaattatttgatttattttattttattttattttattttttgagatggagtttccctcttgtcgcccaggctggagtgcagtggcacgatctcggctcactgcaacctccgcctcctgggttcaagcgattctcctgcctcattctcccgagtagctgggatcacaggcgcctgccaccatgcctggctaatttttgtatttttagtagagacagggttttgccatgttggccaggctggtcttgaactcctgacctcaggtgatccacccgcctcagcctcccaaagtgctgggattacaggcataagctaccgcacccggccaatatttaattcttttgaatgcattgtaaatggaattgtttttaaatttccttttcagattgttagcacatagaaatgcgactttttatgtgtttacgttgtatgtgctactttgttgaaatcatttattaattctaacagttttttttttttgatgtgtggaacctttagaattttctacataaaagatcatatcaggcctgagcctggtggcttataacagtaatcatagcaaattgggaggctggggtgggagaatcacatgaggccaggagtttaagaatgcagtgagccatgattgtgccactgcactctagcctgggtaatagagtaagaccccaactaaaaaaaaaaggatcaatgtaatcagtgaacagagatgattttacttcttcctttccagtgtggatgccttttatttctttttcttgcctaattgctctggctagaatgttcagtgctatgttgaatggaaatagtgaaagcaagcatccttgctttgttcctgatattagaggaaatgttttcaatgtttcaccattgagtatggtgttcactgtgggtgttttatatatggctttttattatggtgagggtgtatacttctatttctagtttgttgagtgtttatttttatcatgaaaaggtgttgaattttgtcaaatgcttttgctgttagaaggggaagggtctgtataccgaaaactataaaacactgatgaaagaaatggaaggaggctgggcacggtggctcatgcctgtaatcccaacactttgcgagggccaggtgggcggatcacgaggtcagaagttcgagaccagcctttctaatatgctgaaaccctgtctctactaaaaatacaaaaagtagccgggcatggtggcgcatgcgtgtggtcctggctactcaggaggctgaggcagaagaatcacttgaactcaggaggtggaggttgcagtgagctgagatcgtgccgctgcactccagcctgggtaacagagtgaaactccatctcaaaaaaaaaaaaaaaaagaaatggaaggaaacacatataaatgcaaagatatcccatgttcatggattggaataattagtattgttaaaatgtccatagtaaccaaactacccaaatccacagaatcaatgcaatccttatcaaaattccaaagtctttttttataaaaaagaaaaaacaatcctcaagtccacatggaaccacaaaagaccccaaacagtcaaagcaatcctgagcaaaataacaaatctggaggcatcatactccctgatttcaaaatatattataaagttactgtaatcaaaatagcatggtactgccattaaaaaaaagatatatcaacacatggaacaggatataatgcccccaaaataaacccatacatttatggcaaattgatttttgacaaagatgccaagaatatacaatttgaaaaggatactctctttaataaatggtattgagaatgcagaagatgaaactagactcttatcttacactatatacaaaaatcaactcaaaatggattaaagacttaaatataaaacaaactgtaaaactactagaaaaaacatagaggaaaagatctatgacattggtctgagcaatgaatttttgaaaatgaccctgaaagcacaggcaacaaaagcaaaaatagacaaatgggatgatatcaaactaaaaagcctctgggcagcaaaggaatcaattaacagagtggagacaaaaacagaatgggagaaaatatttgcaaaccatatatctgataagcagttaatatccaaaatatataactcaaacaactcaatggcaagaaaacaaataacccagtgaattaatgggcaaaggacctgaacagacatttctcaaaatacatatgaatggccaaaggtatatgaaaaaatgctcaacgtgactaatcattagggaaatgcaaaccacaatgagatatcacctcacatgtgttagaatggctattattaaaaagatgaggctgggcatggtggctcatgcctataatcctagcattctgggaggccaaggcaagcagatcacctgaggtcaggagttctagaccagcctgaccaacatggtgaaaacccatctctactaaaaattaaaaaaaaaaaaaattagcctggcatggtgatgcacacctgtagtcccagctacttgggaggctaatgcaggagaatcacttgaacccgggaggcggaggttgaagtgagcggagatctcactactgcactccagcctgggcgacagggtgaaactgcttctcaaaaaaacaaacaaataaataaaaataagaaaataagaaaataaaaagatgaaagaaaaagtgttggcgaggatgtggagagaagggcactcttgtacactgttggtagaaatgtaaattagtgcagcccttatataaaagagtatgaaggttcctaaaaaactcaaaatagaactaccatatgatccagcaatcccattgttgggtatatatttaaaggaactgaaatgaatatgttgaagagacatctacaatctcatattcatcacagcattattcacaatagccaagatatggaatcaacctatgtgtccactggtggatgaaagaataaggaaagtgtggtgtatataaaaaacagaatactattcagcctttttttttttttcgtaaaaagggaattctggctggacgcggtggctcatgcctataatcccagcactttgggaagccgaggtgggcggatcacttgaggtcaggagtttgagaccagcctggccaacttggtgaaactctgtctgtactaaaaatacaaaaattagctgggcatggtggtgcgcacctgtaatcccagctactcaggaggttgaggcacgagaatcacttgaaccaggaggtagacgttgcagtgagccaagaccataccactgcactccagcttgggaggcagagtgaaactgcgtcaaaaaaaaaaaaaaaaaaaaggaaattctattatttgccacaacagggattaacctggagaacattatgttcagtgaaataagccaggcacagagagacaaataccacatgatctcacttatatgcaagatctaaaactgtccacctcatagccagctgcagtggctcatgcctgtaatcccagtgctttgggaggctaacatgagaggatttctttttcttttttttttttttgagatggagtcttgctctgttgccaggctggagtgcagtggcgtgatcttggctcactgcaacctccacctcctgggttcaagcgagtctcctgcctcagtttcctgagtagctgggactataggcacgtgccaccacacccagctaatttttgtatttttaatagagacggggtttcaccatgttggccaggatggtctcaatctcttgacctcatgatccacccaccttggcctcccaaagtgctgggattataggtgtgagccactgcacccagctgtgagaggatttcttgaggccaatagtttcagaccagcctgggcaacatagtgagaccccatctctacccccccaaaaaaaattagtcaggtgtggtgatgcacacctgtagctccagctactggagaggctgatgcaggaggatcacttgagcccaggagttcaagactacagtgagccatgattgtgccactacactccagcctgggtggcagagtaagaccccatctctaatacaatacagtaatataaaaatgttgtagaatgcaaagtattgttcctgggtgtgtctgtgagggtgttgccaaaggagattaacatttgagtcagtggactgggagaagcagacccacccttagtctggcgtggcaccatctaatcagctgccagcacagctagattaaaacaggcagaagaacatggaaggacttgacttgctgagccttccggctttcatctttctcccttgctggatgtttcctgccctcgaacatcagactccaagttcttcagcttttggactcttggacttacaccagtggtttgcagctctcgggcctttgttcacagactgaaggctgcactgttggcttccctacttttgaggttttgggtcttggactggcttccctgatcctcagcttgcagacagcctattgtgggacttcaccttgtgatcatgtgaatcattactcctcaataaactccccttcatatatacatctatcctattagttctgtccctttagagaactctaatatacctgtctaactgaaactttgtaccttttgagcaatatcttcccatttcccactctcccatgcccctagcctctggtaatctctggatacctgatctaaggggtccaacaggatattttcatttttcaggtcataagatgggatgggttgaaaccttgtgccagcatcatctttatgtggaatctagaagacataaacttaagtaggaggtcaacaggaaaattataatttggaggatgagaaaattaatgcatctatgcccatggcatcatgttttttatctttgtgtttgtgaaacaacagctttaagtcttataggagctcacaggtgtaaatcatggtgtcctcctcttatgccgtcagggattcataagaaacagatttaatcttggacaggtgtacccaactagtgattccctgaagtttaacagcagggaaggtacttaacaatacctgataggggctcttccatttgggttgtaattgatcctctggggatcctttttaacaaaaagttttttgtaagactaggtgttcaggttgaacagaggagctatttctttcctatgtgggaaagggaagtactttgttattataatttttgaagggcctttgtgcctagcctaaattctaaggggtggcacagtgaggcatgtttggccccctgtttcctgtcatggtctgacttctttttttttgaaggcttctttggaattccctttggctaagggacttagagtcaaaagacttatagccaattaaacatcctaggtcagaaggaaatggaggtgagcaggcactcatttgcccttaaaatcttttaaagcaatataagagtcaaaaactaaatgccaataataaggttatatgtaaaaaaaaaaaaaaaacagcatagaatcaagctatattcggggaaaacactgttttcgcagacctctaagacaaaacattttagtaccagggcccaatagtcagaaccagaggaaaaaaagtcacaatgttgatgaaaaggttgatggaaagagccatcatcccaggccttcttaaagggagaaagaattgaaagtagtgagacacaacaacagttgaatctctgagacatgaatccaagacattttaaaataaaccaggtagattattaaaagcaaaacttcctgtaatttagcaaatcaataccttaagaaaacctgttgccaatatatagaccattctctagaaagtctaccacagttttcctttagtcatagtcagcttaagcttaatcatacacaaaattccccttcacaaaccccatcatgacccacatggaccatctacaacatgcttggactttctgacttgtcctataggaccccttccttaaagaactcatcattttactctaggataagaatttactacacaagatccctcctcatataaaataactttgtattcttccttgtatccttctttatatccttccttgtatccttctttgtattcttccttgcaaaaagtacatctatccataactttcttcatatctctcttttctacttactggttccttcatattttgaacctctcttttaataacttccaaattagacaaaaattattatttttcccaataaaaaacacactttctttggcttattttatataaatctaaagagcaagaaattctgaactgctcatcagacattggcactctatagatgagaactatttcacagctttaagattttcaactatacataagctcactgtttaaaagccatcctaaccattctaaaggctacaaacatcagaggttcatctaggtaaaaatcttaaagttaaattttagaagacataacattcccttcaaactaataaatttagactagtcttattttttaatttatgaattctcttttatttataagccaatttgatagtatgctaaacacaacacccatcacacaaatgaagtgacctacacaagacagatggatccaagttacttataaaattgggacctgtctatctcaatacattttgtttgcccagatacgtagggaagacaggaagaggcagagaagggaccccatagcatcaaataaggaagggaggtggtaaaccatgttgctcaaggggaggtctcagagtccttgagctaccagagcatctagcagtggagacaccaaagaaaaatgttctggtggccacttgtcttccactgcaaaaagctgtccattgggtcaagggtccaggaatctgagtaaatttacttgagcaaggtggctcattgggacatatggaagaaggttagttctaatattgacggggagctttttccctcgtttgctggggatggttaggacattctcattgtgaatggtccttttgcttatagtaggcacattgattctggaccaggagccagtgagttgggggctctcatctgggcatcccagatggtgatcttgtgacactttctcaggataggtaattctaaggtggcaggggacttaaagtaacagctaacaattgcactttttggctatttcttttcttttttgagacagggtctcactccagttgcccaggctggagttgcagtgcattatctcagcttactgcagcctcaacctcctgggctcaggtgattctcccacctcagcctcctcagtatctaggaccacaggcatacaccaccatgcacagcgaattttttgtatttttagtagagacagagtttcatcatgttgcctgggctagagctgtttcttttgtcttttttttttcaactctttttccctgtccctattgttgtaaattttaaaggccaagtttaaatattggctcataggggtttgagcttccattgttgctttttgtagcttcctcctaatgtcaggggcaacttgagtaataaaatgcataaccagaagagtttgccttctgggaagtctgggtctgcgttagtgtatttcctgagtgcctcaaccaaacaactttgaaacagagtgggattttcatcttttccctgagttatttctctaactttgtcataattggctggcttaactacacactttttcctccacttttttttccggcatggcacagcagggagacaacaatacttgcaagtcacggcaagttaaatttaaaaaattgtcaaccaattcttctataaacttttctagattttctgaaaactggccaaattttttgcataaagccaaatctgacatagaaaatggaacatgtattctaagtatcaccccatttccatcggttacctcctacaatggacacaagttttattttggaggctaatatggggccccactcctggtggtactggttgggcttactaccttgggaagtgaggaatatgggctggggctagttggataagggtgcctgataaacttggggtggacttcctcagaactgggggactgaggagactccaggaaagatgtaggccttctagtgggaacagctaggagggaaacccttaggcatggcttccgggttcctgggagtaatatgagccaataaaggaccataaaagcctgtacataaaggacctcctcccattttccttattttatatagaataagtccaattgtaaaatagcgtcacaatatatagaaccaaatctatatattaggccaaatctcttggttttctaatttgttttggacccaagtggtgctacaatagaaaatgagtttctttttctttaggttgaatttgaatttgctccaacagcctaaaagacaccctagtggtaagtcttctgggatgttcatcattgtctccatgtctaacaaggatttatactggacatagaagtttttcttttctttttcttttttcttttttttttttttttgagatggagtttcgctcttgttgcccaggctgtagtgcaatggcacaatcttggctcactgccacctccgtttcccggattcaagcagttctcctgcctcagcctcctgagtagctgggattacaggcgtgcaccaccacgcctggctaattttgtatttttttactagagatggaatttcaccatgttggtcaggctggtctcgaactcctgacctcaagtaatccacccgccttggcctcccaaagtgttgggattacaggcgtgagccactgcgcctggccagaggtttttctaagtctagtgagagggaaaacaactgggctctcattatttttcccttttagattctcacttcctgcagaggtataagcaaggcattatgaaagtggattataggcattttccagtggatgaagtacgacaaagaaagtatttttatcaagcaaaatgtagaaggaaaagtgtaaatgaagtgacaagaaaagaaaatgctgttacagaaaataactttaactttaaggcagaaaacaagaaaaggcaagactgagattcccctagggtgggcctctatcccacaatcctgagagacagtaccaataccaaaacccttggagtgcccagggggcagccagcagtgaacctcaaaggcctggttggggccacagaacaacatgactctggtgtcccagggtcaacacaacaggggacctctcaaagacaagtgttctgccttaaacaactgcccaaatagtttatcagggaactaaagcaaaaactacaaatgaaacatacatttcagagaaaaaattaaaataaaataaaaggctgggcatggtggctcatgcctgtaatctttgcactttgggaggctgaggcaggtggattgcttgagctcaggagttcgagaccagcctgggcaacatggtgaaaccctgtctctaccaaaaatacaaaaaattaaccaagtgtggtggcatgcacctgtggtcccagctactcaggaggctgaggtgggaggatcgcttgagcccaggaggtggaggttgcagtgagccaagatcatgccactgcagtccagcttggatacagagtgagactccatctcaaacaatgaatacataaataaaaagaaaaagaaaaatatttaaaataaaaaataaatgaaatggcaatggaaaaatgaaaagatgttagggaaaggaccgagagaaggagtgacaaggacgtagttggtcaggtatgccatgggagactttgaaatgacaatctaagatgcccaaagccttatttcctggcttactcaatatcaaggggcagaggggacagtcacccatctgcaggagccaaaatggactagtcagtctccaacctggggcctgggttaagggctcctccccaagtttcctcagcttgaacaggctcagctaccatggggggtactggcgcacaggccagtgatctgctggtcagagtggtgggtcccacacaaggcagtggctctgtggctgctcacctgcctacttggctccactgcctgccaggaaaggtaatggctcttaaaagagcctttggctagtcttacagctctgcagcttgtattgctgtagcaccaatcaccatctcacctactctcattcatcgctgtcttgctgcctctcattgcctctctcttattgctgccccttccctgtccgccgccttgccaatctctgtctagctgatcgccatttctcactgtctctcatcgtctcacctctctgccaatcgtggatcaccagtctcactgtcaatcactgtctctcaccatctgtccactgattgctgctgtctctgctgtcacatcacttctctgctgatcgctggtcaccactatctcactgccacttcaccagtcaccaatagctgtcatctctgctgtctttgtcgtctttgtggtcaccagatgatacaggacaggtaagccccaaaactggggctgagcttgggtgagttcttggcttcacccaggaaagaattcaagggtgagccagtggtgttagacagcagcaacttttactgaatggtgctgctccttgcagaccatgactaactcattggcagtgcacccagagtaagaaatgtatgggtttggccaggcatggtggctcgcatctgtaattccagcactttgggaggccgaggcaggcacatcacttgaggtcaggagttccagaccatcctggccaacattttgaaacctcgtgtctactaaaaatacaaaaattagctgggtgtggtggtgagcgcctgtaatccaagctactcgggaggctgaggcagtagaatcacttaaacccaggaggcagaagttgcagcgagccaagatggtgcattgcactccagcctgagcgacagagcgagactccgtctcaaaacaaaacaaaacaaaacaaaaaatgccaggcatggtggctcacgcctgtaatcccagcactttgggaggctgagttgggtggatcatgaggtcaggagttcaagaccagcccggccaacatagtgaaaccccgtctctactaaaaatacaaaaattatccaggcatggtggcgggtgcctgtcccagatacttgggaagctgacacaggagaatctcttgaacccaggagtcggaggttgcagtgagccaagatcacaccgctgcactccagcctggatgacatggtgagactttatctcaaaaaaagaagaaaaaaaaaaagaaatgtatggggtcttgacaactgtgtttatattcacttaaatgcattttcaattatattcaaattaaggcgtgagtcaattcaaattgaggggctagttatttagaactttctaggaaagagacagtaacctccaagttgttggcatggaaaggggtggtagcttccaggtcattgccatggcatttctaaatggtcacagtacttgtgggagtgtcttatgctaatgaataatgagggcagccagggatcactttccttgctatctgctggttcctgccagtttcctcactttatcctgtctagatcagatcctgttttggtcagcagtgttgtgatcagaaaacaagtcctactggtctcctacctcagaaagagcataggattggctaatttgaataactctggtgggtttgggggcataggggctgtcccttgttgtctagcacctggccctgatttgattcagggcaggagaaatattggtttggtgattgagggttacataagaaagtagttcagagtatgggctctggatcacaggaaagatggaaacaactttagccattagtttggcccttaggttaatggatgccaaatagacaaatacagaatctaagtaatcacagtacagtgctctgaaccaatgacctatatgtgatgttttttctcttttggtcacaatacaacagtctaggaaccaagggttagaggtgggagtggcttctcttacttatatataatgaccatctgtcttagtctgtttgggctgctaaaacaaaaccccatacactgggtagtttataaacaacagaagtttatttctcacagtctgaaggctgggaagtccaagatcaagacactatcagattcggtatctgccaaggacccatttcctggttcacagatggcgccttcttgccgtatcctcgcatggtggaaggggcaaggcagctttcttggcccttttttttttttttttttttttgagacggagtctcgctctgtcacccaggctagagtgcagtggcgtgatctcggctcactgcaagctctgcctcccgggttcatgccattctcctgcctcagcctccggagcagctggaactacaggcgcccgccaccacgcccggctgatttttttgtatttttagtagagacggggtctcaccgtgttagccaggatggtctcgatctcctgaccttgtgatccgcccgcctcagcctcccaaagtgctgggattacaggcgtgagccaccgcaccctcttggccctttttaataagggcactgatctcattcatgacagttccaccctcatgactaatcatctcaccccaagccctatctcctagttccatcgcctttacggttgggatttcaacctgtaaattttagggagacaaacatttagaccataccaccatctcattacttttctcaactcttattgaacatagttttggacttagagagaacttgcaaaagtagtacaaagagttcttaaatattcctcacctggcttctcctaatggcagcggcagcccgtcgggagctgcagctgccaagatgcaggctgcagcgtgggagtcgcagaggaggaggcacagccggggctgtgtggcccaaggggccagcgggagctgggaacaggtgaaagcctcaccccctgccgagttggcagggcaggagccagtgcccctggtgcagccgcagccacccagctgcagctccagaccccagcatccctgcgctcttcagggcccaggaagccttttgcccccacaggcttaaaagtgcctgctcccgctccctggcctctccccactcctggcacccgctctggggtggagcaaagttgtggcccagcctgggtgctgttgcaacccagctgggtgtgtgcacactcaaggtggcattgacacgccagccccctgccaccttggccacctccagattttgggcactgataagcatgggagggaggccaaggcggggctgggttcgggcctgcagtctcccctcagcatgaacagcctgggcaccatggacaggacagcatgttgatggtggcaggaggcagacaggctcctgggcggaaaggggtggtcccggtgaaaccctaccttcaagccagaaatggcctgaagcctgggagctgggctgccagttctgggtggagtccgaagtcctgagtgagaatttacggtgctttttccaggcccgcccatggccgtccatgggccaatcagcacgcacttcctcccttctgatcctataaatacccaggactcaaccagactccaaccgacttcgggactaccagcagagggaagcagcggcccacttcgggcctcctggactcttcaggatgacctgtctgcagaaaggagctacccactgggggtctctcctctgctgagagctggtcactcggggaacaacctgcctgtagaaaggagctacccatttcgggtctcctgagagctgttctgtcgcttagtgaagctcctctccaccttgctcaccctccagttgtccatgtacttcattcttcctggtcacacgacaagaacttaggacctgccaaatggcaggactgaaagagctgtaacacaaacagggctaaaacacgtccctgccgtatcccccaacccttgccatgttgtgagagacgaggagagaagagctgaggcccttccgggaccccagacctaggggctccccaaaccaggggctgtgacagcctctttggggctctgcagttcctggcatctccaagcttctgggtgccactgtgttcccctcgtccagacacgggtgcccgcagcggaagctgtgtgtattacatctggtccagccgcagcctcgcatggagccggcacctgtgctgacacccagagctgcctgccctgcggcagcggccagtgtgcctgttccgcgcggtggctggaccccacactcgctggttcacacacccttggcttggcccttggcaggtgtaggatctgtgctggtagcactagccaaatgcagcctcccaggccgggtgtgtggaataagcccagtgggtgcaaaacccaaggacaggcgccgcgggccatggaggtttccagctggcaaagcgacaccctaaggatactgtgacactaatgttatcatcttccatatccatagtccaatgatcaaaaccaggaaacctgcactgataaaataagactaactgatctgtagtcgttactagaattttgccagtttttccgttaatgccctttttctggtacaggattgactccagggtctcacattgtgtctagtttccgtgccttctagtcttctgtgacagttcctttgtgattctgtgatgactgtgacttgagcactgaccattattttgtagagtatctctccattaggatttggttgatgtcttctcctaattagatggtcggtatttctggcaagaatgtcacgtaagtgctcttgcacccttctcaatgcagcacattactgctcctattcctggtgctttgatcacttgcttaaagttgtgtctgtcttctgtcagagttctccactgtgaagttactagtctttattttgtaatcataagtgtcttgtagggaactattttgagactatgcaaataacctgttcctcaccatgcttttgcccacagatttgagcattgattcatgattcttgcctgaaacaattattattatggtgtttccctaatggtgattttctatttccatcattctttctacatttcttttctttttggagatagcatttcactttgctgcacaagctggagtgcagtagtgcaatcatggctcactgcagccttgaccttctgggctcaagcaatcctcctgcctcagcttcccaagtaactaggactacagggacacaataccatgcccaactaatttttaaattttttttgtagagatgaggtctcattatattgcccaggctatacattttaaaatttgcattctggggctgttctttctccctaatttatttatttattcaatgatttatttacatcaacatgggctcatggatatttactctaaagattttaatttaggtcaggcatggtggctcacacctgtaatcccggtaatttgagaggctgagttgggcagattacttgagtcccggagtttgagatgagcctgggcaacatgctgagaccctgtctctactaaaactacaaaaaattagccaggtgtggtggtgcaagcctgtagtccctgctactcaggagattgaggtaggaggatcacttaagcctgggaggttgaggctgcagtgagccctgattgtgccactgcactccagcctgggcgatagagtgagaccctgcctcaaaaaaaaaaaaaagattttaatttattactctcattatttattttgttgctcatcttgttccagatttggccattgagatgtctttcaattttgctgcttttgtacgttcatcattaaaaaatttttatatcaatatttatttcacctaccataaaattctcccttttagttgggcatggtggcatgcatttgtagtctcagctactcaggagactgaggtggaaggatcacttgcctccaggagttcaagatcagtcttggcaacatagcaagaccccatctcaaaaaaaattccttttaaagtgtaaaatttagttattttaatatatttataagattctggagtcatcacaactatctaattccaaaatattttcactacccccaaaggaaatgccatattatttctcacagttttttgttttgttttgttttgagacagagtctcgctctttcacccaggtcacttccatttctcattttcccagcctctggcaaccacgaatttactttctttatggatttgcctattttggacatttcacataaatgaaaccatataatatgtggctttttgtgtctggcttcttctttcacttagcataatattttcaaggtttaaccatgatgcaggatgtattagtatttcattccttttcatggttgaataatacgacattatatggctatactacatgttgtttatccattcacccattgatgtatattgggttgtgctatggttagagcatttgtgtcccctccaaacttcatgttgaaacttaatccccgatgcagtagtattgagagggagggtctttgggagctgattaggccatgagtgcaccaccgaggacccaacaataaggtgccacctcagaagcagagactggaccttaccagacaccatgcctgctggagacttgatcttggatgtcctagcttccagaactgtgagaaataatatgttattgtttataaatcacccagtctgtagtatgttgttatagcagcacaagtggactaagacaggttgtttccacttttgggtctttgtgaataatgctatcatgaacacagatatacatgtttctatgtgaatacacattttcagttatcttgggtatatacctaggagtgtgtatcagtttgctagggctgccataacaaaataccacaggctgggtgacctaataaacagagatttctttaatcataggtctagaggcgagaaatagatcaagatcacggttaatttctggtgagatctctctttctggcttgtagacagtcacctcctcactgtgtcttcacatggtcttcttctctgtgcatgtgtgcagagagagagctctctggtctctcttcagtttcttatatggacaccaatcctactgaattggagccctgtccttatgattcacgtaacatgaatcacctccctaagggccctgcctccaaatatagtcacattgggggttagggctttaacatatgaatttggggtgggggaccaaatcagcctataacagggagtggaattgctgggttacatggtaactttgtttaagtttttgaggaactaccaaacagttttccaaagcattttcatcattctatatcaccaccagcaatgtatgagggttccaattagtccatgtcttcaccagtacttgatactgtccgtccttttaatggtagctattctagtgtttgtaaggtgcaatctcattgtgttttcctatcttgcatttccctaatgaatgattttgtgcatcttttcatattcttattggacacttgtacatctttggagaaatgtctattcaagtcgtttgctcattttttgatgaaataatttatctttttgttgttgagttgcaagaaatcttccttcatgttttccagatatcaaacccttaatctgttttatgattatcaaatattttatcccactttgcaggttgcctttttattgttgatagtgttctttgatgcacaatttaatattttgatggagtccaattcacatatttttatattttttcttttgttgcttatgcttttggtatcatatctaagaaaccattgccaaatctaagcccatgaaattttacccctattttttattctaagcattttatagttttagctcttatagttaggtctttgatccattttgagttaattttgtatatggtgtgaggtgggggtccaattttattcttttgaatgtggatatccctttgtcctagctccatttgttgatgagattgttctttcacccttaaatagtcttggcacccttgtcaaacattaattgaccataaatgagtgtttatctctgggctctcaaattttttccattggtctatatgtcaattttatgctagcaacactgttttgattactgtagctttgtagtaagttttgaaatcaagaagtgtgaatcatttttctaaatttttatttttagagcagttttagattcacagcaaaatcaagcagaagatacagagatttcctatagaccctctgctcccacacatgcacagcctctccaactatcaatcccccacaccagaacaccagagtggtagttttttgtcctggtggattcgaggctggagttgccccaaaagctgaggtatgggaattgccccaaactgtcagttagaatccaaagaaagaagaactaaatgctagggtggttagtccatttcccagggaaacttacagagtgcttcagtgtatcataacaacagacagcaagaaaaaaggatggtctgtctagctaggcatgcctgcaacaagggagttggtgtatgagtttatatgttggtttaaagagcctggctcagtgcttgggcttgtttccttcagggttttgagcaataacctaaacaccttattcagtgcctgggaatattcgagtccccggcttggggtcaagccagcagagaaaaacatacagatgccaaggcactctgtttctctgtcagaacaagagaaaaagtgagggggaacggggaggtcttacattagttacaattgatgaacatacgttggcacatcattattatccaacatctatagtttacattgaggcttactccaggtggtgtacattctataagttttgacaaatatataatgatctgtatccaccattatagtattagatagcgtggtttcactgccctgaaactcctctgtactccctgtattcatccctctttctcccttaacctctggcaaccactgatccttttgctgttgcatagttttaccattttcagaatgtcatgtagttggaatcctacagcatgtagccttttcagattggcttctttcacttagtgatacgcgtttaaggttctttcatgtcacttaatggcttgatagtacatttctttttagcaatgaataatattccattatctgttcacctactgaaggacatcttggttgcttccaagttttggcaattataaataaagctgctaaaacatccatgtgcatgtttgtgtgtgtgtgtgtacacaagttttcaactcatttgaataaaaggagtgcaactgctggataatatggtaagaatatgtctaattttgtaagaaaccaccaaattactttccaaagtggctgtaccattttgcattcccacttgcaatgaatgagagttctattactacacattctcaccaggtttggtgttgtcagcgttttggggttttgccattataataggtgtggggtggtatctcattattttaatttgcaatttcctaatgacatatgaggttgaacatctttttatatgcttattgccatttgtatattttcttttgaggtgcctcttcaggatattttgctcatttttaaatcaggttgttttttttcttactgttgagttttaagggttctttgtatattttctcttcttttctttcctttttttcttttttttttttttttagatgaagtctcgctctgtcgcctaggctggagtacagtggcacgatctctgctcactgcaacctctgcctcccaggtcaagtgattctcctgcctcagcctcctgagtagctggtactacaggtgtgcgccaccatgcctggctatttttttttgtatttttaggaaagacagggttttgccatgttggtcaggctggtctcgaactcctgacctcaaatgatttgcctgccttggcttcccaaagtgctggattatgggcataagccaccatgctttgtatattttccataacagtactttttcagaaatgtcttttgcaaatatttttctcccagtctgtggattgtcttctcattttcttgacattgtattttacagagcaggtttttaattttaatgaagtccaacttatcaattatttcttttgtggatcaggcctttggtgttatatctaaaaagtatttgccatacccaaggtcatctagatttgttcctatgttatcttctatgagttttacagttttgtattttacatttaggtctatgatccatttcaagttaatttttgtggagggtttaaggtttgtgtctagattctttttttctttttctttctttcttttttttttttgcatgtgatgcccagttgtcccagcaccatttgttgcacagactatctttgctctatttgtattgcctttgcccctttgttaatgatcaggtggctatatttatgtgagtctgtttctgggctctttattctagtccatagatggatttgtccgctcttttgccagtaccacagtgtcttgattactgtagctatatagtaagtcctgaagttgaatggtgttagtcctctgagtttgttctcctttaatattgtgatggctactctgggtatctttggtggtggtgatgtttgttttaaatgtctccatataaacttcagaatcagtttgtcaatataagaaataacttgctggaatattgattgggattgcattgaatctatagaccaagttaggaagaaccgatatcttaacaatattgagtcttcctaaccatgaacgtggaacattatttatttagtacttctttgttttctttcatcagagtttcatagtttttaaaaaatatataaatcttgtacatattttgttagatttgtacttaagtatttcattctggagggagctgatgtaaatgataccgtattgtgtgtgtgtgtttgttttgagacaggatctcaatctgtcactgaggctggagcgcagtggtgtgatcatagctcactgaatcctcagcctcctgggctcaagcaattctcccatctcagcctcccccgtagctggaactacaggcatatgccccatacccagctaattttttttggtagagatggggtctcatcatgttgcccaggctggtctcaaactcctgggctcaagcaatcctcctgccttggcctcccaaagtgctgggattacaggtgtgatccactgtgcccagcctgcattttttatattttatattttttattttttaggtacatagtaggtgtatatatttatgggttacatgagatgttttgatacaggcatgcaatgcataataatcatattcaggtaaatagggtattcatcactgcaagcattgaacctttatgtttcaaacaatccaattatactctattaattgtttttaaatgtacaattaaattattttttgctatagttaccttgttgtgctagcaaatagtaggtcttatttattctttctaactatttttttgtacccatcaaccatctccccttccatcaccagcccccaccgccaactacccttcctggtctctggcaaccatccttctcctatctccatgagttcaattgttttcatttttagcccccacagataagtgagaacaggtaatgtttgtctttctgtgcctggcttatttcacttaacataatgttccccagttccatccattttattgcaaatgacaggatctcgttcttttctatagctgtatggtactccattgtgtatatgtaccacattttcttaatccatttatctgttaatggacatttaggttgctccggagtcttagctattgtgaatactgctgtaataaacatggaagtgcagacatctctttgaaatactgatttccttttctgcgggtatatatctagaagtgggattgctggatcatatggtagctctgtttttagttttttgagggacctccacaatgttttccacagtggttgcactaatttaccttcccaccaacagtgtacaagggttgccttttctccacatcctcgccagcatgtgttattacctgtcttttgaataaaagccattttaactggggtaaggtaatatctcattgtagttttgatttgcttttctctgatgatcaactatgtagagcaccttttcatatgcctgtttgccatttgtttgtctttttttgagaaatatctattcagatctctggcccacttttaatcagattattagatttcttttctagagagtggtttgaactccttatgtattctgtcagatggtgtgatggttaatatcgagtgtcagcttgattgaaggatacaaaatattgatcctgggtgtgtctctgagggtgctgccaaaagagattaacatttgagtcagtgggctggggaaagcagatccacccttaatctggtgggcacaatctaatcagctgccattgaatataaagcaggcagaaaaacgtgaaaaggagagacagccttcgcctcccagccttcatctttttcctgtgctggatgcttcttgccctcgcacatcggactccaagttcttcagttctgggactcagactggctctccttgcttctcagcttgcagaaagcctattgtgggaccttgtgatcatgtaataaactcccctttatatatagagagagaaagaacactgactaatacagatgggaagtttgcaaatattttctcccattctatgggttgtcccttcactttgttgattgtttcttttgttgtgcagtagctgtttaacttgacgtaattccatttatacatttttgctttggttgcctatacctgtggggtattgctcaagaagtatttgcccactttgatgtcctggagagtttccccagtgttttcttttggtagtttcataattttcagtcttaaatgtttttaattcattttgatttgatttttttggcaagagataggggtctagtttcattcttatgcatatggatatccagttttcccagcaccacttattgaagagactgtcctttcctcaatatatattcttggaaactttgtcaaaaacgagttcactgtagatgtatgaatttatttctaggtttttgattctgttccactggtttatgtatctgtttttatgccagtgccatgccgtttggttactatagctctgtagtataatttgaagtcagataatgtgattcctctagttctgtcctttttgcttaggatagctttggctattctgggtcttttgtgattccatacatattttaggatttttaggatttttttctatttctgtgaagaatgtcattggtattttgacaggaattgcattaaatctattggacattttaacaatgttgattcttcctatccatgaacatgaaatatctttccattttttgtgtcctcttcaatttcttttcttttcttttttgaaatagggtctcactctgtcacccaggccagagtgcagtggtgtgatcatggcttgccaaagccttaatttctcaggctcaagtgatcctcctgcctcagcctcctgagtagttgggcctgcaggtgcgaaccaccatgcccagctagtttttcttttttgtgttttttgtagagttgaagtttcaccacgttgcccaggctggtctcgaactcctggactcaagagatccacctaccttggccccccaaagtgctgggattacaggcttcagccaccattcccagcctcacttcagtttcttgcatgaatgttttatagttttcattgtagagatctttcatttctttggttaattcctaagtattttattttatttgcagctatccagcctgtgtttttaatttcagattccacttgttcattgatggtatataggaaagcaattgataattttatattaatcttgcatgctgcaatgttgctataactgctcattagtcccaagggtttgttgttgctgatttttccagattttctacatagacaatcatgccatctttaccacctttcttccttcccaatctgtatacttctatttctttttcttgtcttagcattagctaggacttccagcgtaatattgaaaggagtggggagagaggactttctttccttttttctgatcttagcaggaaagcttctagtttctcactgttaagtaaaatattagctatacggtttttgtaccttttaaaaatcaagttaaggaagttcccctttattcctagtttactgagagtttttttaaatcacaaatgggtgctgaattttttcaaatgctttttctgcgtgtattgaattatcatttgatatttctcttttagacgtgatggattacattaactgattgcatacctgggataaatccccatttggtcatggcatataattatctttatgtatcattggatttgatttgctaatattttgttgaggattcctgtacctatggttatgagagatatggatctgtagagttgttctggtaatgtctttatctggttttagtattagatgctgacctcatagaatgaattaggaagtgttttctctgcttatatcttctggaagagatttcacagaactggcataatttctttcttaaatgtttggtagaattcaccagtgaactcatcaggcctgcagctttctgttttggaagattattaattattgattattatggtctgaatgttaacaaaattcatatgttaaacctaattaccaatgtaatagtattaacaggtgggctctttagtttttaggagatgattaggtcataagggtggaatagaactaatgcctttttgtttttttttgagacagagtcttgctctgtcgcccaggctggagtgcagtggcgcaatctcagctcactgcaagctccgcctcccaggttcacgccattctcccgcctcagcctcccgagtagctgggactacaggcgcctgccaccacgcccggctagttttttgtatttttggtagagaccagtctgggtgacatagcgatatcccatctctaaaaaaaaaaaaaaaaaaaaaaaaaatcctctaaacactgcttttgctgcatttcacaaattttgataagcatatttttattttcttttagtgcaaaatattttttaatttctctaagttttcttctttgagtcatgtgttagttataagtatgttgcttaatctacaagtacggggatttttttttttttttttttttttttttttttttttttgagacggagtctcgctctgtcgcccaggctggaatgcagtggcgggatctcggctcactgcaagctccgtctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaagtacggggatttttcagccatctttctgttattgatttctagtttaattccattgtggtctgagagaagaaattgcatggtttctattgttttaaatttgttaaagtgtgttttatggctcagaatgtggtctatctggtgaatattccatttggtcttgaaaacaatgtgtattctgctgttgtgggatgaactattctatagatgtcaactgtattctttcttaaaatttttttttctttttttttttttgagacagagtcttgctcagccacccaggctggagtgcagtggcgcaatctcagctcactgcaagatccgcctcccgggttcacgccattctcctgcttcagcttccccagtagctgggactacaggcgcccgccaccacgcccggctaatttgttttgtatttttagtagagacggggtttcaccatgttaggcaggatggtctcgatctcctgacctcgtgatccacccacctcgacctcccaaagtgctgggattacaggcgtgagccaccgcgcccggctagatgtcaactgtattctgttaactggcagtgctgttgaattcaactacatccttactgatattctgcctagcagatctgcctgtttctgtagaggagtgctctttttcaagattgttttagctatttaggaccccttgcaattccatgtggattttaggatcagcatttccatttcttcataaaagaccattgggactgtcatagggattgcattgcgtttatagattactttggggattactgccatcttaacaatactaagtctttcaatccatgtacatgaatgtctttccattatttatgtcttctttatttcttttagcatgttttttaatttttggtatacaactcttgtatttcctcaattagatttattcccaagtattttattctttttgctgctattataaatgtaattgtttttgtaatttccttttggaattgttcattgctagcatatattatagcgatacaattcatttttgcctattgatcttatatccgaaaactttgccgagttcatttattaactctactagttttttgtggattctttaggactttttcataaaagatcacgtcatcttttaagagatattcttacttcttcctttctgatctatatgccttttatttattttccttacctaattactctggccagaacttccaggacagtgttgagtaaaagtgttaaaagtggacatccaggccggacacggtggctcacccctgtaatcccagcactttgggaggccgaggcaggtggatcacgaggtcaggagatcgagaccatcgtggctaacacggtgaaaccccgtctttactaaaaatacaaaaaattatccaggtgtggtggcgggctcctgtagtcccagctactcgggaggctgaggcaggagaatggtgggaatccgggaggcggcttgcagtaagccgagatagcgccactgcactgcagcctgggcgacagagcgacactccgtctcaaaaacaaacaaacaaaaacaaaaacaaaaaagtggacatccactgggcacggtggttcatgcctgtaatcccagcactttgggaggccaaggtgggaggattgcttgagcccaggagttctagaccagcctgggtaacatggtgaggcctcatttcttttttgtctttttttttttttttttttggagatggagtctcactctgtcacccaggctggagtgcagtggcgtgatcttggctcactgcaagctctgtctcccgggttcacgggcaccacacccggctatttttttggtatttttagtagagacaaggtttcaccgtattagccaggatggtctctatctcctgaccttgtgatccacccgcctcggcctcccaaagtgctgggattacaggcatgagccattgcgcctggacagaagacctcatttctattaaaaataaaaaaaaaaaatcagccaggcatggtggtgtgtgcctgtgcctgtagttccagctacttgagagtctgaggtaggaggatcatttgagcccagggagatccaggctgcagtgagtttttaatttaattttattttttgagacaggatgttgctctgttgcccaggcgacagaaagaaaaaaaaaagacatccttgtcttattcctgatcttaggcaaaaagttctcagtctttcaccaccgagtatgagtttttttttttttttttttgagacagagtctcgctctgttgcccagtctggagtgcagtggctccatctcggctcactgcaagctctgcctcccgggttcacgccattctcctgcctcagcctcccaagtagctggaactacaggcgcccgccaccacgcctggctaattgtttgtgttttttagtagagacggggtttcaccgtgttagccaagatggtctcgatctcctgacctcatgatccgcctgactcagcctcccaaagtgctgggattacaggcgtgagccatggcgcccggccgagatttttttaataagtgccttttatcatgttgaagaagctctcttctatttctaattagtaaaaattttttatcatgaaagggggttggagtttatcaaatactttttctgcatcagttgagatgatcattgtttttttttccttaagttttaagagttctttagcccttggtctgttgtaaatattttctcccatttcatcagttgtctttttattcacatgtagttgtaagtactaatacagatctctttacccttaaacctgtttccctcaacaataacatcttgtaagactatggtatgatatcataactaggatattggtattgatacagtcaagatactgatcatttccatgatcacttccctctcactcacacccactccttaacctctggcaatcactaatctgttctccacgtctacgatttttgtcattttgagaatggactataaatggaatcatacagtttgtaatattgtagagttacctttttttcactcaacataatcccctggagattcattcaggttgtcatgtgtatcagtagtttgttccttttttattgctgagtagtattccatggtgcagatgtaccaaaatttgttaaccattcacccattgaaggacatctgatttgtttccagtttttagctattatgaccaaggatgctatgagcattcatgtgtgggttttttgttaatatgttttcatttctctgggataaatgcccaagagtgtaattggttggttgtatggtggttgcatgtttagctttataaaaaactgccaagctcggccaggcgccatggctcatacctgtaatcctagcactttgggaggccaaagtgggtggatcacttgagctcaggagtttgagtccagcctggacaacatggcaaaatcctgtatctactgaaaatacaaaaattagccaggcattgtgctgcatgcctgtggcccagctacttggaaggctgaggtgggaggatcacttgagcctgggaggccgaggttgcagtgagctgagattgcaccactgcactccagcctgggtgacagagtgagaccctgactctaaaacaaaacaaaaaacctacagatcaatttagggagaattgaaaattgctatgttacatcttcaaatacaggaacacaatatgcctctccatttatttaaatcttttctttcattagcactttataattttcaattttcagcatatatatcctacacatattttgttaggcttatacctgagcgttttattttctttggaatgattgtacattgttttgtgttttacattttggtttccatatgttcattgttagtatataaaaatgtgagtgatttttatgttactcttcatctgcaactttgctgaactcaattagttctaagaggttttctgttttctttttagtttgtttatggtgatttttgccatgcaatttaaaaaatatagtcaagctatcattctcttattttattgtctgtggatttttttttttttttgagacagggtttccctctgtcacccaggctagagtgcagtggtgtaatcttggctcactgcaacctctgcctcctaggctcaagggatcctcccacttcagcctcctgagtagctgggaccacaggcagaaaccactacgctcagctgatttttgtactttttgtagagaaagtatttcactgtattgcccaggctggtcaccaactcctggcctcaagtgatctgcccacctcagcctcccaaagtgctgggactacaggtatgtgccactgtgcctagtggattttatttttttaacatgaagtcttactctgttggccaggctgaaatgcagtagcgtcattttaactcactgcaactttgaacttctgggctcaagcaatcctcatgcctctgcctcccaagtagctaggactactgacatgtgccaccattcctgaataactttttaattttttgtagagacaggatctggctttgttgcctgggctggtctcaggcaacctcttgacctcaagtgatcctcccacctcagcctcccaaagtgctgggattacaggcgtcagccactgcatctgacctatttgttttaagcagtcagaaattcagtggatatattttgtattaatgtctgacagagctagtcttcaccatagttattcttttttttttggtatttttctgggtattcttgcatttttttctatgtaaatattagttatcaattacataatgccatataaaagcttattggtacttttattgggattgcattaaatttataaagtaacttaagaaaagccaacatctttataatgttgagttctacccgtttatgtaagtctatctttgtgactttcaggagtattttaaaatttcctcatataagttttgcacatttcctgatacttttatttctaagtattcaatcttcttcaatactatataaacgaattttatcattatgccctctgattattgtttgtttgtatgaaagttattgatttttgtatgttagctttgtatgctgtcactttactgaattttttagttaattttatttttgatttgagtttttccagcattgttggcaaatagagataattttacttcctctttaccaatcttatgctttgaactgatttatcatgttgaattgcaatggctaatacctctagacaatgttgaatagtagcagagatggtgagcatctttgtgttgttcctgagccaagtgaaaaatgcttttagtatttccctattaagtaagatgctggctaaagctgtgatgttgggatataataagaaattctgtaccattttctggcatagaacttctaatcctttggaatttcctgagctataggagcatgtattttcccctaaaatctatttattaggaagaatgaattttcataattctagtagcaaatcatactacagaagtatcagatagaattctcatagccttgatatattgtctcaatgttataagaagttgacctccaaatcaacaatcatagtcaactgaaaaatatcatttgttgatatctttcagaggccaagacatgattttctgacttttttttttttatcactccatttataggaaatttcttttttcttttcttttttttttttattgatcattcttgggtgtttctcgcagaggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaacgagcatgctgccttcgaccatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagaaaccatccgatttctcaatcttttccccacctttcccccttttctattccacaaaaccgccattgtcatcatggcccgttctcagtgagctgttgggtacaccttccagacggggtggtggccgggcagaggggctcctcacttcccagaaggggtggccgggcagaggcgcccccacctcccggacggggcggctggccgggcgggggctgaccccccacctccctcccggacggggcggctgccgggcggagacgctcctcacttcccagatcgggtggctgccgggcggaggggctcctcacttctcagacggggcggctgctggggggaggggctcctcacttctcagacggggcggccgggcagagacgctcctcacctcccagacagggtcacggccgggcagaggcgctcctcacatcccagacagggcggccgggcagaggcgctcctcaagtcccagacagggcggcggcgctccccacatctcagacgatgggcagccgggcagagacgctcctcacttcctagatgggatggcggctgggaagaggcgctcctcacttcccagactgggcagccaggcagaggggctcctcacatcccagacgatgggcggccaggcagagacgctcctcacttcccagatggcgtggcagccgggcagaggctgcaatctcggcactttgggaggccaaggcaggcggctgggaggtggaggttgtagcgagccgagatcaggccactgcactccagcctgggcaccattgagcactgagtgaacgagactctgtctgcaatcccagcacttcgggaggccgaggctggcggatcactcgcggttaggagctggagaccagcccggccaacacagcaaaaccctgtctccaccaaaaaaatacgaaaaccagtcaggcgtggcagtgcgcgcctgcaatcgcaggcactcggcaggctgaggcaggagaatcaggcagggaggttgcagtgagccgagatggcagcagtacagtccagcttcagctcggcatcagaggaagaccgtggaaagagagggagagggagaccgtggaaagagagggagagggagaccgtggaaagagagggagagggagaccgtggaaaggggagagggagagcgattttctgacttttaaaccttttattctccacttagtggcataaaggaatctctattatgcaaaactaatctgaaagtgaatagttatatagtggctacagaaaattttaccttttttttttttagacggatcctccaggttggaatgcagtggtgtgatcttggctcactgcaacctctgccttccggtttcaagcaattctcccgcctcagcctcccgaatagctgggattacaggtgcatgccaccacacctggctacttcttgtatttttagtagagatggggtttcaccatattggccaggctggtctcgaactcctgaccttgtaatccccggcctcagcctcccaaagtgctggaattacaggtgtgagccactgggcccggtcgaaatattttctatatccatattaaatgtgattctctgttcgttgcctgattctcaccaaatagggcaagtaattaaggtttcgcaaacactttgttagaatgggcaacattacatcagaggagaatcgtcatgttatttgaagttggtttatcactctgcacctcactcttatgtagaaacttgactgaccacaaacacaaatgttttaacatttaaatatctgtgtattcatttttatacttcttgaaagtacttctaggagtacaaacatgaactgctaacaagtcctttttcccccagatggcaatattattgtgggggtagaagcatcttctgtcctaacaagaggaccgactcttgctggctcctggatgaggcctggtcgccagaaagatcaagccataatgagaagcttgaacctttcagtcccaccccccattcttcaggaaggggagagaggctggagactgagttaataatcaaccatgcctgggtgatgaagcctccataaaaatcctggaactacagaatctggagagctattgggctgctgaacacgtgaaggtgcctagatggtggcacatcccagagagggcagggaagcttagcgggtcttctgacatgctttgccctgtgcatctgtattctgtttaatagtctttagaataaatgggtaaacgtaagtaaagtttccctgagttctgtgagctggcctagaaattatcaaactccaggatggggttgtgggaacccctatttatagctcattggacagaggcacaggtcacagcctgcggcttgcgactggcttctgaggtgtgcacagtcttgcaggactgagcccttaacctgtgggttctgactgtaactccaggtagatggtgtcagaattgaattaaattataagacaccctgttagtgtccactagagaattgtttggtgtgtgggtttgatcacccacacattttggtgatcagaagcattctatgttgagtgtgaatgtagaaggaaaaacagtccattgtttcctaactcatacaaaggctaaggtgctgtatgtgggcagtctttgctttgcccagtccccatatggacatatttggcttaccacattttagtttaataactccagtcctccccaccagcatggttcaaacttcatttgccatggaattttaacgaattgtataaggtgcaaaccttgctgctggctctttagtccaaaaaaatgacataaataacagatgggcatcatgattaggacatcactgctttcgaagactagtggtgattggctggtcagtgccggtgtgttattcagctcatgcagacgtcagacaagtgtataggtgggttgcctcctcatctctcagtgatcaacagatataacattttatgaaattcaatgattgggctgggcgcagtggctcacacctgcaatcccagcactttgggaggctgaggtggatggatcacttgaggtcaggagttcaagaccatcctggccaacatggtgaaaccctgtctctactaaaaatacaaaaattagccaggcgtagtggtgggcgcctataatcccagctactcggaggctgaggcaggagaatcacttaaacctgggaggcagaggttgccgtgagccgagattgtgccaccgcactccagcctgggtgacagagtgagactccatccatctcaaaaaataaataaataaaaaataaattggatggataattggaagggggaatggctaacaaatataaaagtgcagccaaaaaaaatgaggatgataagactggaagtgaaattgtatatgaagctgtggcatgaactatatcgaaagtctgatgaatatcatgatatggtttggatgcttgtcccctccaattgtcatgttgaaatgtgaccaccccaatgttggaggtggggcttagtgggaggtgttgggctatgggagtggatccctcaggaatggcttggtgccctcttcgaggtaatgagtggtagtaaattcacacaagaactggttatttaaaagagtgtggcagctccccctccctctctcttgctccctctcttgccatgtgatacactgctccctctttgccctctgccatgattgtaagcttcctgaggcctcaccagaagcaggtgctggtgccatgcttctcgtacagactgtagaaccgtgacccaaataaacgtcttttttgtataaattacctagtctccagtgttcctttagagcaacacaaaataaactaatacatataataaacaaggtaaagttgcttcaacatattttttttaaatttttttcttttaatttacttttttttctttgttgcccaggctagtctcgaactcctgagctcaagcaatcctcccacctcagcctcccaaagtgctgggattacaggcatgagccgccacgcccaggctgcttcaacatcttttagtttaaattgcgctggaaacagaagtcgttcgtggttgaaatggaatgtttacttctatgttgaactgaagactgtaatttgttaacaatccccattggtttggccagcattcaggctgaagcattgaagttaattgccacattgacagaaaacagtaatttcaaggagactgcagaaacttttactaacggtaaagagtggtttgtttcatcatttcagaagttggcatgaattgattaatgtgaaactgtcaagcacagatgaggatgttgctgtgaaatctatccccagatgtcaaggattttttttttttgtcagtgtctcgttctgttgcccaaactgtactgcagtggcacaatcatggctcactgcagcctcaaactcctgagctcaagcaatcctcctgcctcagcctcccaagtagcttagatgctaggcatgtgccaccacacccagctaggtttttacatttttttagaggccaggggcggtggctcatgcctgtaatcccaacactttgggaggccatggctggcggatcacctaaggtcaggagtttgagaccaggctggccaacatggtgaaaccccgtctctactaaaaatacaaaaattaggccaggcatggtggcacacgactgtaatcccaacactttgggagaccaaggagggcaggtcaccaggtcaggagttcgagaccagcctggccagcatagtgaaaccccatctctactaaaaatacaaaaaaaaaattttttttctagaaatggggtctcactatattgcccaggctggtcttgaactcctgagctcaggcaatcctcctgccttagcctcccaaaatgttaaggactataggcatgagctaccacatccagctgattttgtttgtttaactaaccactatactaacgaggatcaaggataattattacggcaggcagtggttacaaaaaggataaagatatcctagaagaaatgccgctggcaaaaagtttaaaagaacttggagatatttcacaacgttggaagtacaaaggataagatgttgaaagttgatccaaacttaggaaggagtatgacaatttgccaaggcatggaaaacgtgttttttttttttcttttgagacggagtctcgctcttgtcgcccaggctggagtgcaatagcgcaatctcgggtcactgcaacctccaccttccaggttcaagtgattctcctgcctcagcctcctgagtagctgggattataggcacccaccacaacacccagctaatttttgtatctttagtagagacggggtttcaccatgttgggcaggctggtcttaaactcctgacctcaagtcatctgcccgccttgacctcccaaagtgctgggattacaggcatgagtcaccgtgcccggccttctttttcttttttttttttgagacaaggcctcaccctgtcacccaggctggagtgcagtggtgtgatcatggcttactgcaaccttgaactcctgggctcaagctgccatcctcctgcctcagcctcctgagcagctaggacttcaggcatgcgccaccacacttggctgttgtgttttttcttttttttttttttaatttttgtagagacagggtctcactatgttgcccaggctgttctcaaacacctggcctcaagctatcttcctaccttgacctcccaaagtgctggaattacaggtgtgagccaccatgctcagcccatatatagtatttataatcgttctctttggtgtggatgaaacacatctctatcagactggctcatgggtgcagaattccataggtacttactgaaaaacagaaaattgtttcctataatcatgatacttgaaggatagtttgtctgaatataaaatcctggctcacacttgtaaaggtgtaatgtctaaaacctgctgctccattgctgtcttgctttgtatgctggtttaaaaagtctgctgttggcctggcgcagtggctcacgcctgtaatcccagcactttgggagtcggaggccggcggatcatgaggtcaggagatcaagaccatctggctaacatggtgaaaccccgtctctactaaaaaaaaatacaaaaaattagccgggtgtggtggtgggcacctgtagtcccagctactcgggaggctgaggcaggagaatggtgtgaacctgggaggcggagcctgcagtgagccgagatcgcgccatcgcactcctgcctgggcaacagagcgagactccgtctcaaaaaaaaaaagtctgctgtcattctcattatttaattattttgcctttgtgagttatttgatctttttgcctggagtccttgagggtttttttaaaagagtctttgaggctgggcacagtggctcacacctgtaatcccagtactttgggaggccgaggtgggcagattacctgacgtcaggagttccagaccagcctggccaacatggcgaaacctcgtctctaccaaaaatacaaaaattatccgggcgtggtgtcaggtgactgtaatcccagttactcaggaggctgaggcaggacaatcacttgaatccaggaggtggaggttgcagtgagccaagatcatgccactgcactccagcctggttgacagagtgagactccgtttcaaaaaaaaaaaaaaaaaaaaaaagagtctttgaaattagagttttactaggatatgtttcaaagttgatcacactgagtgaatctgcccacattcccagtgggctcttccaatgtgcagagtttttgctcctggacagttttcttacagtgttaaatattagttgtggtttacttgtttattttttcttcagggactccaataatacacatgtgattccttctttgagtatattctgtttccattactttctttggacccagcctacttctttatctcattttcattctcttgcttggttacctgtattccttcaatgccccttattaaatttttatttgaatttattctcccttgggcatcttgtaatttaatctttacttctagataattttgtctgtttattccatttctttcctgagttcaaccaaatctattttcatttcttcctctattttgtctatttctgttctttgtttttaaatttcccacccaaaatggttttgcatgtcttcaaatgcttgttttgcatatatttggttctgtttagtgttgtattacagctttcttcttcttcatggctattgtttcagaggtttgtgtgaattttccttggttcatatgtgatgaaattcattttctgatattttgcaatagctgtatgaacctatcttttcattattcatttttgtggtattgggtgttttacaagatccctagataacacgccctcttctggcaacattgtgaagtccagatgctttagtgaatttgtttttgcaggggtgggggttgtgggccttctttttttttttgtcttggagggcaattaaacttctccatttgcctctctcttcacacccaaatgccaaaggacacttttcctttcttttgtgggtagttgctccccaaggatctatgtgtttccaagactgtggcttcacatttcacgtataacttttttttgagacaaagtctcgctctgtcatccaggctggagtgcagtggcacagtctcagctcactgcaacctccacctcctcggttcaagcgattctcctgccttagcctcctgagtagctgggactacaggcacatgccaccatacctgactaattttgtatttttagtagagatgggatttcaccatgttggccaggctggtctcgaactcctgacctcaggtgatccacccgtcttggcctcccaaagtgctgggattacaggcgtgagccaccgtgcctggcctcacgtgtacttttaaacctcccacctattgtcccagctctgacactactgcagacacttttgaacattttcaggctcaaggtgtacttagtgtttttggtgaggtcttagatcaagcttaagccccattacaactccctcctctcctttgccccagttttcctcagccagtcttgtggcaggtggggctggaatgggtgcgtgggaaggaaagtctgagctgccatttgtttttcctttttctttcttttcttctcttctctttctttcttttttctttctttcttgtctcactctgtcacccaggctggagtgcagtggtgcaatcaaagctcagtacagcctggacctcctaggctcaaataatcctcatatctcagcctcccaagtagctagaactgcaggtgcacacaaccacacccagctaatttttgtattttttgtaaagacaggttttcaccatgttgcccaggctagtttcgaactcctgggctcaaggaatctgtccacctcaacctcccaaagtgctgggattacaaacgtgagtcaccacgcccggccaggtaatttctatgttatttgtttttcttgttctttttaagtttgagcattcttgtctccaagttatcctgagggcttgctgttgcataattttatcttttctcctcattccatattgtttttctaggcgacactggggacctacagtgctaccattgtcctcctacctgaaagcctctgacaaaatattgtcttcccattccattgaaggttcagaggcctcagtgtccaagggagaatgccgccaggaatggacactgcatagctttttttgaaccggaagtaaaggctgccccgctgtcgctttgcctcaggaccaagagctctaagaggaagactgaccctgactgtccaccgagaagctgttgctgccatacaacggagacaaggagtccatcgtatccaggggatcccctgaaatatctctgaggattgccaggttcagtgacagtgttaatgaaagcctcaagtgactcaatacaagcagaataaccaaggactcagacccttcaggaatgaagtttgggtcacctcatgaagtaaaagaaccaaaggaacatagaatgggtatggaagaaagaagttgtaaatatcaatccagggttaacagataaaatacaggatgctcagtgttaaaaggaaaactttagctcaggtaagtttcacagtgtttaactgagcaaagaacaattcaagaatcaggcagcctctcatgccagagtgggctcagagactccagtgcagccacgtggtggaagatttatggacagaaaggaaaatgaagtacagaaaacacacgtgagatatagaaaccagccagattggttacagattggtgtttgtcttatctgaacacagtttgaacagttggccacctttgattagccaaaactcagtgattgccacaagcgttggctacagtctgtttacaagtccatttaggttatagtttacgatgtacagagaaacctttaggccaaacttaaaatatgtaaggaggcagctttaggctaaacgagatttaacactggttatagcccgggcacagtggctcacacctgtaaccccagcaccttgggaggctgaggcgggtggatcacttgaggccaggagttggagaccagcctggccatcatggcaaaaccttgtctttactaaaaatacaagaattagccaggtgtggtggcacatgcctgttatctcagctactcaggaggttgaggcacaagaataggctgaacccaggaggcagaggttgcagtaagccaagatcacaccactgcactccagactgggcaacagagcaagactgtctcaaaaaaaaaagaaaaaaacaaaaacaacaaaaaaaacccaccacttatatctgaaccttggagaaacaactactggttttttagtgtaagtatgtcctattaacaactaaaaaattcattgcttctccaaaattcaaacttaaatgcacatcctatataatatttttatttgctaaacctaggaaccctaattagggcctcgtaactcattgcacaaaagattcatactttcttccttgcatgtaaaatagagattaaccgatatctttccccatcttttcccttgtttcatataaagtgtattattgataattgttaacgaaaaaaagaaaagatacacaatttataaattttgagaggagactttatttcttataaagggttaggctgggcctggtggctcacacctataatcccagcactttgggaggccaaggcaggaggatcacttgaacccaggaggccttaaccagcctggacaacatagtaagaacccatctctacaaaaaattttacaaattagccaggtgtggtggcatgcacctgtagtcttagccaccccggaggctgaggcaggaggatcacttttgcccaggagtttgaggttgtagtgagctatgatcgcaccactgcactccagcctcagaaagggagtgagacctgctgggaagcatgtctccagccaagaccagagacaggcacttcaaagaaggaggggttagggtaggagcttcatgctcaatggattgactaaacatacacattcaacaggttacatgaggagctatgaatattcatgaaagtggttctgacacatgcatattgaacaaacatgcatgcaacatacaacccatggtcactttggggtggagacttaacatttaaatgtattataattaggccctatatggcaaaaggtcttttcaggacacaaagacatgcaagtgcaggagctctgtaagccagccagaaccagtccatgatgggtagtcaccttgtcaggaaaaagttactgaaatcagtcacttgtccaaccaaagctgtagttatggctggtggaacagtggttggaggtcagttagtcagcatctgatgaagctgaaaatgtttttaatattgcttatctcaaagccagtgcttggaccgggtgcggtggctcacgcctgtaatcccaacactttgggaggctgaggcgggcagatcacctgaggtcaggagttcaagaccagcctggccaatatggtgaaaccccatctctactaaaaatacaaaaattagccgggtgtggtggcggacacctgtaatcccagttactcaggaggctgaggcaggagaatcacttgaacccaggaggcagaggttgaagtgagccaagatcacgccactgcactccagcctgggtgacagagtaagactccgtctcaaaacaaacaaaataaaaagtggtttttgttttgttttgtttttaagctttttagctgctacagggaaaaaaaaaccaaaaacaaaaaaccttgtgcagttagaacatagtttattcataagttgggggcaggggaggcggggcatgaaggtgggctctacatgacttaacccttgcttggcatggccttaggtcctgtttacaatttggtatcttattgccacagtgtctgttctgtccatctcatgatccctattttgttcattcatgctcggcagctgtgtctaaaccataaagggatggggtataacaagttgcatctgacctcccaacccatcagggccaggaattgttttaagttttttctgagattccctcggccacgaggtggcatctgttcagtcggtggggttttaggatttttagtttacataactgatttgataatccagggcatttgttacagcgtatccaggtgagattatgactcaactatttagcacctccatctcaacatgtacttccccaacggtcatggcagaggaagagagggctggaaaattgagcactggcaatgacatattttgccccaaaactgaccccttcacatttcttttttcttttttgagacggagtcctgctctgtcatccaggctggagtgtagtggcccaatctcagttcactgcaacctccacctcccgggttcaagcgattctcctgcctcagcctcctgagtagctgggattatgagcacgccaccacacccggctaatttttggatttttagtagagacgggtttcaccatgttggccaggctggtctcaaattcttcacctcaggtaatcaacccacctcggcctcccaaaatgctgggattacaggtgtgagccaccgcccccggcccttgactcccttcacatttcattagccagagctgggcttgtggccagacctgccttgaaggaggcaaggaagggtatgtgaacatgagcaacgtccacacaggtggacaaggtgacccgtgtgactttggttccctctctttaggaagaatttttggttgtacttgggacagttacaggcatgctgctattgccatgatcttcgggaagctgaagtgatgagcagcagtgtgtgattctgaggacacagagggctggggtctaggagctatctcaggtgggctcagtcagtgccatcctcccttttggtgcctccctagaagtgctgagaagatgcaaaaccaaaagcttttactccaacattgcttagccaagctaagcacatgcattccctatgattcagcaattctgctcctagcatgtatcccagagaattgtcccatgggtccataggggcatataagaatggccattgcagcaaagttctggttggggtagggggagctgaaagtcatctggtgtccacaactggaggaatggatggataaaatgggatggatgcacaagtgggcagacagatgggtgaaaggatggtcagtccttacatggaccagtttccttattcttaggctaaggattagcatctccaggcaaaaagaaaacgtttctggattcccttgccactggagttccgtggaagagagaaatggagtccactaatgaggtgtcctttgaaggatatggatggaggacacagggccaaggaagtttgctctgcgggcccagccttggagatgttcagtccttctgcagcagcaccacgcttctggctttgtgggtgtcaggaggcaggagtggcagtcccaccccatgtcccagggcccaagcccagcttcctgggtgcttacaggggatggcaggcaggacagtacgttctgatcccagctccagtgggagcttcctggaggcgacttctccagccttcccatgtactttaagtaccctgattcccttaaatccccttctgccaaaaacagctggagaagtttctgtttcctgaaactgaccccttcctgatttggaaatgacttgccgaggtgacaaagcaagttattgccacatctcaagtttgagacaggcctcctgactccacctattaacagtaccactgtcccaggccctttcttttttttctttttttgagacagagccttgctctgtcgcccaggctggagtgcagtggcgtgatctcggctcactgcaacttctgcctcccaggttcaagtaattctcctgcctcagcctcccaagtagctgggattacaggcgcccgccaccacgcccggctaatttttgtatttttattagacacagggtttcgccatgctggccaggctgatctcaaacacctggcctcaggtgatccacccgccgcagcctctcaaagtgctgggattacaggcatgagccaccgcacccagcccaggcccgtctttcctctcctagtctgccccaatcggaaggatcaggaggcgtaaagctggcccatggggaacctgtggctgggagcccatgaggcaggggcagcagaagagggcagagacggttgggacctctgtggccctggctgaggtctgctctgatggcatggtaatggaaacctgctaccagatgacaaaacactattaccaaacagctgggtgaccttaggaaaatcactcaaccgctcctgcctacggatttcctcatctgcggggccctgcagagctgttgcaaggatgaaatgaggcaacgtacatgtgcctggcagcacagctgaccccacacagctcaatcctcagtgtttgcatgtttgggaaaaaaaaacaacaactagaggaactagttcttcttacctgggaagattcctaagcacaaattaggtttcttaggggctgagattagaaaaaacttggtctcagaccctagaccttattagcaggcccttcctagagctggctctaatcggcacagcttgggaagctctccacctggccactgctgtctttctgtttctggcttaggcccactggcctgcctggcgtgagctccctggggcagggagcttgcaaaccttgggagttgagaagcgctggctcggccaggtgtgggggctcacaccagtaatcccaacactttggtgaggctgaggcagaagagtcatttaagcccaggagttcgagaccagcctaggaaacagggagatcctgtctgcaaaaaatacagtggtgactcacacctgtagtcccagctactcggaggcaggctgagatgggaggatcacctgagcctgagaggcagagtctgcaatgatccctaatcacaccactgcactccagagcgccagagtgagatcctgtctttaacccctccccgaaaaaaaaagaaagaaaagtactgtccaacaggtcaggtccacactctagcttcagccttcttcctaaatcactgagtggccttgggcaaggccagaccctctctgggaagcagaaaggagatttttcccctgcctcctgggcagagattctggagagcactagtgtgtctgggtgagaaggaactctgtagctctacagtgccgggttctgtctggaagccttcttggggcctatgaccctgctatggtttgaatgtttgtcccctcccacgctcacgttgaaatgcgattgccactgtaacagtataagattagaccctaagaggtggtcaggccacgagggctctgccctcctgcgtggactcaggccgttatcttgggagtgggttcgctctctcccctcactcctgtcactctgtcctctgtcatgggaagatgcagaagggtcctcactgggctctgggccctccactatggacttcccagcctccagagctctgagccaatacatttctgtttattataacttaccccgtctcagggatcttgctagagcagcaaaaacagactcagacagaccctcacccccaggagcctgctcccaaccggggcccaaaagaaaacaagccagcgagggcactgcggaatgcagggttttggcgacagagctacaggagtgtgccttggcccccacaagggccacagtcctgcccccacctggtctcccggggctcagacagcagccgccagcccacggaggtagtcccccgccaggggcagcacggcccagtcatcggtccgcagggccacaggcactccatctgccagggccgcctccagccgcagcagcagctttgagtccgggggcaggtggattgctacacagtagctggtaggaggctgggccaccaccacaaaaggctccaggtggcgggacaccaagccctccaggccctgtggcccaagtggacaccacacacgactctcagcaccctctggcaggcaggaatcccagagctcctcaaagaagcccagcccggccccctctggaggctgcgggaaaggcagaaagaggtcggcaaagttcacgaacaggggtggcaagtgggcatggcacgtgagaccagtggatgtggtgtaaagggcatggacatccagccgtgcgggggccgggcatcggggctgcagaggcaggagcagagggcgggcagggcggccaggacacaggcagggcacatggacagcctccaggggtgcatacagctgtccttccacacggaagcgcagctccagagagtagatgggctccagcgcctccggctggagcttcaacactgggagtgggcccttgacccgatgggaccccaggctcagccgtaccagggccggtgcctcctgcaccatcagtgctgccacaaagccctggttctcggccaccagtgaagaggccagtgcaggtgcggcaagcgaggggcccagggccacccccaacttgggtgctgccaggtgtgccagcaggatgtagtagaggcgggcgtggtcacgcccatcagggtcctccagctgcctggccagcacctgcagcaagtcgaccaggccgcccctcacccctgcccgcagcagcgcccggcagacccgcagcaggccctgctgtaggtcccagttcgtgcagtgggcagccgcggcctgtagaaagttgagggtagcactctgggcatctccatctgccacctttgccagcatttgcaggtgccagcaaagagcttcatccctgcccggcctggacaccaccacctgccgcaacaccaccttcaggggctccctcagctcagagtccacctgatccaagaggtccacaaagtggggagccagcatgggccgggcttggtacagctgggccagtccgtggatcaagggggtcagcaccgtaggttgcccagccaggcagcaggccaccagatacgaggcctggaagcagagagtggccaaggcccgggggcccccatccagggctgcccgctgccgcaagccagccagcagctcttccaggtagtgccgtgggcttggaagctggcctttctcctcttcttcctcctcggcacagagcaggcacagtaaatgcaggcgggccaggagggccattgggtcatgcaggagactgggcaggagaccacggcatagctggggccctagcagcagtggggcagcctcctcaccttcagggcccagcggccagttctcagggaagctcaggacgcagtgaaggtaaaagagatgggtgggcggaggcagagcagggtgctgggcagccaaggtgagccggcggagcagcaacgcttcatcctgggctgtgaacaaggcctcaccaaaggccgccttgagcgcaagcatggcgtgcaacagtgtcagctgtgctgtgcctagcagccgtaccagctgcggcttgaagagtgccggtggctgtccctgcagaccccgcagggcccagcccagcagccacaggagctgggcctgggccacaggagtgagcagataggaggtgtccagaagctggatcaccgcagcccgcagctcccgcgcctcctcagggctgtgctctcgtgctgtaaggctacgctccccctctccctcctcagctgccggccagctgggtgcctggggctgaaggcgtccatcgccctcctccactagtgtccaatcccagggaccacccccagttggggagaccttatccgtgagcagtccccccaggccagccccaacccgggactggagcaccaaggtgttgcgcaaagcgagggccagcaacaggctgagtggctggacagggccttcctgccccagcaggccccgcagcaaccccagggagccccccagcagcccgggcttgcagctctctagctctcgcaggcactcgcaggccgtggcctgcaaggggcgctgttccgaggcggggacaaagcctcgccccagatcgctacccgcggccaggccgagcagtaggggcaggagccggcaggaggcgcccgaggtggggcccagcgcgccgcccgccgccagggcagtggtggccgccagcagcagtggccgacggagagctgagggccgcgggggtaggaggaccaaggtgtccaacagggaggtggcggccacttcggccgcagaggcgtcgggccacagctgcgcagggtactccatgctcagggccagcagggaaacctggatgggggattaggagggaatcacgaagatgaggttcatgacgcggcgggctggggtgaccctgcggaacggcgcaggggacgcgtgggggcctaccttggtctgttcgctcagcttctcacttctcaggtcgctcagcaggtcgcgacccaaatcctccccctcgggacctgccatgaaggcagacgggctggcccggaaggcccccaagcgctgggcccaggcgtcccggctcaggggccccatggtgaggcgcgcgggcccctgcgcagggaagagggaccctcaggccgcagccaccgggagcgcggggcccgctgccgaccccgaggggctgcggtcacccccagacgccgcgcagatgccggcgggacccgcgcccggctcccacggtgagaccagggctctcggggccgacgccagagctgggcgccggggccctcgcgggacaggacaggagcagggcgggggagggtgcgtgccgagagctcgttaggccgcctccctcccgcccgcggcccgcaccgaaaccacagcgccaccccggcccccggcgccggcggtaacgggccgcgctcgccgcctgactcagccgccgcgggcactcaggccggccggctccttccgggctggcggcgcggggcggggcgcggcgcgggggcggccgagtccgggcggggaggggcggggcgtaacggggccaccgcctcccgcaggtgtcgactcgcaggtttcgcgggggctgactaactgtcccgccgcgcaggcccccttccccgaaaccgccgcaggccggggcaggaaaggcggaggggagtgggtaggggtggcggagcggggtgggcctgggccccagatgccgggtaccgcggcgcagggctgcgatcccgcggccctcggcggacagcggcccggtcccaccagcgcccgccaagccgcgcagggcggcagccagcgcgccccccgccggcgcccgggcacaccgcaccctgcgccagacgcgcggccccggggggcgtgggtgcgggtcctggggctcccggagtggcccctgggggtgaccaaggtgcggtcgcagggcgcccgcaggaaaagcgccccagctgaaccggtccggcgggcgccgcagggcttggcttcgcttccctgacgcctgcccgggcccccagcccgctcggcttgggggcgaggagccggcgccgcggttgcggccagccaggagcttctgacctttgtttgcccgaggccgcgctggcggcccgcaggggtcgtgacggcgagggcggggcagggccctaagtcgaaaacaacgggatccatactcgggaagtgcgggctgtcagggcctggccggtcacggggctcgaggcatgcctagcgatggggaaaacaggcccaggaggagggcggccttgccaaccgagatctggggccaagccgggccggaacccagcactccagacttcagtgggctggattctggctgtttgggggcattcgggggtctgggcggcggtctctcccaggccagaggcccaggttgcaggtgccccacagaccaccggtttccagggcacagaaccgccggcgcccaaacctcaccacccctctggctccaattagccgctttgaagatgaaacaggcctgagcccccatgcaagccagtgccagctggcctctccctaccccatcctgctccagatgggaggtggtggagagttgaggggtggagagtgccaaaaaggaggctgtctgggtgcccttggggatggagagatagagacccactcggagggacaggtccagccagaaggcccggtcccggctcctctaggccctggctccacagttgactcacaggcagcagccccaaactacttccctctaggtgcctcagtttccccatctataaaatgggagtgataactcccacccaagaggctgtggggtgaggcagcctggctaattaaacccaagatgaaagaggcaggatgagagcagccctggggaggggaggcagcctgcagtaggagccagtctggtttctctgtctgagcccagagggtgctggtaactgcacatccccggacctcaccaccctcacggtgaggcaggaatgatcattaaacttcttgcagagttgagaagacaggtttccaaggatcagggggcctgacactggctctggccccggctcagcctctgacagcgtggcctctgcacacctcctgcctgagtcttgactccttgaggctgagggtctggagggagggaacccacttgtggtctccaatactgcagtggacgaatccgcatggacttactgaggctcacagcaaccccaggtaccgagagtgggtatcagatgaggaaagggaagcccacagaggtacggtctctcagtcacagagcccctcagaggtggagcctcgacttccacaaacagccccttgttgcatctgacctggtcctccccccacaccaggtaccctcggccctcttgggtgtccaggtccctggatgggccctgttctcacctgtctgctcccctattggcgggtggtgctggctctgtccctggcaaggccaggcatggagctgagctcagactgtcaccggactcacccgggacagcaacatcccagtcgagggcccaggtgtgggccactgccggatgctgagctgggaattccccactccacgccctccctcatttcttctcctgctgagtttctgtcctccccatgcagcccagttgtgggcagacactaaacacaaggcttgtaaaagggaaagtcagcttcccaaggggtcctgagcctcagttttctcatctgtaaaatcgggctacaacaaacacactctcgcagcactggctgctggggatacaggaaggcttaggaaagaacgagtcaataggcaaagccatggagatagagcagatagtgggtgctgggccagggggaagggagacacagtgacagctaatgagtacagggttttctttggggccatgaaaatgttctgagatttagtgatgatggttgtacagctctgtgaggttactaaaaaccagtgaattgtacatcttacaaaagggtgaatttgatggtatatgaattctatctaaataaagctatttaaaatggtgtttaaaaaggggtcccaccccagaccagcaggggcacaaaaagtaaaaataaaaaataaggccgggcacggtggctcactcctgtaatcccagcctttgggaggctgaggcgggcagatcacgaggtcaggagattgagaccatcctggagaacatggtgaaaccccgtctctactaaaaatacaaaaaaattagctgggcatggtggcgggcgcctgtaagtcccagctactcaggaggctgaggcaggagaatggcgtgaaccagggggtcggagcttgcagtgagccgagatcacgccactgctctccagcctggacgacagggagacaccgtctcaaaaaaaataaataaaaataaaaaagtaaaataaaaaggggtccctcaagttcagaacttgcactggtggggaggagaaccaacaataaacaagaaagacaaacgaaacgccacagagtcaaagttgtggcaaagaaaataggatagtgggacagaggtggcaggggacaaggatttagctggggtggatggagaggcccctcagaagaggggacatttggttgaaacctgaatgaagaaaggtggccagtaatccagtagggaaaagtgttccaggcagaaggagcatcgggaggaggggccagagctgggaacaggccaaggcttgttcaggggacgcgggagacagcagtgtggctggcatacagggacccagctggaaggggattgggaggtcaacggcggccccagcacgccaggcctcaggctcttattccagctgcagtgaagccactggagggtgtgagccgaggggaggcctggcctgggttttaagagcacctcgtgtggcccacctgcctctccaacctcagcttccctaccctctcttccccccaccgcacggccaggttgcatttgggttcgcggtacacactaggctcactcctgctcagggccttggcatcagctgttccttctgctggtcatgatcttctccactctgcacagctggctccaccctctcattcaggcctcagcacccctacctgccaccatcacattctctcgccaaatgttctctgtgcatcttaggcttctgcttgtttccttgtttctttgtctgccttgccttgtagaatctcagtgcctggcacagcaggttctcaggaattaagggaagaattacgggatgaatgaacaccatctagctggcactgtgctgctagatgaacagagatgtactgctagatgtggtgaacagagcacaggccgccagccttcgtgacactcacagttcaactccgtgtttccccgccgtcacatacatcgtctgtctcctgagctgcccgtgaagacagccacaccacacaccgcggcctgtgggtcaaacctaacccacaaaggtgttttgttggatccattccatgttttaaaattttttgattagctgggtgtggtggcaaacacctgtagtcccagctactcaggaggctgaggcaggaggatcacttgagcccagtaattcgagattgcaccactgtgctccagccaggcgacctggtgagaccccaactcttaaaattattttaaaaataaaaaaattgagctaacatttaaaaattagttgatttcacttacaaatctggacttctggcttctcttggaaaatggaaagctgtggccacgtggggtttgtgcatctgaatgacaggattgtgactgccgtttagatagggacattctctcccgtccccccaactctgttctccccaacggccagggccagttgtgttttctcactgaatttgtagtattgtcttcccatatctatgtctccaccaaaagttggactgtgaaaggtgaatgggtcacaggagtcaagaaaagaggatattcattcattcaacaaacatttattgataacccactttgtgccaggcacagctgtagatgctggagatatagcagtagacaacaccgcctcccacctggggccccattccacatcctgtaactcacttgtgcagggaggggttcccctggctggcttcactttatctacccagtgtcctgtccctctggacattggagttgctcccttgatggggaagactgccccttgtgtctagggacatctgtgaagacttcaccgtagtatccaccgagcacccactgtgtaccagcccatcagggcttggcacaacaaaactgctcaaccaatatttgttgaatgaatgaactaactgcacctctgtcctagacagattgtgtttaaggttgtttctcctggattcacctcaaaagataggcacataccaggtgttcacttaatgtcagttgaactcaaaggtctggctgggatcagagtggaggtcacagcccttagaaaggcaggggaagaggcaaacacgaacgccccatccctgcccttaagtaggtcagcgagtgaaggaagcccagccagcgcccaagtgtcacgatgagagtgtgggcttcatggaggcctctgaggagcgggggcatccctccacgtgggcctggggcctgaggagagtatgaagagtggctgggggcgcgggtcccaggctgaacctcagccctgggcaggccgtgggtaggaagctctccgcggtggccgcagcagggcaaaggcggctgagcctttcccggtctgaggtccccagccctccgcgctccaccagcctggctgcacctgaaatccacccatttgggacaaggaggagtttttttgaggatgcataagtcccactggccaagacacgggggtctgtcgggctctcggcgcactccgcgcagttgaagccacttcctccgtgaagccctccgggcagaaggcgggttctccgacgggtactcggtcgcgcggtccgtgcctccccacacaccggccggggccgctcctgcggccctgcgtgccttttcgcacaaagccggcgcccagcaaacacctccccggctgagccacgagttgcttagccaagcctttgggatcccgcgccgcctgggcccaggcccggttcaacaagtgcggaccgggccgcccgttcccgcccggcggcttcgcgcctccccaggagcctcgggcgcgccgggttgggccggccccagtggggcgagtttcgtgtcatcacccgcggagcgtgccagcgccggtgcaaataacgttgccccctccctcccggctccgctcgctccgaaactcctgtttgcaaacgccagtacgcctggctaggaggtcccgcgggggccgggccggctgggcagccaggggctgagtgcccgaagctcgccccccgaccccgccccgcccggccgccccgcccgggccgcgaggccacctcacccgcagcggaatggaaaccggttcgacaggtaacaaataggtgggttgtcaccgttatttcccaacgcatgcgccgtcgctccccgggccaccccaagctaattagatcagatcaccgccccccacccccacccccccccgccccagccaccaacacacaccgccgcgagccaataaagcgtgaacccgtccgtccggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccaggtgaggctccaaccgccctccggcctggggcacccgcggcggcgtcgaggctgcgggcgggcgggcgggcgcaggtccgcggagccaggcggcaggcgcggtgtgggcgccggggctgaatgcggccgcggcctgggctgggtgggcccgcggctctcgacccgggactcggggggcgggggcggggccggcggaagagcgctggtcggggcgggggctgcatggtggaaggggagccgctcccagggccagggggcgcggaaccgcctacccccaccccctgaaccgcggcacagaggaggcagcggggtgtgtcaccgctcaggcgaccctcggctccgacgtcgtaaatccagaaaaccgggactcgcatgaggcgggagaaggcactggagcgatgccactttggggggcggggagcgggctggagtttcggccgagatttgtgttaaaagctcagagcttcagccgctcgcacaggtccttcctcctcccccacaacactggtggccgggtcggagtgagggtcgggccggtggggggcgtgggcccccaaattttcgttgggctccggctgctagtcccgcgcagtgagccgagacggtgggacaggcgcccgctgcgccccgcttgcccttaaagcagaggtgggatcgggtctcacctctgctagaaacgcacttccttcaccttgcggagggcacaattgcatggaaagcagctgcagggagcccaccccacagcggagggccaggcccggggaagctggtgtacccagttatttttggcagacgcctagacagcgtcgactgtgagagttgcttcttcctccagcggcatcttcccctgaacgccccaagaacactcctaccccttctgtcctcccccacccccaacaaagtctttggtctggagaaagcctgcttccttccgaacgccccctccccaggccttgggggcggggcgtggacgctctgaacgcccagcccagcccctccgaggggggaggggaggagtaattaaccaactgactttgacccttgatctgcagactccctggcaccgccccaggccttgtaggaaagtggggaaatgagggcagcagtgaggggccccgtgagggctcttgctcagtttccctcctgaataagctgttggagacagtgtcctggtgaggtctttgtggcctgaccttccaggacccagtggcctgtggcgctggcaggatgtttcacagcttaacctgatctcaaggggacccctcttccaccgttccttaaaacaagggaatgtgccagaagaccctggtaaccccagtggggaaactgaggcaaaaagggaagtgagtggcctccccacctgaggcagattagggtgtgggctcagaattctgtgtatagcttcttgcttggccacactccctggtgagctggctggttctctacctgggggttggtgggggcacgcagagggccagagccccctccccgctccgccctccgccctccaccctcacctgtgtttgacttgctgcttagctgctccttgggatctgataaactgaacttggaccgtggtaaaggtgagctgagccctgagccaggctcagtgtgctgttatttttagttttatttcacatcccaatcagtaacagatcatgtgttgatttttacaaaggacaaagaaattccgttggttgaaatcattgacttctttttgtcctagctattttctctgccacacttccagtggccacagtggaagtggcaggggagacgtatgccccaggggcttcctgtcaggtgcaggagagggcctctgggtggtccaggccacccgctggcaccatccaggtgagggagacctgccggcttctctgtaggctcctccaggatgtgtggcgggagtccaatctcaaggatgaagggagaatttgtcctcatccccatggcaaggagagaatcctgtgggtcaagtaaagggtagaagatagagaacttaattttacctctgaaagtcatgtggcccactggagagttttcccacagtttttggcaatgagaaagggactgtcctcagtccacgctcgggtgcctcagatggctggagagtgggggtgcgttttgtgctggcctgtcccctggctgggccattccatcaccagccaaccatgaccccagagccagctgggcacgtttccgttcacctcacagattcctggtaagttgtgaccagctaagcgttgaccccatttccagtggagggcccaggaatgtgggagtgtttgagttctgaccttcctgccaggttcctctgagaccctcaaagcctcccagaaggttttgggagaaggttttacaggccagagacactggtccccagcccgacagcactgattccagggccccagtttgacaatcccatcagcctctctccccaaggcagaattctagagcttcttactcccggggcagaatctttcccctgggaagaggtgaagatggttgcaagcaccctggagatttgaaaggattactggctaggaagccaccttgaaccgctcccccacccacccccccaaccaccctcccctcgccttcctttgttatgtcaatattgacttggagtgacagggagtaatgctggttccttgaggataaacctaggcacctgtacccagggggtaaattctacctcctggacccaccagggaagggctccaggaacagggttgaagctggttcccccgagccccaccccatgctgagtgaaatctccaggccaggaaaggacctgaggacagactgaggctggaagctggagtcaaggagcatcccagggcctctcccaggcctcccaccactgcttcccagcctcccctctgtcactgggctggccacagtctgctctgccactcgcctggtggacactcgagctcagggaggccagcaggctgggcggtgggacactggagcttccttcaaggaatgtggtccagcctggctctaccactaggtagtgtgggcacttgggcagatctctttccagctggtcaggaaagctgagagtgagctttggggcccaaggatgtgtcgggagtgaggatagtgagagctccggcctctgatgggatggttaccctgtagtcattcctgggccgtgtttggcagcgaaggagatgtttgctgtgcttgccagggagcggggctgggagagtggacagccacacagtggacagagacagaagagcagcatgggcctgggcagccagctagatgagactcctacctgtcccctgggatcctgtcacccaggctgctaggctgtctgtgctgagcttgggtgtcccgaggcggaaacctggcagatgatttgtctcagaaagaacaggtgagggcgagtcctttggctgcagggaggatggcgagggaagctggccatgggtgaagtcggggctcctttgtatcatcggccatttcaacaagtcctggatggagtcccacagaggcactgggcctgtgcctggctgggtgggggctgcaacaggaagcactgctcccactgttctgggcgggcaccctggcgcgagggccgaggcacagttttaacttctttgtggatacccagtgaaaagcggttgggaaagagggaaaatacactgtctgaggcgacctgtggcagttcacagcgtggaaacagaaggccaagagactggcccatgcgttaccgggccggcctgcctctggctggtgctgggtccttttggatgattgctagctgacctatggggaccagaggagatgggcacggggggcaccagcccttcctgataagggtgcaaggctgctgagaaccagctgcactgtgctgacatgctgggcccccgtctcaccttcagaactgggctgacccccatgttctggggcagcacccatgtggtcagtggggcccaggagggggtcatccttgcatctgcttcacttactctccccagagagccagggacaggcctcatgcccagccctgtcctgaggccttggatggggggacccggcactttccccaacatctgggccagcagctttccatccaagagatggaggacttacagaggccaaggcaggagacaggcctcgatgggcagctgccctggacacagtccctcggtgtccgtgcctctgctctgagcctggccctcaacattgtccaggtagaggcaagtagggccagcaggaggggacccataagcccccaggcagtaggaagagggccaagctagtttggccttgccatactccacagctgtgggcgggtgatgagtagtcatagcgccaccgccttgccggaaacatctaattagggacagagagcaccacaagcagggcccaaccagttctgcttcctgcctcctgccactcagcgacactcagtgccaggtggcacgccagtgtgcactccctgtgcgtgtggccgcagaagggacacgctcatgggggtggcagggagacaggtttggcagggtgggtgggatgaggcaaacatccccaccctggcagcgggtggccgcccatccagcctcctctgcccctcgctcagggtggaggtggaccagagagccaaagcaggcaggcccactccctggccccggtctcccagcaccagctcagccaggtttgtgtggaacagcagaggtgggcaaaggacacaggtctcctcccaaatgcatggatctcaggaccctaaccatgagcctcccctctcgtggagcaaggcagcccagagcagccacccttgtgggctcagcccgtccctcacctgctgtctcctgccctgctgtggtgcagctgggggacctcgctcacaccatccagtactaacaggcagaggagggtagaggttcctgtttgtctccacctggattgagaaatgaaaactgtcatccagctttgaattctcagccaaggtctccaatagctggtgagcctgcatcagaagttcaccatcgcccctgcccacccccagccctgtgggcacagacagctcctgcggcaggggaacaggcctgggtagacagccagaccccgacgacttgagcctgacactcagactcagagaaaggtgcaatgccagcccagaggccaggccggggccaggcgctggtgaatcaaccctaggaatgaggtggctcattaaaggcccccggacagacggacgccagtgcctgcaggacgggttctgggcggcggcgggtgcattcttctctctcagacctttgttgtgttttgagggggcgagagctggggcctctcccgaaacttcagcactgtcaaacgcacccttgctccacaatcacatttctctgcttcccccatgtccctgtcctcctgggagaagaggtgagggcggcagccctcctgcccaggcccaagcccgttctctgtctcgccggctgtgggatggcagggtgcacagggccgtgctcctgcttctgcaatcccacatcagcctccctcggaagctcacttatccttttggtcataggcccctcgtgatttttccttctgaagcttggaagatgtccttagcttacaggtttcaagtactgagctcaggctctttggaagaaaaatattaagttgaaaaatttgccccggctctgttggctttgagaattgcctgtctgtgtccctcgagagtgctctctttctggtcctctctagtcagcactgggctcagggtctgaagccaagcctccccggcccgttcggtgtgaggtgtctgcctcggggcgtggctgcatccaagggctgccaggtatcggtgctgccgctgctgagggagcccagcccgacatgccccggcgagcggtcctgccgagggggagggttgcataagcctgggcaggctgccgagactgttaggctgcatccacctgcggctccctgacctcctccctgttccacccacctggcctgtttccctgcagagctgggaccagctgggagtggagagcctggagccctggggtgcaacagcagggaccggcctgctggggtgggggtgggaggcagggctaggaccacccaaacccccaaggccagcagccaaatctgttggagaggcctggagtggcccagaccaccagggacccttctgatgaggctccaagagctgtccctgggcagaaggtctccactggtgccctttgtccctgcaggagagtggatgaggcctggaattcagagggaccagcccaggtggggcaggcagaaaactccggagggataattggcagggcagttcggtcctcccagttccgctaagacacaaattactcagcgggcagtggcgcttggctggcatcacctgcaattaccttaatagggcgggaaggcggtgcagcagtggtggtcggggcagccccgctctgctgcatgcctgcgatgggagggacggagtctccaggttccagccgtctcatggctagggaagtttccagaaacccgctggaccctctcttctccaccaagcctctcacctgtctgttctctccccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtaatgccactcgcgctgtctccgagggccgggggcgtgcatgtagacctgcgtccagctcatgagacatggcacaaatgagatgtaggcagagactgacctgggacctgggccaaggtttctgcagaggagtgccgatctccgggcagacggcacagagctgtggtctctgggaggtgggcaccaccctcctcagggacactgggggctggcatccacgtcttcccaatctgccagcctgtggccccaacttctggatgtctgtcagcaatgccgtcctcacccacaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggtaagtggaagcccacggctgggaggagcacgccggatccgcctggccgcggccgtgcgggaaaagtccagcaccccctgctctccctcggtgacgggcagcctgggagggcatcccggagctcagggccaaagtcctcctgagctcatcagttaggagttttgatttgagagtcactcgggaagttggtgttggacaggcctccgtccatcccttggccctagaggcaggggtcctgtcctttctgtgtctggaagcagccgacagcctctgaagtccctgccaggtctctgatgctggcccctgtcctccccacaggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgttttctgtgtttccgatgtttttgtcttatgggcccctttttccccatgcagagaagtaatggaaacaattgacacattcttatccaaacccttcctcgttacggtcactggggggccctggtcaagacaagagcctggcccagatagcttaagtgacctgcccagggcctcagacagtcactgcctgctgagtcctggtttagcatgctctgctctcagcagcggcagcagcggggcgccctgagctccatccatcagcctcatactaccctgcatctacctctgccaggccgagaccgccaggctttatgtagtcacccggggatccagtcttggcctcccaggaccctcccagggttagaccacagaaggagccacagtcccaaaaagagggtgcaaagctcacatcacttctggtcagacacttagggacggccacactctgtgtccacacacctagggacagccatatgctgtgtccatgcacctagggatggccacacctgtgcccacgcacctagggacagccacactctgcatccaggcacctagggacagccacactctgtgtccacgcacctagggacggccacaccttgtccacgcaccgagggacagccacacctgtatccacacacctaaggatggccacacctgtgtccacgcaccgagggatggccgcacctctgtccaggcacctggggagagccacacctgtgtccatgcaccgagggatggccacacctgtgtccaggcacccagggacggccacacctgtgtccatgcaccgagggacggctgcacctgcacaacccttgtgctgtgccatgcacactcagaagtgtgttatgtatattggctcacttgactcaactcgcttctgaggcaggttctgtgaccacccccaccctggcagacagaatttgggtagctgacacagtgtctcacaactgaccagcagtggagctaggctgccacccgcctggcctggcccagggtctgctcggtaactgctcacgctatggatggagaaagcaggaagggacgtagggtccctctaggcaattcaaactaggaaatttggagcttgcctggctttccctatcgcttaccaggattgctctgggagactgatctctttgggggccctggtccctgggtcccaattcgtgttttccaccatggcctggccagatggataagaaagctacaggtctgggacgctggtcttgttccaggaggcgtgggaagggttggtaccaggcgctgtgaggcgagggaagacatccttttccaaggctccctgtagccgcccacaggactaaaaagggccccaaccaattttctgtctctaaatagctggccatgaaggatttctcttatccagagaggcctctctgtgaaaggccaactaaatcccatttcctatcccaagacgtgcatcccgctgttgggaacccaggggactacccaccacatgaacttcaggaggcaggacagcctccaggaagcaggggcagtgtaggggtggaagaggctccctctgagcctctgtactccctcccatgcctcagatgagctcaggtgggtgccgtgccctgtgccacccagaagagctcttccctagcagggcggggccagtcacatttccaggcccagaatattctccaggctctgttggattgtagctgtgagggaaatgaaaagtgtacagggctctgctgactgggaaaaagagaggagattatctaacccagaacaaatggcgtggccaaactacaaacactatggaacccaaaagcagtcttttgcatcagaaagaacaaaggcttcttggaagaggtgggtctgcggctgggctggaagaacaggaggatgtgagtagaacagaggaggaggtgtttcggggaaggaaagtgggctcagacaccaggggagatgagcgaagccaggagcggggtggaaggcgtccctgtttccactaaagccgatgcctcttcattcagccagtcacactgtaggcatttttctagtcccgcctaggtgtcaggaagaactggtaactatacaagattctgagacacaggagaactgggggatgtagccagacagccttatcaaggatgaacggagagtcctatttttatacctaaaaacaaagcaaccaagggcagggtgggaaaagctttacaacaacagtaagtgccattaagatttatattctatcttggaatattttccaatatatatattttttgagacggagtttcgctcttgtcgcccaggctggagtgcaatggcacgatctcagcttacttcaacctctggctcccagggttcaagctattctcccgcctcagcctcccgagtagctgagattacaggtgcccaccaccatgcctggctaatttttcgtatttttagtagagacagagtggtttcaccatgttcgccaggctggtctcgaactcctgacctcaggtattccacccatcttggcctcctaaagtgctgggattacaggtgtgagccactgcacccggctccccctttttttttttttatagtgaatatatattatttttacaatcagttgtaagacaatttaggtgttttcagtgacctgaagttcaacaggtcaacaggaaaatggggcggtcccttcccctgccacccaaaaaagagctaatgatggctgagagtggcggctcacggctataatcccaaaactttgggaagccaaggcaggcagatcgcttgagcccaggagttagaggcaagcctgggcaacatagggagatcctgtctctacaaaaaaattttagaattaggccgggtgtggtggctcatgcctgtaatcccagcactttgggaggctgaggcgggtggatcacctgaggtcaggagttccagaccagcctggccaatatggcgaaaccctgcctctacaaaaaatacagaaatctgccaggtatggtggcacactcctgtaatccaagctactcaggaggctgaggcaggagaatcgcttgaaccctggagacagaggtttcagtgagtcgagattgagccactgcactccagccagggtgacagaacaagactctgtctcaaaaaaaaaaaaaaattaactgggcatggtagcatgttcctctagtcccagctactcctggggctaaggtgggaaaattgcttgagcctgggaggtcaagactgcagtaagctgagattgcaccactgcactccagcctgggtgacagcgcaagaccctacctcccagaaaaaaaaaaaaagaactaatgtgattttggacaatatcagaagtgtggcaccaacagctaaggctgcctccctctgcttggtcaggcacccatcagtggtgcaggggaagagcagggtctcaaatcaggagcctggtctgagcctagccctctgtcactgtctgcgtgatcccaggcgagtgaccacctctgtttcctcatctataaaatgaggtgggctcctaaacccaaaagttccagttcctctctgctctaaagactccataaaaactttttttttttttttaggcagagtctcactcgctcttgtcaccaggctggagtgcagtggctcaatctcggctcactgcaacctctgcctcctgggttcaagcgattctcctgtctcagcctcctgagtagctgggattataggcgcccgccaccatgcccagccaatttttgtacttttagtagagatggggtttcagcatgttggccaggctggtcttgaactcctgacctcaggtgatccacccgccttggcctcccaaattgttgggattacaggcatgagccaccgtgcccagcctcataaaaactcttgaagacacttgctggcaaactggcagaggtgaggaggctaaaggctgggaggttgccctgcaggaggggccaagggcggggaggccaggagagcagtgcaggcagctggagacttccaagcaccccatgccccagctgctgggaacggctggagggctgctggcctggctgggggtcatttgctgggactcactaaagggacctaattctggcactgcaggtgggacacagccacaaaatctcctagccacaaaatcctctaaggtcaaagtgcgctggccgtgatttccaggcctgctcatcagatccaagaaggcagagccagggagaaaatgctgctgagctgagtgggatggaagagacagccgagcagacagcaagacctgcagcaaggtggctccctgcactgaacctggactcgccacgggcaggcgctcccctctgatcctctcactgtcctctgggtccactccctcgggcgatggcagccacctgacccaggatgtcccgctcttttcacagccaaatctctcttcctgagctctggagtctgtctggctcctgctctcccaccttaggctccagggcctggctctttcagtccctacaaccaaccagtcagctcccagttcaccgccctcccccaacaccccagctctcccaggcagaggtggcatggaggcagcggaggcggcaggcaggctgcatgtgggggctcaggtacctcgcccctgtggggcccatgccaggggtaggttgactcaagtgtggagatcggggtcttgggcaagggcgctcctttgtgacttagatcttccaggctctgtttcctgattgtaagagctgggtatcagtgcctgatttcctccgttcctcactttctgtctgtgacatgattccatacaatcctactttgatcaatcttttaaaatagaaaaaaggctgggcgtggtggctcacgcctgtaatcccagcactttgggaggccaacgcgggcagatcatgaggtcaggagatccagaccatcccggctaacacggtgaaaccccatatctactaaaaatacaaaaaaaaaattagccaggcgtggtggcacgtgcctgtagtcccagctactcgggagggtgaggcaggagaatcacttgaacccaggaggcagaggttgtagtgagccgagatcacaccactgcactccagtctgggtgacagagcaagactctgccttaaaaaataaaataaataaataaaaataaaataaaatagagtaaaacacaaagaaaacagatcatttaaaatgtgctcagaggccaggtgcagtagctcacgcttgtaatccctgcactttgggaggcgaaggcgggaggatcacctgagagcaggggttcaagaccagcctggccaacatggtgaaaccctgactctactaaaaacacaaaaattagccgggcatggtggcacatgcctgtaatcccagctactcaggaggctgaggcagagatcgcttgaacccaggaggcggaggttgcagtgagccgagatcgcgccactgcactccagcctgggcaacagtgtgagactccatctcaaaaaagaaaaaaaaaaaaaaaaagaccaagagttcttggggcaagatttggctttggggccagaagtaaatagtcctgtaatagcagctaatcacgacttgcactacctgagctcctactacgtgtcaggccgaagcctctgacatcatctctagtccccaaaacaaccctaggaggtagctattattgttgctatctttagacaaaaaaactgaggctcagggaaattaaccatcttgctcaaggtcacacggtgagcaagtggtgaagctgggctctgacctgacgcctgctagactctaaagtttgggctcttgtctctcaggtcctcaagtgcttatgaaactccttccctttcagttcttcattttgtctccgaacattcggtctctgcacccactctgtgccggggcggtgctcaggttttgagggtgcaaagatgcctaagatgacctccgtccagaaggtcaccttcgagtgggggaaacaaatatggcccagtccaggcagcggaagaggagggtgagaagtggagactggagggggccaggctgccccagggcacagagactccaccaccacagactccaccctccagcaggaatctcttgagctcccgaatgtcaccccatgtcaagacagttgagaaaagacaaaggaggaagaaatactaacacgggtgggcacctacctgccatctgtctggcatattgcacatggcatctcatttaatcttccagcaaccctgagaggctggcactgttactgtcactttctagacaagggcagtcaaacctaaagaagttaagaaacagccaaggtcagcccacgttccctgcagagcggagtgtcccggctccgagcctgggctctctctagagcatgccactgtctttccaagaatgtgtagaagtagaaggaaagagagtggggacaccccaaagcccaactgcagggaactaaacccaagacccggagggagaccacaggtgcccggggctggccccgccataccattgtcaggtgtgtttgctcctgctaatgtcgcagccacagctgtctcttaaatgtcccaaacctggaggaagggtgggacggaagtgcaggaaggaagatgctgggggatccggagtgagcgaggacattccaaacccacaggagctctggaaggaactcccgacgtccatccccgacatgccctgaactcctccctacagttccaattttccaaagtaatgatcttggtgggtaagaaactcatcctgtcctcaccgcctcggccttggagggccagtccagccggctccctccgcctctccccgttgaggactccaggcaggtaacaggcctgagcgcttccctccccatgcacagcggacaggcaagaccaggaggactggaaggacttgtgtccctgtcaccagcagcacaaatgaagccgccagaggtaataacagggcaagggcgcgctcaccagctctcaggccgtgctagagcacgggccctggaggagtggggttccctgtgtgccagactggtggtgcctcctgccctccctaaccagcacactctcctctgactcaaacgccccctaactgtttgctcccctccactcccttccgggagctgtaagaggttcctgccagggttctcagaagccttgtgtagggacctctgtggggccaccacagccctcaggccacagccctgtaagagaggtggtaggtgctggagtcagggcagaggggctgagagctgccctggctgagtttcatgcccaggtggggaggaagcgttccctaaggaggcgaggagccctctaagaagtttgatttgtttggggtttgaaatttcagccttaatataaagagttcctacatatctgtaagaaaaataaaaggtggccgggcgcagtggcttacacctgtaatcccagcactttgggaggccaaggagggtggatcacctgaggttgggagttcgagaccagactgaccaacatggagaaacctcatctctactaaaaatacaaaaaattagctgggcgtggtggcatatgcctgtaatcccagctatttgggaggctaaggcaggagaattgccttaacccgggaggcagaggttgcggtgagccgagatcgcaccattgcgctccagcctgggcaatgagagcgaaactccgtctcaagaaagaaagaaaagaaagagagagagaaaggacgaaggaaggaaggaaggaaggagggagggagggagggaggcaggcaggcaggcaggcgtggtggctcacgcctgtaatcccagcactttgggaggcagaggtgggcagatcacttgagcccaggagttcgagaccagcctgggcaacatggcaaaaccctgtctctactaaaaaaaaaaaaacacaaaaaattagccgggcatggtggtgcgcacctctaatcccagctactcaggaggctaaggcatgagaattgcttgaacccaagaggtgcatgttgcagtgagccaagattgcaccactgcactccacctgggcaacagagcaaaaaataaaaatataaaaaataaaatatgtaccatgggaagctggcaaacagtatggattattcataaaacagcttcaaatgataacaattatatgaaaaaaattcaacttcattcataatccaaggaataaaaatgaaaattaggtatctgttacctataagcaagtctatcaaggcccagtgtggtggctcacgcttgtaatcctagcactttgggaggctgaggcgggcggattgcttgaggccaggagttcaagaccaacctggccaacatggtgagacctccatctctaaaaaaaaaaaaaaaaaaaaaaaagaggctgggtgtggtggcttgtgcctgtaatcccagcactttgggaggctgaggtgggcagatcaccaggtcaggagtttaagaccagcctgaccaatgtggtgaaaccccgtctctactaaaaatacaaaaattagccaggtgtggtggcacgtgcctacaatcccaactactcaggaggctgaggcaggagactagcttgaacctgggaggcagaggttgcaatgagccgagatcatgccattgcactccagcctgggcgacagagcaagactctagctcaaaaaaaaaaaaaaaaaaaaagcctatcataaaactagttataatattgaaaaagtagaaacaatctaaatatttaacctgagtacattaaaaattataattaagtaagctgtgtgtggtggctcacacttgtaatcccagcactctgggagggcaaggcaggcggattacttgaggtcaggagttcaagatcagcctggccaacatggtgaaaccccgtctctaccaaaaaatacaaaaaaaattagccgggcgtggtagcgtgctcctgtagtcccagctacttgggaaactgaggcacaagaattgcttgaacctgggagacggagattgcagtgagctgagatcacaccactgtaccctgtagcctggacaacagagtgagaccctgtctcaaaaaaagaaaaactataatgaaatatgtgtatctcttaaatatgatggcaaaaaatatttcaggaaaatgcttacaatatattaaatttaaaagcaggttccaaaacagtattatggggtaggcacccttgtcatttttataaacgtaagtcagtccatatgtctgtagtaaaaatcatggaagtaaaaatcttaaattcttgttcaatggcagaattatgacttttattttcttttttctatatttcgtacttttttctacaatattcccatattgcttttgtagtgaaatcttcttgatgattttgaaagagtccttcaggaaggcaatgttggaataattggctgcaaaaggatgttcttcattgaacagtgaaaattcttgccaatttaggccggccgcggtggctcacgcctgtaatcccagcactttgggaggccgaagcgggtggatcacttgaggtcaggagtttgagaccagcctggccaacatggcgaaaccccatctctactaaaaatacaaaaaaattagcagggcttgctggcgggcgcctgtaatcccagctactcaggaggctgaggcaggagaatcgcttgaacctgggaggcagaggttgcagtgagccgagattgcgccaccgccctccagcctgggtgacagagtgagaccatgtctcaaaaaaaaaaaaaaaaaaaaaacattgcccatttgatggttatagaaatgggctgggatggcaatgggtgggaggaaggccgagggaataaactgctccagatccaggaatcctgatttttgatgttaccatgaaatctaaatgtgtagaaagcacaaagaatctggagtccccggacacacagtttgaatcctacagctgctttgaggaagatgccttagctttctgagactgactgttcataaagtggaagtaagagcaatgtaggatgatggtgaagattaagataatgagttgctttgtgaagcagaaagctctaaacaaatgctggatgcagcagataataacatccatgtctggtttagcttcggtaagatgggcggtggctgctgtagttgaatttgccctgactgctgagaacgctgggcacgttgcagctgagagacaattttcccatagggtacaggcaaactcttggattttccggtccacagtaatacagaatataaaaataaactagctgggcacggcggctcatgcctgtaatcccagcaactcgggaggctgaggcaggaggatcacatgagctcaggagtttcagaccaacattgtgagatcccgtttctgcaaaatatttaaaaattagccagatacagtggcagggcctatagtcccagctacttgggaggctgaggtgggaggatcactcgagcccaggagtttgaggttatagtgagctatgatgacaccacagcattccagcctgtgtgaacagaacgagactctgtcccagaattttttttttttttttttttttttttttttgtgagagagtcctacactgttgcccaggctggagtgcagtggcaggatctcggttcactgcaacctctgcctcccaggttcaagcaactctcctgcctcagcctcccgagtagctgggattacaggcatgcgcaaccacgcccgggtaattttttttgtattttttagagatggggtttcaccatattggccaggctggtcttgaactcctgaccttgtgatccgcccacctcagcctctcaaagtgctgggattacaggcgtgagccactgcacccggcctaaaaaaatttattttaatttaaaaaattaagtaaaaataaacttattctgagttcagaggaaggtgtttggtgacctgctgactaccctttcaggagtgaatatacggcccctgatgagaacccctggttagtcgtgtgctgagcactgggaaggagagaaaacggcacaaaatggagacacctgtgacctccttcacctatacctgcttactgatgttttggcgaaatgcttgggggctgagttgggtggaccgaggatgccagagcttgtcatctaaggaggctgggagaggctgggtggtggttccggttagatgggtctccaccctgcacgagatagatgggcaggctcatgaatcatgagcccctcgtgttcataactgattagctagtttgttgcggcgccactcttgactttcccacaatatgggccctgacatcctcagagggtaccacgttcttcagtccacccagatgaaatggatttacaaatccaatgatgagctttctgagtactgactgtgtttggagactcgttcttgactgtgccactccaagtccttcaaatgaaagacaatgttcaccctttttttccttccttttctgctccttctaggatacccctcgccacgttttctgttttacctccttttctttcaaggaatcattttaattgctcttcctctccttgttcctcagtttccctcaccttctcctcatgtcctcctctctctgcctctggatctagccagcgtcttcctctgtgctcttcatgtcacaggcacctgccaccaggagccaccgatgccaggctgtcctgagctaacgcacagggaggactgtatgacgagggagtgcagacggcaagacagccactcaacagcagaatgggggctgcccttgccgcccaggccacccaggctgtggctcctgagctgcgtggtcctcccttcatcactcgccccctctctgaattctcccacagccttttacaatcttttcaaacagcttttctccccatactcctgccagccctcctcccctgccctccctccgaaggagcccttggatttatccacacctgctggtgccaacatgccccagactgaacgcgccactccaggtgtggttttgcctggtgaatggagaggcacggggcggctctgtgtccagaggtgggagaggccgtccagggccagccttgcacctgggttcagccagcgcagctgcccccaaccatgccaggccgctctgttgatccccgctatcgagcggagcgtcaggacaggagcttttgctgtctccttcctgcctcagaaccccacccactatgttttttctcatctgaatctcagttcgaaatctccagcccaaggggtttcccaacacctcctagttttgaatcaacctgctgatgccagcattcccagatgaggaatagagatgtgaggtgggacctggcctggcactgcgtggtgaagacactcctgtacccgcaacggtcatccaactggtggcatctggacaaacaaacccagtcccctccttagcttccatgaaggaaaaaaacaagtgggtacaagctgaggacacggctgggagtggaactgtaggaacaaggactggccagatggcgacaccaaggcggccatgctcctaccctgaagccgcagctgcaggtctggtctgcaccaggtggtcctctccggcaaccaaagaattctctgcccccaacagtgcctcggtggaaaccatgcccagtctctctcggggtcaccccacaggaatatgccttttagtcccccacctatggcttcatggggaagacttctggcagcagaggcccgggcatggcagcaggaaacagagaactgggtcagtcttcttctttgtcctactgtggcctcggggtctggtcattctccgaatggggctgaaggacagcaatagggccagaacggcaatctgggtctgtgcatcatgttctagccaacaaaacatcccaccttggattttattttttaaatctattcaaagcttcggttccgcatccaattcccagagaggccatccccttgtccaaatgggcagagtggcatgccagcactgagccacctctggagggggctggccacctctggatgggtcggcaccctctcacaggggtgaacactgcagactggaactgagcttctctctgctcctctgatttgaggagagagcacacctgataccacagcaagcacttgttcttggcacttggtgtcactcttgcttcatcttggctcagcttaaacccttcaactgaatggtggcgatcaccacagaggagaactctcttcttccccctccgtgccacatgcacacacatgcacactcacacacacgcacacaattgtacacacatgcacactcacatacgtgcacaattatacacacacgcaatcacacacacatgcactcacatgcacacacgtagacacacgcacaattgcacacacatgcacacgtgcactcacgcgtacacactcgcacacacatgcacactcgcacacacgttgagacgtgcactcacgtatacactcccacacacgttcagacgtgcactcacgtgcacactcgcaaacacgcacactcacacatgcacactcacacacatgcacactcacatgcccgccagggcaggagcctggctctccaggaggcagggcaagtgtccagacagaaggatgagagccatgttgtggcacaggagggccccatggtggatgatggggaggaagggccatgtggacaggcaggggtggggttgggaggggctcctcatctttcctgagcagggcccgggtggaaccaagtctcctggaattgttcattgttgacttcaccaacatattcttaaaacttgaaattgctcagaagataatctaacagcacaaacatgcacacataaacagtaagagtcccttggcatcaaactggcaaactgtggtggcagaaacacaggaaggatccactcccggtgtgaggcttgctgtccctccctcttcaatgcgctggctaccaagcctttgccaatccccagtgcagcagttcacagactttttactgctaagaacggcttttggcaaccccaaaaatgtgatgtgccctttcggtgggtagaattaattggcgtaatagaacgtgtcctcctctcaggcctcagcactgctgctgcatcttcgcagcctctctcagcctcggttctgccacctttcctcactcatacaacaacaggctcctcctatcgaggaggtaatgagctcccactggactttggggtcctctagagtcacctgcaaactccactcctccctcccaacgtcgtctctagaagattcctttgtcctcgaggctctcctttcagtgaaggaccctcatgaggacacagtgcctcctctgggacacacagccataatactcttgtcataagaaatccaactccttgaccgggcttggtggctcacgcctgtaatcccagcactttgggaggccaaggcaggtggatcacctgaggtcaagagttcgagaccagcctgaccaacatggtgaaaccccatctctactaaaaatacaaaaattagctgggcgtggtggtgcgtgcctgtaatcccagctactcgggcggctgaggcagaagaatcacttgaacccgggaggtggaggttgcagtgagcagagatcataccactgccctccagcctgggcgacagagcaagactctgtcgaaaaagaaaaagaaaaaagaaaagaaaagaaagaaatccaactcctctgctacccatgagggaaggtggctcaggatgaaagggaagtttgacaatccctaaatatcacaggcttaagaagagccattacccaagaagtcgtgtggaaagagctgccggcctcagccacagctgtcctctacccacactgccgcctgccgcaggccacagcaccgtcagccgaaaaagcccactgatatctgggttacagggcttgaggctgccttgatttctggctaacagctgggccgtcctcggcaagagctctcctgggaacgggttggggagattccccgtgccctgtcattctgatgtctccctgcacaagggagcgggttaaccatgtccttgccacctcatcttcgaaaacaactcataaaagcgcatcagaggaaacagtcttttcatcccacctatcattagttcccagaacaggggctggaagtaggcagcctccctgggagtttgcgggatgaggcaacaccggcgcctgagctaccatttagcctatttctagagataagcctgttgatgtcaaagtaaggaatgaccaactccagccaacagcgccctgtgggactgggtctgtgacatctcctttctcccaggcaccatccccagggcaggagacaggaaccctagatcgtgggggtttgtgaactgacctaggtaaataataacaagttgggctgcactctccttgaggtaattcaaagtactttatcaccattacctcactgatcttaactaacatccaaggaaggaaggaaagaaaaaaggcagaagctttctcatttcctaaaacaaaagtgaatgggggctgggtgcggtggctcacacctgcgatcccagcactttgggaggccaaggcaggtggatcagctgacgtcaggagttcgacaccagcctgaccaatatgatgaaatcccgtctctgctaaaaatacgaaaacttagtcgggtgtggtggtgggcacatgtaattccagctacccaggaggctgagacaggagaatcgcttgaacctgggaagcagaggttgcattgagccaagatctcaccactgcactccagcctgggcaacagagcaagactccatctcaaaaaaaaaaaaaaaaaaaaaaaagtgaatggggagtgggagcttttaggtgaaccagctcctattcacctatggtcagtgaagaataagtacctcaaatatacacaataacactaatggggatgggggagggcatacaaatgaactccaaagccctgactgtggcccatagccagagaaaacaaaaaagattcctgatttggggagaggagtcctcaactgggagtttgacagttcagactgatttcaaaagacaggctgaattttacccctctgtgctagaaagggtatcgaaccataaattccccctgccctgacttcaccaaactttgtaaataacagagacgcgcacccgagtaattagaagaaaaagctaagtggcttgtcagctaagtggcttgagtaggcataggtgtggctggaagcattctgtgtattttctctacagccaaatgtgtaaacggtcagaaatactagtttaatgagcttataaatttggagtgactctttacatctgacagtgaggtctggggttcaactatttcacctctgaaatcaaagaggctgtgatggggtattcatctcttaccaattctttttttttttttttctttttttgagatggagtttcgctcttgttgcccaggctggactgcagtggcgcaatctcagctcactgcaatctgtctcccgggttcaagcaattctcctgcctccgcctcctgagtagctaggattacaggcgcccaccacaacgcccggctaattttgtgtatttttagtagagacggggtttcatcatgttggctagtctggtcttgaattcctgacctcaggtgatccacccacctcggcctcccaaagtgctgggattacaggtgtgagccaccacgcccggcccatctctgaccaattcttccagaatgttccacaggtttcttcttcacactttatgattctattttactgacccaaacaattcgccctccaatgtttcgtggaggggataacaactctgggtatttgaagatgttttctgacatcttatctgtttccttccctccttggtctgcgctgggctacctgaaatgcctcctacacgcgcgcttcccttatgaacattcattagatgggtacttgtcctgcttaactcctacaaattcacaagttctctaatgctcaaattcaaagcacttgcatctctaggtaatcactgtttgctaaaatgctctttagctttttctatctacaatgtttctaaacgttaatttaattgaacttaaaagcgattgtgcataatgtgccgcaacttggcactcagctcatgtaaacagtgtcttgctgacagggtaggtctagtgcaggaaataaccgcgtcagcagcgctgtcccacataggactacaaatccatgacagcctcaggggctccccacgaggcacaatgggtgatgtcattcttctggggcttggctaggccatgactgggtctagaggcactctctcttcccagtccgtttttagaactaatatttgcaatgccacttccacatttccctctatttctgattcatgtcagcctgaggcctgagacagaacaagcctgcagctgaacacatggttaccactttttttccagaaccttaggaaaacgttgttaatgttcagggctatgagtgaccttgccgtcccacatcatggaactatttattaaacagatggatggacaaccttataattaggtcaactacgtatactccgattcaagcccttggtttcattccttttctctctaagattagggaatttctcaatgaccaataacgcagaaatacaccccctcacatcccgagggagattgctcagcctacagccaccccgtgaagatcccatgacttctggcatctgccctaataacccaagtctcttatctgtgagttttggtttgtcagaccctgttgttcgcattaatcttcctgtgcctgtgaggacagaacccggacaaagtgggagtcctgaacctgcgtatgctggttgaataggtaaacaccctcagataaggaggccttgggaaaaccattgtgacgtcctaagaatgcaaggtgtaaaagttccaatcccactctcccacccctaaaccagttgagacacagacctgcccttccccaggttgacttggcccgactagatagcatctgcaatctgcactcgctccctccctcccaagtgaatcagtccccaaccggttacctccccaggctccttggagacaatgccaagtacagcctagggggtgatggctccatttgaggagcctggcatcttggagagtgccaccccaatcccccgctttgggcaggtgcatagggaggactcaggaaagaggtgttctgccatggaccagtccaggtccaaaaagtctcgagaagcgcccgggagccaggagaaaagccgagagatgaaaggagatgcctgaggtgccgcagcccaggtctgagccgggctagaaaccgcgtgacaaaacaaagatgcgttcttagccgtgatggaactcccagattagcttggctttcttccttttgttttgttttgttttattcatctctgtcgcatctattttcctctgggcatgtgacacttccactctttctcttctttagtcctcttccagaagttctgttctgtgctggattaggtcaggagtgatggattgttcttatacacacgggatatggtggatgaatgtgttgatctgacactcactgagagttctaaacagggaattatagcagtgacaagtggtgaaagacatggcccctgcctcttgagcttctgtgggacccagcaggctggaggggcgcacccagctttatgcatctgccctcaggagagctgcacaggctccaatttttctacttttatttttaatttaattttttttttgagatggagtctcactctgtcatccaggctggagtgcagtggcacaatctctgccccccaggttcaagcgattctcctgcctcagcctcccaagtagctgggattacagctgcctgccactgcgcccagctaatgtttgtatttttagtagagacagggtttcaccatcttggcgaggctggtcttgaactcctgacctcgtgatccacctgccttggcctccaaaagtgttggaattacaggcgtgagccaccgcgcccggcctcaggctccggtttttctaaatgaaagcctcatctcttactgacccactgggtaactgaacccttgattttcatgtaagactgatctcttggcctggcgcagtggctcacgcctataatcccagcactttgggaggccaaggcaggcagatcaccagatcaggagattgagaccatcctggccaacatggtgaaaccccgtctctactaaaaatacaaaaattagctgggtgtggtggagtgcacctgtaatcccagctacttggaaggctgaggcaggagaatggtttgaacccaggaggcagagattgcacagtgagccaaaatcacgccactccactgcagcctggcgacagagcgagactccgcctcaaaaagaaaacaaacaaacaaacaaacaaacaaaaacggatttcccgctggtaacaactggttaattagtctctggttttctgtccttctagtcaaatgctccagaagagctctgtatttaaatacgcccaagtatgaatctctggtcaagtgaagactatttctagaaaacaagtaagtcttcccaaattcatctgcctcagctaggactggcataaatcactttttcttgaattggtctccattgcatatcccattttcttctcatcttttttttttaattgccaaacaagatgtatgccacccaagccacaaaatggcaggcaaccaatttctgtcctgctacatccaaaattctctaaggttctacaaatatgagcaatgattaccaaaggacttgtgctgtaagggaagaagaggaactggaaatattccggctagtgccaggagctctggggaccccagctctgcctggctgcctgggtccagtcattccgaaggagataatgtctatggctgctgataggtctctctggtgaccacaatttcagaactggaaattggtggtggtctgatgcgtagcctaacaaagggccagtgggccagtcctctgtcccagaaattgagattgtcccagaaatctgaggccacatggttgcccgcaggacagctctaagacaccatttagttgattaaagcagatgttcaaactctcctccaatcccacctatctactcacaatttgcatccccccaacccccatcagtctcctttttttaaaaaaagagatatgctaggccaggcatggtggctcaggcctgtaattccagcactttgggaggctgaggcaggaggatcacttgagaccaggagtttgagatcagcctgggcaacatagcaacaccctgtctctaaaaaaaaaaaaaaaaattagccagtgatgcgtgcctgtggtcccagctagctactcgggaggctgagatgggaggatcgctggagcccaggaggatgaggctgcagtgagctctgattgtaccactgaactccagcctgggcaacagagccagaccctgtctccaaaaaaagaaaaaagataaagagaaatgctagtggtaaaaaaacgtaacttaaagcctgtacattccccgcaggggggtgtttatggccttgtatccagctggctcttcccagattcaaaagcaattattccaaaagaatgctttatggttaaaattaaaccacagtccaaaagctattagaactggactttgaacaaatgccaaagaggacagttatgaacatcttcttgacagaaaaagaaagagacccaccagaaggaagaaatctaaaacaaacaaaaaattaagtaaaatgttgaaacctgttcaaccaccctatttcagatagaacgcactttttaaccacattaggaaagcgaaactcgccgtgggtggggtggaaacgctgccaggtcatcctgtctaaagaaactctggtcgcgcctacctgagggacgtgcgggcgcggctcggcccccacgaggcgccccgacaccgcgccggccgcgcggctcccgcaggcacagcgcccgccccggcgagcaccagtgcatcaccccggtgacgtgggtcacctgccctgatgcgttattccgccgcttgatgaagaaaccagcatttaggaaaacacagaggcgcacattagcgtgcacgaaatcgcccgagggagctgagagctggcgaggtcacgagtgccgggctccgggcggggggtggggcagggcggcggggcaaggccggggcgggagcggcgatccgaggccgggtcagcagcgccccctcctggaacgccgggagcgccgcgcgcgcggatgccgctctccttccagcctggcgcgccgctgccccctatcggacaaacgctttgaccgttggctaaagcaagtatcagacgtcagcccctccaggtggcaagcacgcctggccaagcctcagtttccacatctctcaaatgggagcgatggcaacactatctacccttgcacacctcagagggtgaccaggagcaaatgaaggaagcaccgctctttcttcctgggccggcctcgctgcttaggccccagcaaaatccaggtcgcctccccgaggtcatctttgtcccccgtgtctgaactgggagcacagttataaaaccagtcatgttgttctgagagtggcgtctctcttccagtagcttcgataactccacaaatgtatttaacataattttcaaaacattttttcttataagcatgtatcataatttagttttccggcaattatccattcactgtctaaatcccccaccacactgtgagtcctggggatgcagggacctccctgtcactgtcattgttgtgtctccagaatctgcctagcacagtgcctcccacacagtaggtgctcaataaattgctgttggaaaaatacatggatgaagcctaggagctggaggctaggcagaaacagaaaggacaaagtcagatacggggggaaatcctatttccagaatggtatctcaagtgactattaaaaatgcggcgccgggcgcggtggctcacgcctgtaatcccagcactttgggaagccgaggcgggcggatcacgaggtcaggagatcgagaccatcctggctaacatggtgaaaccccgtctctactaaaaatacaaaaaaaattagccgggcgtggtggcgggcgcctgtagtcccagctactcgggaggctgactgcaggagaatggtgtgaacctgggaggcggagcttgcagtgagccgagatcgcgcccctggactccagcctgggctacagagcgagactccgtctcaaaaaaaataaaaatataaatataaataaataaataaataaataaataaataaataaataaataaaaattaaaatgaggccaaaggccgggtgcagtggctcattcctgtaatcctagcactttgggaggccgaggtaggtgaatcacttgaggccaggagttccagaccagtggggccaacatggtaaaaccctgtctctactaaaaatagaaaaaaattaactgggcgtggtggtgtgcacctgtaatcccagctactgaggagactgaggcataagactctcttaaccctgggaggcagaggttgcagtgagccgagattgcaccactgtcctacctggtgacagagtgagactctgtgtcaaaaaataaaaataaaaaaggccaggcacagtgactcacgcctgtaataccagcactggaggaagccaaggtaggaggatcacttaggcccaggagttcaagaccagcctgggcaacaagatgaaaccacggctctgcaaaaaatacaaaaattagccaggcactgtggcgtatgtctatagtttcagctatttgggaggctgaggtgggaggattgcttgagcccagcaggtggaagccgcagggaaccatgatcacaccaccgcattccagcctgagcaacagagtgagatcctgtctctaaataataataataattaataaaataaaataaaataaaaatgaaaggccaggcacagtggtgagtgcctataatcccagctactcaggagactgaggttggaggatcacttgagcccaggtgttctaatccagcttgggcaatgtagggagacaccatctctattttaaaaagaaaagaaagaaaaggtggggatgatgaaaaaggtttttaaatagaaagcggtggtggttgcacaacattgtgaatgcaccaaatgccactgaattgtaggctataaaatgattaattatatgttatatgcatttcacctcaataaaaaaaatgaaagggcagaattgtaatataatcattatgatcattcctgctttagacactgcaaatacttgatgaagtcaacataaagagaataacttttatagagtgttctacagttgacataaatgttttcatataaatgatttcatttgtccctcccaacaagcccattaatttgcagacgaggaaaacaggattgcagatcagtggcttccttccaacaggtagggcacactccccctcgggggctctgcccttgaggctccccgctatgaaaagacttcctccaaaccacagcttccccctcccctcttgctgggctctgcttcaagggtcaccagaagggccttcctcaaagagcggccctcctccccatcgtcattctctctcccttaccctgcttgagtttttctttaaaattcttaggacatattatattgacattatttctttttgtctccttccacaacaatgtaagcaccaagagaacagtgctatttgtcagttttgttctctgttataatcctgacatctggaatggtacctgacaaataataggtgcttaataaatattgttaaatgaatgcatttgttaaaggaataataactttaccatgaacttggccagatcttttgaggatccaaggctttttaggtcacaccacaaaaacaaaattacaatatgatggagataaaataccagttgtgagaggcctgtaacaaagcgctacccagttcactgattattacctgcgtgtgctccacttatcccccagggaggcacctgtctgttgtatccctggctcccagcatggtgctggacacctagtattaggcactgatctgcatcagtaagaaacaatggattctgagcaacacaaacaagaacagaactggctacagtgcacatcccggtcccaccctaagtgtgcatatggcagggaacggggagtctctgaggaccagaggaaggaggacacgcaggacaggggccagagtccagggagcagcagagcatggccttctgagccccacgtgatttgtgtagaaatagctcccgagaccaagctgatctgccatgtaaacctcgcacgattacttcctgttcccaggggagaacttgcagggctagcctctcgtgagtggggtcagcatggtctgacaggatggatgacccctgtgctatggacagtgagcctctgaggggcaggggccactccataatactgtccagtggcctctgagaaattcctggccagcactggccgccttcctccagttcctgagccaggcagccaggtgtgatggaaagttgtcaggtgtaactcaaagaacatagattaagagtctagaggccgagcgcagtggctcacacctgtaaccccagcactttgggaggccaaggcaggtggatcacctgaggtcaggagtttgagacaagcctggacaacatggtgaaaccccatctctactaaaaatacaaaaattagccgggcatggtggcagacacctgtattcccagctacttgggaggctgaggcaggagaattgcttgaacccgggaggtggaggttgcagtgagctgagatcaagccactgcattccagcctgggtgacagagcgagactctggctaaaaaaaaaaaaaaaaaaaaagcaagaaaagaaaagaaaaagagtcgactcctgcactttgctggcagctctgcttcctgcacctgtttgaacctgtatctctaagggcagtatacagattgcaaacaaaaactcacacaagcatgaaatgtggtcatttgcccaacctgaccatgggcacggagaattattgttatactttaaatggaacataatatttaatacagataaatacctgtttgccagtgtggacctcacatttgaacgttatggtacagaaacatgttttcaccctttaatcataaaagtttattaaaatgttctttttttttttgagaccgaatttcactcttgtcacccaggctggagcacaaaggtgcaatcttggctcactgcaacctccgcttcctgggttcaagtgattctcctgccttggcctcctaagtagctggaattacaggcacccgccaccatgcctggctaagttttgtatttttaatagagatggggtttcaccatgttggccaggctggtcttgaaaaaatgttctgaaagtgaagtttgtttctttccttctttccttcctttcttccttccttccttttttcctttttttttttttcatggtctcgctctgtcacccaggctggagcatagtagcacaatctcggctcactgcaacctccacctcccgggctcaagtgatcctcccacaccagcttcccgagtagctgggactacaggcgtggttcaccaggaccctctaatttttgtatattttgcagagacgcggttttgccatttacctaggctgctctcaaactcctggactcgagcaatctgcacacctcggtgtcctaaagtgctgggattataggtgtgagccactgcacccagactctgaaactgaatttctatagaaaactccaagctttgtaaactgtggtccacacccccataaacatgcacaggtgcgcgcgtgtgcacacacacacacacacacacacaatcttcccccacagcttccttatcatatgtccaaagtacgcagctcaaaattcaaacaaattatttattacaaaacaaattttaaaaaatcacaacgtgattcgcatactggcaataggctgttacttgccatttgccagggtatgatttgtattttgttttaatttatgctggtttcaggaactatggccatttgcctttttcctgcactacccgtgcgcctcctgtgggcactcagcatgggggggcatgtagtttttctcacttcccgcagcacgtttttatcttatattgcctacaattcagaaaaggtatttagccatcagtggaggcctgggcttggcgtgcattcaatgcacaaacacagcctggcttcaaagccaagctgagtggcacacctcgtgacagaacagcagaaaggcagacccaggtgcctgcggaggtggcagggaccccaggcaggccagtggggcctggccaacaggggggcacaggccccagctgaaggaaacagagagaggcaactccagttcctatatgggcccagtgtggccagatcttctcattttccaagaaaagccagaaactcactctttaatgtgaatctctgcattttaaaaaggtaccaattaattctaaacatggtcttaaaatattctttggggcaaacataacacatctatggccgatgtggcatcagagccacctaactgtgagctctccggagcagaagatggttccagcaggcttctggcccgaatccgccattcattcactgctgactagggtggtcgcttcacctcccaatcacatggcactgaagacccagccagctggtagagctaccacataggtccaaaacctcctcacaccaccacttactaccaacacatactagctatgtcgtttcgattgaccactctgacgggcttcaatgccacctataaaatgtggatagtaatacaattgcggttgtgggattaagtgagataatgtgtgtaacacgcctaatgcagagtaagcatttcacgtcagctactgctatccatgcgcctggcgcctcattcctcaccatccattcacattaatcagccaattctgttaaatgggacttttaatactctctcaagtcttgtttttattcctcctctctccgctgtaattcataacctcatcctctctaccctgaactatttatttattttgtgtgtgtgtgtgtaagagtgtgtgtgtgtgtgtgtgtgtgtgtgtgtttgagatagggtcttgctctgtcacccaggctggagtgcagtggtgtgcgatcaaggctcactacagcctcaatctcccaggctcaagtgatcctcccacctcagcctcctgagtagcttcaactattggcatatgccaccatgcccagctaattttgtttgtttttgtagagatggggtctcactctgttgctcaggccagtctggaactcttggactcaagcaatcctcctgcctcggcctctcaaagtgttggcatttcaggcttgagccaccttgccaggcctgaactacttaccataatgatctagtaatcacatctccactttactgagtgcccgcacaccatgctccggtgactccatctcgaagccggacttctctatgtgaagcacagatctgatggcatcatcttccctgtcacctacagaacagagtcgcaattccttaatcctgcctttgaggctccctccccagtctggccctaggctcatatcctgctagtttctttaagattctctctgctctgggctgggcatggtggcttacgcctgtaatctcaacactttgggaggccaaggctcaggtggatcacctgaggtcagcagtttgagacgagcctggccaacgtggtgaaaccctgtctccactaaaaatacaagaattagccaggtgtggtggcacatgcctgtaatcccagctacctgggaggcagaggcaggagaattgcttgaacctgggaggtggaggctgcaataagccgagattgtgccactacattccagcctgggtgacagagtgagaccctgtctcaaaaagaaaaaaaaaaaaggccaaggccaagagcccggttttacacattttttgcattcccagagggcacacgataagtgctcactgtttgctgaatgaattaattggaccaaccaagaatgcattttaaccaaaagttaatgttacttgtttttttgtttgttttgttttgttttgttttttgtttgagatggagtctccctctgtcacccaggctggagtgcagtggcatgatctctcctcactgcaacctccacctcccgagctctatcaattctcctgcctcagcctccttagtagctgggattacaggtgcgcaccaccacatctggctaatttttgtattttcagtagagatggagtttcaccatgttggccaggctgttctcaaatgcctgacctccagtgatctgcccgcctcagcctcccaaagtgctaggattacaggcatgagccacggcacccaaccaaaagttaatgttactttaacacattctgttacaagaaacaaggctgggactatacaaagaataaaattataaaaattttaaaaatcgtccatgcttggccgggcgtggtggctcacgcctgtaatcccaacactttgggaggccaaggcaggcggatcacaaggtcaggagatcgagaccattctggctaacacagtgaaaccccatctctaatgaaaaatacaaaaaattagctaggcatggtggtgggcgcctgtagtcccagctacttgggaggctgaggcaggagaatggcgtgaacccgggaggaggagcttgcagtgagccgagattgtgccactgcactccagcctgggtggcagagcgagactccgtctcacaaaaaaaaaaaaaaaatcatctaggcttgagcccaggagtttgagaccagcttgggcaacatagtgagacccccatctctgttttatatatatatatatatatatatatatatatatatatatatatatatatatatatatatacacacacacacacacacacacacacacacacacacacacacacacacgatatatatatatttaaaatatatatatgttatatacatatataaatgtatacatatacatataattatacatacatatatgtatatatacttaaatatacatatatatatatatatatatatatatatatataaaaatcactcaggagccctggaatgtgtgtgttttggttaattttagtagaaaagggtattacctatgcaaagctctagctacctagataactgaaaatatctgcacttatgaggtagttggcatttgtcacggtatcttggtcttcatttttctttctgtggccctggtgaaatgcgtctgatatctcaggagaaaatgcaatccaaagaacgattgtggttgtctggttcatcagttgtatactgtgcggtgcaatctgagagattttcacaaagccgaaaactgcccaagtatgacctcgtgcctgtgtaggcctcttataaaagagacaattccccaactctcagagagtttccagaggaggctaggagtgatgatctcgggatggcagagatctaggaaagaaaataaacgtcattgttttttgacatttatatatatatacacacacaattattattattatttttggagacagagtctcactctgtcactaaggttggagtgcagtggcgcgatctcagctcactgcaacctccacctccaggattcaagtgattcttgtgcctcagcctcccaagtagctgggattacaggcgtgagccaccacatctggctaatttttgtatttttagtagagacggggtttcaccatgttggccaggctggtcttaaactcttgacctcaggtgatccgcccgcctcggcctcccaaagtgctgagagtacaggtgtgagctaccgcaccccaccaacatttatattcttaaatacttgccactgaagcgctcatccagtaagtatgcgccgaatgaatggaggggttgctgcacagcctcattccctacccccattcaggatcccaggccttgctttggcaggtgaggaagccaaggttcagggcttgtctggtaggaatagaggaggccattcagcagacagagcggtttccagctcagctctggagtcaggctgcctggactctgtgcctggctctggcagtgtctactgggtagagtcgatagagtaatagttcctatctcaaagagctattggactaaattatagagaacatgtaaagtgcttagcatggtgctgattaaattaccctgattattacaagaattcagtaaatgttagctattataatcatttgtcaagaagatcctaccatgaggcttgagccatctatagcttatctttacaactctgcccactccctattaatatctccactttattgtctaacaatgggatcagagttcctagaaaatgaaagagcaagctatcagcttctgcccaataaagaaggagaaatagcggagctggggagaagcaaacagatctcatacacagaacgcctggttgtgcaactggctcagcttagaaatagatctggactctcaatggccatgcagaaaggaagaaaacaaaggcgcacatcttcaggctgctgagggaaactctatatccagaaaaacctcaagtacaagtatggaacaaagacagtttcaggcttttgaggtttcaaaaaatgtgacattctaagaaacagggtaaattattatagcaatttctcaatagatattaaatagtactgagactgatgaagtcactgaatatgatgggttgatttattctgcagacacatgctgagtgctactatgggctggttacacactggactagagagggtaaccagactgacacatattgctgccctcatagagctcatttacatcctagtgaggacagatagatgtaaacagctacagtaggaaagttctgagtcagaaggtgatgaacgtgatggagaaagagaagccagggcctctagcctcaacttccaggaactggaactacagaactacaggaactatagcagacagatgaacgaactacggctgggcgtggtggctcatgcctgtaatcccagcactttgggaggctgaggcgggcacatcacaaggtcaggagttcgagaccagcctggccaacatggagaaacctcgtctctactaataaatataaaaattagccggggatggtggcgggcgcctgtagtcccagctactggggaggctgaggcaggagaatggcatgaacccagaaggtggagcttgcagtgagccgagatcgcgccactgcactccagcctgggcaacagtgtgagactctgtctcaaaaaaaataataataattaccagcaactgatggcttaaaacaatagaggtttattctctcacagctctagaggtcagatgctaaaaccaaggtgttggcggaggccacactctctacagagactctggggaagaatccattctgtgcctcttccaacttcaggcgaccatcggcactccttgactcgtagctgcataactccagcctgtgcctgggagatcacactgcctcctcctctctgtgtgtctgttctccttctcttcctctctcttacaaggacacttgtaatggcatttacgacccacctctaaagtgggcccttctctcaagatctttaacttaattacatcttttgccatattaaggtaatattcacaggttcctgggattaggaagtgaatatatctttggcggaccacttttgtgcctaccttaaggagcaagaaaaatgggacagtactagagggaaatgtagggtacagagaagttttttgtttttgttttttaagatgggaaaagttggcggggtgcagtggctcatgtcggtaatctcagcactttcgggtagaggcaggaggatcgcttgagcccagaagttcaagacctgcctgggcaacatagagagacctcatctctacttaaaaaaaaaaaaaaactagtctcttgtggtggtgtacacctgtagtcccagctacttgggaggctgaggagattgcttcagcctagaaggttgaggctgcagtgagccatgatcatgccactgcactccagcctgagtgacagagtgagaccctatttcaaaaacaacaacaatgacaaaaaaaaaaaaagtttggagatggagtggtaaccaacttggcagagtggaggcagctggcacttaagtgcttaaagataatagaaacgaaaagttaacagttcactctacttatccccaaaaaagttcaggacatggagggaccagatagctcagatggaaggaaaaaggcatagagctgagaacagagaaattatttaggagtctgtatataaagcagttaagcttacaaatcccctccccaaccttttttagctgggcaccaactcccatagcacagcagagggtttactctttggggaaactgaatctgagaagcaccaactcagggacaccaggcacagctgaaggtggagtgagcactgagctgaaaacaagggactgggtaaaaacatatgtaccaagcggtggctccacaaccgtctcccctgaccctgctgctgtaacctctatagcaggggccatgcagatatcccccagacagattggagaattctctgtagaaaccagacggtcccttcagtgagatttacagattctgatatttgggtgtacccagtaaaatatcctgcttgcttcagtcgccacagagtgaagcccatagatcaacaagccccaaattgtgcttccaattgcctctgcttaatgcctcattcttaaatatggacagccgaagatcaaacatttgaggaaaacttccaacaatacacacacaaaaaaaatggagcggggggaagcaggggaggggaactcaggggaaacaataagaaaagcagaagaaaacttaaaaactggaaaaatccttggagagctaagagaacagactcatgaaacaagaacagaaatactatatataaaaaaagaagcacggccgggctcggtggctcacgcctgtaatcccagcactttgggaggccaagatgggtggatcacctgaggtcaggagttcaaaaccagcctgaccaacatggtggaaccccgtttctactaaaaatacaaaaaattagccgggtgtggtgatgcattcctgtaatcccagctcatgcagtgagcacaggaggctaagtcaggagaattgcttgaaccggggaggcggaggttgcagtgagccaagatcacgccattacactccagcctgggtgacagagcaagactccagactccatctcaaaaaaaaaaaaaaaagcaatcaatgaacaagagagttaaaatgtaaaatttcaataagaaagaaagatacagttaataaagttgaaagtggatctcatgaaaatagagatgagattggtggttactggaggccaggaagggtggaggaaataaagacatgttaatgagtagaaatgtacagttagatggaagaaatgggacccagtgttctatagatcagtagggtgactgtagttaacaataatctattgtacatttcaaaatcactagaagagaatgattcgaatgttcctggcataaagaaaagataaatatttaagatgatggatatcccaattgccctgatttgatctttacacattatatgaatgtatcaaaatattacaggtacccccaaaatacgtacatctactatacatcaattgttttaaagttaatgaaattgcccagagaatacaataaaaagagacgggcaaaaggagaaaaaaagataacagctataattcaaggtctaacatcctctagtaaggccagagaaaatggggtgaggatacaggttgagttagggagtggtagcaaacaggtaatttacatagaaaaaaacactatctatagaattaaaagaaaagaacaaaaagacttataaatagcaatacttggaagttagaagatagtgagggaattagccaggcatggtggcacatgtctgtaatcccagctacttgggaggctgagacaggagaatcgcttgagcctgggaggcagaggttgcagtgagccgagattgcgccactgcacactccaacctgggcaacagagcaagactgtctcaaaaaaaaaaaagaaaaaagaaaaagaaagaaagaaagaaagaaaagaaaagaaaagaaaaggaaataatgaaggacataccaacaaacacaatcaccattatggcacgtggcttcttatgttttttctcacttctttcttatctcctctcttgcttttgtcacttgggagcccttcattcttcaggctcctctttcagaaattttgcccacttcagtctgcaccttcttccacaactctcaaaatctaccctttatcctgctgcaattctccatctcatagaccccatttagtgtcagactaaatccttctagcccatcctccatccttttctcaaacatttccctatgagctcccagtcacaccttttctcccaatatccaagtgtcctctgtcaacacattaccaagtcttctctttctcctccatatgttcccacttccctctgaaccagagactcctctttgcttcctttgatcctggcctccgccttcagccccagaagctcttttcctcacttccactctcttttattttaggctcagactctctcctttcctttctcaactttaccccttcagtgtcaataatgttctgtctggctctaatttctcctctgactttcagtacttctcctgtctgcctctttccttctttggtgtcaatccttcatctgcctcattcactggtaccttcacctataatatcttttttttccatagaaacagattcatcagtgatatctttcacttcactcaagatgcccccctcaactcccactcctttctcagtcccttgtagttcctcactccctttgacactttcaaaaggaatttccatctcatcatgagtaaatgccatcactctttcatcgccagtaacttctaccactttttcaatgttcttctcatttatgctccccattcttgaaccctccaatttctccccgctggtccctaacttctcctcactagatctcagcttctccgcacttgaccccagcttctctccactcaacctcagcttctctctgcttgatctcagcttctctccactggttcccagcttctctctgcttgatctcagcttctctccactcaacctcagcttctcatcacttgttcccagcttctctccactcaatctcagcttctctctgcttgatcttagcttctctccactcaacctcagcttctctctgcttgatcttagcttctctccactcaacctcagcttctcatcactggttcccagcttctctccactcaacctcagcttctctctgcttgatctcagcttctctccactcaacctcagcttctctccactcaacctcagcttctcatcactggttcccagcttctctccactcaacctcagcttctctctgattgatctcagcatctctccactcaacctcagcttctcatcactggttcccagcttctctccactagttcccagcttctctccactccatctcagcttctctctacttgatctcaaattctctccacttgatctcagctttctgccactggacctcagcttcactccactggacccctgcttctctcccctgcacaccagcttctcactagtagacctcagcttctctacacttgatctcatcttgtctacactagacctcaaccccttctcatcctgtcccagtttatatccattggatctcaagtcctctccactggtccctaccttctccccagcagacctcaacctctcttcaaacccagaccccttcataggccctgctgtcatccctgcactcttagatttagcctttatttcgtgtttgacctcttgctttccccaaataccccttgggctgtctttccccaaatctgctgaagcttgtgatgcacttgctccacggtatagcagcttcacatccatcctttcctgactcgggcctgacttccctttcaagaccgtcttttccacatcttccagtctccagtactcagactccagcttcggctttcgagtgtttctagtcaggagctccactctcttcccaattaccatgagcccgttccaaggtccccaggttttctctcgcagcatcggcacccccttgcagccccgctccagtggcgaccgttcgcggaccccggcctcgcttggggcgccctggccgcgggacttgtggagctccctagtcctcctaggctgcttaccccgccgctccctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgtgtctgtgtgtgtgtggtctgcctctgtgtgtttctgtgtgtgtctgtgtgtgtatagtctgcatgtgtctgtttctctgtgtgtctgtgtgtatgtcgatgtgcctgcatatgtctgtgtgtgtgtgtatctgtgtatgtctgtatttgtgtctctgtgtgtctgtgtgtctgtgtgtgtctcagtgtgtgtctgtgtctttgtgtgtctctgtgtatctgtgtgtgtgtctgtgtgtctccgtgtctctgtgtgtgtgtgtatggcctgtgtgtgtctgtgtgtgtgcacgtatgcgtccatgtgggtgtttgtgcgtgcatgtctgtgtctgtctctgtgtgtgtctgtgcatgtctgtgtgtgtgtgtctgtgtgtctgtgtctgtgtatggtctgcgtgtgtctttgtgtctgtgtctgtctgtgtgtatggtctgcatgtgtgcatgtatgcatctgtgtgtgtctctgtgtgtatctgtgtgtgcacgcatgtgcctgtgtgtgtctgcgcaggtctgtgtctctttgtgtctgagtgtgtgtctgtctctgtgtctatgtatggtctgcgtgcatctttatgtctgtgtgtgtgtgtctctgtgtgtgtgtatggtctgcgtgtgtctgtgtgtgtgtgtctgtgtatttctgggtctgtgtgtgtgtttgcatgtgtctgtgtgtgtctgtatccgtgtgtctttgtatatctgtgtgtgtctatgtcagtgtgtctgtgtgtgcatctgtgtgtgtctgtgtgcctgtgtatgatctgtgtatgtcgttgtgtgtgtctgtgtgtgtgtttctctgtgcctgtgtgtttgtgtgtgtctgtgtatctgtgtgtgtttctatgtgtgtctgtgtgtgcgtgtgtctgtgtttgtctcgtgtgtctgtgtgtgtgtatgtgcccatgtgtctctgtgtgtatgtgtgtgtctgcgcaagtgagagaaaggagacttgagcaagggagtggggagcctctgtggcacctgtgtgcggactgatgaggatgccaagggaggcagggttttgcctttgtccttacagatggaaagggacccgtcactgtcactcttaccctccccaagaccaactcaggctgtcttgatgggggtaggtgggtagggggtgggaggtgagggcggggaggagggcaggatgttagggattgagcagaggctggcatcctcttctcctttcccaaggcgagagaatcctgttcagccctaatggcttcacttgtgttctgagttcatgtaatgataagaccatttcttccttttgacttccttcagcaaagagttgtcgagcatccacgttgtgccaaggatggttagagcatggagaggtgcacccttttgggagatggaggcatatgcatagtgggccgtggctgaggatgaggatggagcagctgtggtccacctttgaggcccatctccctcaagcagctaccaagcagtgtaggtcagagtagagatactaaggcaggaggaaagaggctggggactaggggacctgctgcaccagttagccagactgcatgtgtttggggtctggggcaaggggagagcctgccttgggagtgtcagagaagccaagaaatgaggagcggggttcaagtggtttagaggggcaagaggggctgagagacacaaagcatggaacagaatggtctgcttcaatgtttatctatgtatgttcatcttcatggttaaaggagttaacatatataaaatgcttagggcatatacatgaaatggttagagtggtgcctagcatattgtaagggccaacataagggttagctattatattattattattgttatattatttttgctgtatgttctgaggatgtgctgagctattgaacagatggatgcaccccccagcctttgcaggagccatactctgaaagttcactaccagtacttatcctctaggttaggtgttgccttctctaagatcttcctttaaatatagagacattaaaagaatatataagcaaaaatataatagaggagaaaatgaaataatataaaatactggccaggcgtggtggctcaagcctgtaatcgcagcactctgggaggccaaagcaggcaaatcacttgaggtcaggaattcaagactagcctggccaacatggtgaaaccccatctctactaaaaatacaaaaaattggccagacgtggtggtgcgcacctgtaatcccaactacttgggagactgagacaggagaatagcttgaacccaggaggcaaaggttgcagtgagccaagatcgcaccattgaactctagcctgggcaacagagcgagaatctgtctcaaaaataaataaataaacccagaggattataaataattatactataaagacacatgcacacgtgtttgttgcagcactatttacaatagcaaagacttggaaccaacccaaatgcccatcaatgatagactggatagagaaaatgtggcacatatacactatggaatattatgtagccataaaaaagaatatcatgtcctttccagggacctggatgaagctggaagccatcattctcagcaaactaatacaggaacataaaaccaaacaccacacgttcttactcataagtgggagttgaacaatgagaacacatggacacagggaggggaacaatacacactgtggcctgtggggggctggggggtaaggggagggacagcattaggacaaatacctaatgcatgtggggcttaaaacctagatgacgggttgataggtgcagcaaaccagtatggcacatgtatacctgtgtaacaaacctgcacattctgtaaatgtatcccagaacttaaagtaaaatttaaaaattaaaataaacaaataaaagaaataatataaaatactatttaaataatccaaaagaggacaagaaagaaagaatacaggaataaaaacagatgggacaaagagaaagcaaaaagcaagatgacaagttggtagcctgctacatcagtaattacaatgattatgaatggactaaattctccaatttaaaaaaatattgtcagattgtattttggaaaaaaaacaactagagtttgttaaaagagacatattttaaatataaggacacagaagggttgacataaatgggtgggagctgggcatagtgatgcacacctgtggtcccagctatgtgggaggcagaggtaggaggattgcttgagctcaggattgtttgaggttacagtgagctgtgattgtgtcactgcactccaacctgggacacagagtaagaccttgtctttaaaacaaaacaaaaccaaaaaagggccaggcacagtggctcacacctgtaatcccagcattttgggaggtcaaggtgggcagatcacttgaggtcaggagttcgagaccagcctggccaacagagcggacccccatctctactaaaaatacaaaaattagctgggcatggtgccacacatctgtaatccccactactcaggaggctgaggcaggagaatggcttgagcccgggagatggaggttccagtgagccaagatctcgccactgtactccatcctgggcaacagggcaagactctctcaaaaaaaaaaaaaaaaaaaacgaagaagaagaagtatattagaaataaagaaggatggctgggtgcggtggctcacgcctgtaatgccagcactttgagaggccaaggtgggtagatcacctgaggtcaggagtttgagaccagcctggccaacatggtgaaaccccgtctctactaaaaatacaaaaattagccaggtgtactggcaggcacctgtaatcccagctactcgggaggctgaggtaggagaatcacttgaacctgggaggcggaggttgcagtgagccaagatcatgccatttcactccagcctgggtgacgggagtgaaactctgtcaaaaaaagaaagaaagaaggaaagaaagaaggaaggaaggaaggaagaaaagaaggaaggaaggaaggaaggagaaataaagagggacattttataatgatgaaagacttgattccacagaaaggtaaaacaatcctaaatttataggcacctaataatatagcatcaaaatatgcaaaataaaagatgacagaactaaaaggagtaataggcaaacctacaattaaatagtaagtaattgtatttattttttagaaatggggtctttttatgttggccaagctggtctccaactcctgagctcaagtgatcctcccacctcagccttccaaagtgctggaattataggcatgagtcaccatgcccagaccagttagaaattctaacacaattctcaacaactgttagaacaagcagacaaaaaaattagtaaggatttagaagatttaaataacatgattaatcaacttgatctaattgacttatgtagagctctatacccaacaactgcagaaaatacattatttcaaatgcacatgaaacatttaccaaaataaatgaaatgttgagctataatgcaagtatcaataaattttaaaagacgaaatcatagattatatactctgacccagaattaatgtggaatcaaaacaaaaacataactagattccaaaatattggaaattaagcaacatgcttctagataactcttaggccaaagaagaaattataatggaaattagaaaatatttttaaatttatgattacaaaaatatgacatatcgaaactcataagatacacagtttccagagggagatttataccaccacatgcatattttagaaaagaagaaagccttgagtatatgacactaaagaaaataagtaattattattattattattatttttgagagggagtctcacttcattgcccaggctggagtgcagtggcataatctcagctcactgcgacttccgcctgccaggtttaagcaattctcctgcctcagtctcccgagtagctgggactacagctgtgccccaccacgcccagctaatttttttgtattttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcatttttttgtatttttagtagagacgatgtttcaccatgttggccaggctggtcttgaactcctgacctcaggtgatccactcgcctcggcctcccaaagtgctgggattatagcatgagccaccgcacaccggctggaaaataagtaactaaaaaaattttttttgtgaaccatgatcacaccactgcactctagcctgggtgacacagtgagaccctgtcccaaaaaaaaaaaaaaaaattatcaagctgaataagcaatatataaaaggataatacttcatgaacaaggccttcttccaggaatgcaaggtggtttaacatttgcaaatcaatcaatgaaattcagcatataaacagataacaaaggccgggcgcggtggctcacgcctgtaatcccagcactttgggaggccgaggtgggcggatcacctgaggtcaggagttcgagaccagcctcaacatggagaaaccccgtctctactaaaaatacaaaattagccgggcatggtagtgcatgcctgtaatcccagctactcaggaggctgaggtaggagaattgcttgaacctgggaggcggaggttgtggtgagccaagatcgcgccagtgcactccagcctgggcaacaagagtgaaactctgtctccaaaaaaataaataaataaataaacagataacaagaacatccatatgattatctcaatcaaaggaaaaagattgataaaaatcaacactctcatcaaattagggatagcggggagctccattaagcttcattaagatacccttgattaaaaaaaatatctaaaatcactttggggttaaatttaaatgcagtccctctgagattaggaacatgtcatcatatcatcacttccacattgtactggaggtcttggcaagtataataaggcagtaaaaagaaataaaggtataaaggttggaaaggaagaactaaaactgtcatcattttagattataggactgtatatgcaggaaatccaaaagaactggccaggaaggtggctcaggcctgtaatctctgcactttgggaggcctaatttaggagatctcttgagcccaggagttcgagaccaacctgggcaacatagtgagaacctatctctacaaaaaaatacaaaaattagccaggcatggtggcagatgcctgtagtcccagctactcaggaggctgaagtgggaggatcccttgagcctgggagttcaaggctgccatgagccaagatggcactaccacactccatcctggatgacagagcaagaccctgtctcaaaaaaaaaaaaagaatctacaaacgattaaattaataagtgagttcagcaagatattttaaaaaattattaaaattaacaagtaaatttgtggggaccaaggtaaatatataaaaatctattatggtttttttttctttctttctttcttttttttctgagatggagtttcactcttgtcacccaggctggagtgcaatggtgcgatcttgtttcaccgccacctctgcctccgggttcaagggattttcctgcctcagcctcctgagtagctgggattacaagcgccccccaccacacctggctaatttttgtatttttagcagagacggggttttaccatgttgaccagcctggtcctcgaactcctgagctcaggtgatccacccgcctcggcctcccaaagtgcatgagccacctcgcctggacttttttttttttttgagacagtgtcctgcactgtcatccaggctggagtgcagtggtatgatggtgtgatcatggctcacagcagcctcgaccttctgggctcaagcgatcctcctgcctcagactcccaagtagctgggactacctgtgtttgccaccacacctggctaatttttgtatttttttgtagacatagggtttcgccatgttgccctggttggccttgaactccttggctcaaatgattctcctgcctcagccttccaaagtgctgggttcacaggcatgagccactatgcccagtctattgtgtttctatatacaattagaagatgaaactttttaaaatataatttaaaaagcaaagaaagggcgcctataatcccagctgcttggggggctgaggcaggagaatcgcttgaacccaggaggcagagattgcagtgagccgagattgcgccatcgcactccagcctgggcaacaagaacaagactctgtctcaaaaaataaaaaataaaataaaataaaaataaaaagcaaagaaaaagagaatcatcaaatacctaggaataaatctcacagaagacatgcaagacctttacacagaaaactacaaaacattaaagaagacctaaataattggaaagatattacctgtttttagattggaagattaaaaattataaattataaaattacaaagagatctagtcttccaagattgatctatatatttgatataatcacaatcaaaatcccagtacatttttgaggggtagaaattaacaagcagaatatctgtagaaatgtaaaggacctataatagccaaaattattttgaaaagaaagaataaagttggaggctttgcactatctgatttcaagtcgcacctgtcaagttacagtaatcaagacagtaagatattatcataaggataaacatttagaccaatggaacacagtagagagtccaaaatttgtcactcttaataggtcaatggatatgtgtacaccaaagcaattcaatagcaaaaggaaaatctttataacaaacagtgctcaaatagctggccacatggcacaatgaatcataacccatacctcacactgcatattcaaaatgaattgaaaatcaccgggcgtggtggatcatgcctgtaattccagcactttaggaggccgaggctcaggtggatcaactgaggtcaggagtttgagaccagactggccaacatggtgaaacactgtctctactaaaaacacaaaaaaattagctgggcctggtggcacacgcctgtaatcccagctacttgggaggctgaggcaagagaatggcatgaacccaggaggcagaggctgcagtgagccaagatcgtgccactgcactccagcctgggtgacaaagcaagactccatctcaagaaattaaaattaggccaggcacggtggctcatggctgtaatcccagcactttgggagaacaagggggggtggatcgcctgaggtcaggagttcgagaccgcctggccaacatagtgaaaccccgtctctactaaaaatacaaaaatgagctgggtgtggtggtgggcgcctgtaatctcagctacttgggaggctgaggcaggagaatcgcttgaacctgggaggcggaggttgcaatgagccgagatccgccattgcactccagcctgagcaacaagagcgaaactccatctcaaaaaaaaaaaaaaaaaaaaaaagaaacactttgggaggccgagaccgggggatcatgaggtcaggagatcgagaccatcctggctaacatggtgaaaccccgtctctactaaaaatacaaaaaattagctgggcgtggtgggcacctgtagtcccagctactagggaggctgaggcaggagaatggcttgaacccaggaggtggagcttgcagtgagccgagattgcgccagtgcactccagcctgggcgacagagcaagactccgtctcaaaaaaaaaaaaaaaagaaaaagaaattaaaattaaaatgaagaaaatgaattgaaaatagatcatagccaggtagggtggctcatgcctgtaatcccagcactttgggaggccaaggagggtagatcacttgaggtcaggagtttgagaccagcctggccaaaagagtgaaaccccatctctactaaaaatacagaaattagccaggcgttgtggcgggcacctgtaattgcagctactcaggaggctgaggcaggagaatcacgaacctgggaggcggaggttgcaatgagccaagatcgtgccactgcacaccagcctgggcaacagagcaagactctgtctcaaaagaaaaagaaaaagaaaaagaaaatggattatagatacaactgcaagagcttaaactgtaacacctctagaaaaataaatagaatatcttcatgaccttggggtaggcaaagttttctttaacaggacacaaaaagccttaaccatagacataaaagactgttatgttgagcttgtaacatttgaaccattaagagtcaaaggcaaactatagactaggaaaagatactgacaaaaggtataatcaacaatgggtttgtctccagcaacagttcctacaaattactgaaaaacagataatctgatctttcaaagaggtggcaggaaagaatcagagacctgaataggcactttacaaaagaagatatgcagatggctgataaatacagaaaatgccgctcaacatcattcctcaccaggtaataccagttacactccccatgcgcaattaccatgcctggactaacagggtgaaagtaaaaaagactaacaattctgagctgtcacagtggtttgtgcccagactgatctatatattcgatgcaatcacaatcaaaatcccagtatgtttttcaggggtagaaatgtaaaggacctataatcacccaaatgattctgaaaaaaaagaataaaggtggaggccttgcactatctgatttccagtctcacctgttagattacagtaatcagtccagtgagatattatcataaggacaaacatagaccaatggaacagagagtccaaagtttatcatacttaataggtcaattgatacgtgtacacaaaagcagctctcagctactccagaggattgcctgagcccagttcaaggccagcctggacaacattagcaggaccccttttctttaaaaaaaaaaaaataataaatagagagagagagagataaaatgactaacgactctgtggcaaagatgtagtacaactggaactttcatacacagtgctgctgggagtgtacattggtttagtcaccttagaaaaccgtttggcagtatttactaaagtgttttaaacatacaatatgtcttccctgtaactaagcaattctcatgcccaacagaaatggggacttaggtcaaaagtcctcaaaagacggctgggcgtggtggctcacatctgtaatcctagcactttgggaggccgaagcgggcagatcacttgaggtcaggagttcaagagcagcctggccaacatggcgaaaccccatctctactaaattacaaaaattagccaggcgtggtggcgggcacctgtatccccagctactcaggaggctgaggcaggagaatcacttgaacctgggaggcggaggttgctgtgagctaagatcacgtcactgcactccagcctgggtgacacagcaagactctgtctcaaaaaaaaaaaaaaaagtcttctaaagacctgtgtaagaatgttcatggaagccagacatggtgctgcacacttgtaatcccagctacttgggaggctgaagtggaaggatggcttgaggccaggagttcaaccagcctgggcagcatagcgagaacacccccctgctttaaaaaaaaaaaaaaaaaaaaaaggctgggtgtggtggctcactcctgtaattccagcactttgggaggccgaggcgggcggatcatgaggtctggagatcgagaccatcctggctaacacagtgaaaccccgtctctactaaaaaatacaaaattagctgggcgtggtggtgtatgactgtaatcccagctactagggaggctgaggcaggagaatggcatgaacccgggaggcggaggttgcagtgagctgagatcgtgccactgcactccagcctgggcaacagagcaagactccatctcaaaaaaaaaaaaaaagtaaccggttgcagtggctcacgcctgtaatcccaacattttggaaggccaaggtgggcggatcacctgaggtcaggagtttgagaccaacctggccaacataatgaaaccccgtttctactaaaaatgcaaaaaattagccaggcatgctggcccatgcttgtaatcccagctactcaggaagctgaggcaggagaatcgcttgaaccaggaggcagaggttgcagtgagccgagatcttgccattacactccagcttggtcaacaagagcaaaactccatctcaaaaaaaaaccaacaaaaaactgttcatggcagctttattcataatagccaaaaacttgaaataatccaaatgaccatcaacagtagatacatacattatgatataatcatgtaatgaaataagacacagcaatgaaaataactgcttctccactcaacaacgtagagagctctctaaagaacaggggcacaaaagaatacacaatgcataattgcatttctgtgaagttcaagaataggcaggccagcataggctgggctcagtggctcacacctgtaatcccagttctatgggaggccaaggtgggtggatcacctgaggtcaggagttcaagaccagcctggccaacatggtgaaaccccgtctctgctaaaatacaaaaattagctggacgtggtggtgggcgtctgtaatcccagctacttgggaggctgaagcaggagaatcccataagcctgagtggtagaggttgcagtgagttgagatcatgtcactgcactccagcctgggcgacagagtgagacttcgtctcaaaaaaaagaataggccaggacgggtgcggtggctcacgcctgtaatcccagcactttggaggccgaggcgggcggatcacctgaggtcaggagttccagaccagcttcaacaaggagaaaccccatctctactaaaaatacaaaattagctgggcgtggtggtgtatgactgtaatcccagctactcgggaggctgaggcaggagaattgcttgaacctggtaggcagaggttgcagtgagctgagatcgtgccattgcactccagcctgggcaacaagagtgaaactctgtctcgaaaaaaaaaaaaaagaatacgccagaataatctatggtgatagaagtcagaatggtggttagttctggggtgggagataattgatgggtgtggggcaagaaggagccttccggagtgtttaaaaaaatgttttttgccaggcacggtggctcacgcctgtaatcccagcactttgggaggccaaggcgggaggatgacctgaggtcaggagttcaagaccagcctgacaaacatggagaaaccccatctctactaaaaatacaaaattagctgggcgtggtggcgggcgcctgtaatcccagctacctgggaggatgaggcaggagaatcgctggaacccgggaggcggaggttgtggtgggctgagattgcaccattgcactccagcctgggcaacaagagtgaaactccatttcaaaaaaaaaaatttagctttagttttttttgttttttttttttagacagtttctcactctgtcacctaggttggagtgcagcggcgagatcctggctcactgcagcctgcacctcccaagctcaatcttcccacctcagccccccccaagtagctggaaccacaggcatgtgccaccacacccagctaatttttaaagtttttttgtggagatgggggtcgaagggtgtctcaccatgttgcccaggctcgtctcaaactcctgggctcaagcaattctcctgcctcagcctctctcccaaagtgctggattacagcacttttaaaaaaaaatttttaaattagctgggcatggtggcacatgcccgtggtccttgctacttggaaggctgagtcaggaggattgtctgagcccagctcatcacggaggctgcggtgagctgtgatggcgccaccaaactccagcctgagtgacagagcaagaccctgtctccaaataaataaataaaatatatatctatcatgatctgagttgggtgatggttacccagctgtatacacatatacaaataattggtgctttacacttaaaatttgtgcactttcctgtatataacttataccttaattaaaaaaacaaaagggggctgggtgcagtggctcacacctgtaatcccagcaccttgggaggccgaggcaggcagatcacttgagctcacaagttcaagaccagtctggccaacatggcaaaaccccgtgtctactaaaaatacaaaaattagctgggagtggtggcgtgtgcctgtaatcccagctactcaggaggctgaggcaagagaattgcttgaacttgggaggcagagtttgcagttagccgagatcacttcactgcactccaacctgggtgacagagcaagatgctatcaaaaaaaaaaaaaaagtgagaaacaatgtagagataaccctgtaaacagtggccagtgacctcagggtcaattccttcatgccggacagccaggaggaggggacagatgcagggatctccatccagggaggagacatcactactgcagatgggccaccatcaagcaaggtcttgcctgtttctggacccacatatcaccaagccccatctcagggaccatctccaaagtgtgccaaaagcagagagaggagagagtgaggaggcctccagattgagaggtgggacaggtgcctgttgtatactggtgagcaatgctgaagggtagagtgattcctaagcctcttcccttccccctaatatcacttggcactatggtgtggacacagtaggtattcaataaatgcatgttgcttccggccctttgggaggctgaggtgggaggattgcttgagcccaggagtttgagaccagcctgggcaacatagcaagactctgtctctaaaaaaaaaaaaaaaagcttggcatggtggtacatgcctgtagtcccagctacccgggaggctaaggcaggaggatcacttgagcccaggagttggaggctgcagtgagctatgatggcaccactgcattacagcctgagtgacagagcgagaccctgtctcaaaaataaataaatacatgttgaatagctcaatgcaagaatgagctagtagcttggtgtcttgtggatcttttcacttgaagaaatacacatgctttgcatgtaagcttttgcctcttggcaccaaaagtagtaaatggaatggttttggcaacccccgcaaaagaggtgggaatgtctcatccaactcacttgaagccctggttaagggatgcctgaggtagccagctggggaaggggtgggcaagtaactgagaaagtgcatggggttgggaattaagaaactgggttttgctgggcacggtggctcatgcctgtaatctcagcactttgggacgccaaggcaggtggatcacttgaggtcaggagtttgagaccagcctgaccaaacatagtgaaaccccgtctctactaaaaatacaaaagttagccaggcatggtggctcatgcctgtggtcccagctactcgggaggctgaggcagcagaatcgcttgaacccgggaggtggaggttgcagtgagctgagatcgcgccactgcactccagcctgggcagtgcaagactccgtctaaaaaaacaaacaaagaaacaacaactgggtttcaatctggcactgtcgctttgcagctgcataaccttggacaagttacttctcctctggttgtctcagcttcaacagctgtaaaatgggaagttttctgcctgcctccaaggatgggagggttaaaatgttttggcagttgcaaaactcaggtcagtgccttatcaggacccctctctggtgacctggggcattgctgaagcagtgctgctgaagagggttctgcaggtggatcagaaagcctgcagggcaaggaagggcaaaggggccatgctcagccaggccagagacctcccctcctccgcagccttcctgtgcatcggtggatctgcagggagacagctccttacaggtggagatttctgacgcagtgagtgagcgggacaaggtgaaattcactgttcaaacaaaggtgaggcagtgcggggcacgaggaaaggtcctggtggctgcccgcaggaggcctcccccagggggtggtaggcatgtgccaacacagcctgtgggcactcttcctccacctggcacttgccctcagcccctcctggaaagtgagcctcttagctctgcctaaggccccgagtcctaatcattcctgtccaccattctaaatgaaatcatgcacacctgagctctaactttgtcctccctgggatgtgggatgaggggggcccaaaagtgcatgcccagacttgctgaggcagggcttggggcagagagaggacctcagttggccttcccgcttccagagctgcctccctcacttcgcccagaccgagttctcagtcgtgcggcagcacgaggagttcatctggctgcatgatgcctacgtggagaatgaggagtacgccggcctcatcgtgaggaggggctgggcaggggctgggagggacaggcagagcacttgggtgaggaccaaaggctgtgatggccgtctcggcagtgagaggcctcccagctccgtccctcctttgagcagatccccccagcccctccgaggccagactttgaggcttcgagggaaaagctacagaaattgggcgagggggacagctctgtcactcgggaagagtttgccaagatgaagcaggagctggaagcgtgagtgccccctcctttccctgccatccccagagtccagatgtcttccccagctatctccccatgaatgtttagcaaccctgacctctgaccccagaaagggggcaggcaggatgatgggggctgaggagggccggtgagctgctgccactctcgcagggagtacctggccatctttaagaagacagttgcgatgcacgaagtctttctgcagcgcctggcggcccaccccaccctgcgtcgagaccacaacttctttgtgtttttggaatatggacaggatgtgagctgggccgaatccctggggtcacccttgggccaggagtctaccttgggtggggaggcacccaggggtggcagggctggagaaggggcccaagtgggcccaatcctgtgtcacagctccgtgagtggcttgcaacttggggtgggaggtgagaacgcccaccccagcatcataccctccctgtgtgcctcagctgagtgtccgggggaagaacaggaaggagctcctcggagggtttctgaggaatattgtgaagtccgcggatgaagccctcatcacgggcatgtcagggctcaaggtaacccctggtgctcctctccggattcaacccagcacctcaagtccacagcacagattgaggcccaggctgggtgtgggaaggaagccactggtggggcctggcctggtttggaaggagattttgccaaccctgggtgcctgtgttgtcaagccccgtggtgacccagtgtaaatggggtcctgcctggctcccttaggaggtggatgacttctttgagcatgagaggaccttcctgttggagtatcacacccgtatccgagatgcctgcctgcgggccgaccgcgtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtgttgccatcttcctaaaatgtctattggaccgcatctcttccctgctcaaggcccttcagagaccctgccccttctggaagctcctaaagtcctgagcttccactttcagcctcttgtgctccagccactgcctccctcccctgctttgcccaagtgccctccctgaactaaagtttccctgaacacatagccgggcttgcacagctgccaagccctcagcgccctctgtccagctcttactcagtccccgagatccagactagatcccacttcctctgtgaagccttccctggcctgcacccctcaacaccagacctgacctggaacagttacctaaggcttctttgctggatatttagatgaagaggtgcctcccaccccttagctgcccctctgacaagctcccttcccagtgcccacctttctgatgcagaagctggagggccgggtggcttccgatgaggacctgaagctgtcagacatgctgaggtactacatgcgtgactcacaggcagccaaggtgagaggcagccccagcgcagcgctcaggcccggatgccaggacagggcagcagtgaccctgtgcccatggtcctaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaaggtgagcccgcagcccccagccccagcctggggccacatgccctgccctgcccggatccccatgcctcttcccctcctctccagagctcatggacttcaagtcccgccgggtctcctcttttcgaaagaatctcattgagctggcagagctggagctcaaacacgccaaggtgagccctcccacctcactgggcccttgtgaagcctcccacctcccacctccctccctcccccaggcaccagggtgtgcgtgcatgtgagggtgtgcacgcatgtatgcgcgtgtgtgtgcatgagaggagccccagctaaggcttggggccatgcttccctggctcaggacccgtgccttctgggtaggaaggcccaattaacagcagctgttattgcagagagcaggggtgtggggagcgagggagcatctaaggtgcagaaagaatggcagcctgactcagggagcaggggacttcaaggacctgtttctcctctgcaggccagcaccctgattctccggaacacccttgttgccctaaagggggagccttagagtagccagagctcagccagaccctaatctgggatctccagtgaccagggtatcccagacccctctctccggcaagatgtctccttccctagcagtgccactagccacaccctcactctgccccacatcctctcagggaaagcccaaaccccctatcaccaccaccacaggtgccaggccctgcaagacacagggcagcatgggcatcataactggccacagtcagcagagccccagggaccctgacacctctccccaggaagctgaggaacagcctctaccctcacccatagccctgaaggaatcatagctcacttgatcccggcctgttctccttcgcaaataaaaaccctggttttgtagcaaggaggcctgttgtccttacttcccttcccacagctcaaaggtccaccaggcacactttctgccaaggcagtatgatcagatcctggagacaccaaggagggcacccctgcagcatcctcagccctctctccagtgacagcaggctccctgtgggaaggcgcgacacccagaagctgggacctaggaaccccagaagtcttccaggtttgcccctacccccataaaccctagcacaaaaatgaatcccaagttctccacacctatttcctaaccagaaaagggatctagcccttcctcccagaaccgctcacaagttcccaggagttatggagccaactgtaacaccaggaggactcttcctcagttcagttgataagggaaatatagatgccacattaccactcccagttcacctcaccctagggccagatttcttgtatgtctttgcctgctgggcaggaaaaagcccaaagtacaggctggaaacagcccttgacaatgctggcaaaaggctcagggtaccggcaacacccttttggttaaacacagggaggcagtgctcaagacaccggggtctgaagtcccgggctccacctggctggccccaccctgaatgcactccagccacatctagaggaggtcaaaggctcaacttggcctgactcacagcagccactgaacctgaccctcataaacttgagtcagccatccagggaagacagcagaccaaacagaacctttgagctacctctgacttgcctatcagcccacacctagaaagggacagaacagaatatcagatggacctcactgtccatccaggcaaggctacagagcacccagttcaggcataaatcacttccgctggaagacccctgtagccagcacccactccttaaacagccagtccagtgtcaatcacagcaccaacagaataatggtgaccatcagaaaggcgtctcagccagtcattggagccagataagggtgtgcaggggctggttgggtgtggagtacagaggagagagatagcaccattatcccagtgcacccccaatcctgaagtctcctgtgtcccaaccttgaaaaacacatcccattaatgagcctttttattattgtcttttttttttttaatcgaaggtcccttactggtcctgcttccatgagtagccgtgaccaggggaaaagggagaggaaccagccggcacagggaggggtcatctccacaacattccatttatacacagaactaaacagacaagcacagagtcactattgcggttagaagttggcagcatgggaagggggaggaccaggtggggaatggggatgttgttaaaaaaaatacaggctcccccacaactggggtgcctggggggaacttggtctgcttcagcccaagaggaatcaaaagatcaaaagcagtttgggaaggccagaaccgtcaagggatggagggagaaggaaaatccagggggtggggggtctgtttggcaactggggtgaagggattgccctccccctgctgggatccccccagcccctccggtctggcaggaagggggcagcctgcaacccccaagggcaggtgtggggctgccagatgctccaggcagggggccagaaggggctcacaaaggcttgccctccagggagatgacggcactgccccccagcttctctgccagggtgcagcggtccttgacctcctcgtagcagtttgcttgcaattcatgcttgatccctataaagaagaaaggggagcatctgtgagcaggaagcactggggtgggggtagtttctgtggctgggaaggagccaatcaaagcagatggaaggaacaagcaggcagcgaagacaagggggcagaccccctctgcgtgccattcaccctgccctgcagccaaggccagagcagaagggcactcagcaccaatgctggcccttacctgtcagcttcttcttgatggcgtccttggagctggcataaatcattttgctcttaaggggcgcagactcgggggccctggacagaaacacgcgtcaggcaactcccagcaacagcaaagccacaggtgactttgagaaacccttgggctggcagtgaggagtcttttgttacaaccccctccccctccaaacccacacatctgggttgaccaggagccacagaagttcccatcatgagaaagggggcaggtgacaggaagaagtgccagaatgagctcaccagaagataaacaccagatcctccttcttgctctccttggtctcataggttgcatcatagagggcatagcggcagtccttatctggcagcatcttgacaaaggtggcgtaggggtcgtcgacagtctggcccacatcgcccaccaggatctccttgccctcctccaggatgatgttcttcttgtcctcactcaggcagaagagcaccgccttcttgcgcttcttcacctcctctggcgttgaagacttacgcaccttcatgtcgttgaacaccttgatgacaccatcagagacagccacaccggaggcctaggagacatgccacgtatacgtcaagaaaaggattctagggaactgccccttgttttttcagaagatctcagtccacgtcccgagtggtcactagtgcccttcccaaggcaagtcactagttttcccacccaagtcactgtcaaagaaccagatgggacacaacctcagaatggcagccatggcctctgatcacctagttcaacaaccccttccctcattttacaggatagaaatgcaaaactcgtgaaaagcagaaccttgaccaaaatgtgaacccagaattaaaagatccaccggctactgactcatttgctactcacagtacttgctctcagcctttggataaaactggtgatttagaacttcggatatggaggacccaaacacctgagccaagactcctcttcagaaagagccaagaccccacaatgctagatgggaccccaaggacaccgaacagttacaacaaacccaccagaactgcttaatacagttactacacaaacgacccctgttcccagctaggctctttcccaaccaagacaagaattgcaacccccattaaggaccctgcccgacaactcccttcttccgggaatggtgctaggccccagaagtcgctgataaaaattaacatgccaaactcaagtgcccagaggcctcgaggtctttaaactcttcctactctgcgtcgtgcttcggggtgcccgagccaggagagggaggggcaatccaaggtaaatctggtcccccaaactccccggaactgcagaagaagccggccacgtgactcggccgcatccggagtgggcggggacaggagatcggctgggcccggccccctcaccaatgcagaaacgcgtatccgagaggcagcagcatctccaggtccctaaccctgtggaatcgccctaaaacaacgggtgtatcagacccatctcctgcaggcaggagcctgggcaagctacataaccttcggttttctcagccctcgggccgtatacagggggcggggtggtttccgggcggtgcccgcctgggtcacttccctaaactcggctccaccctcactcaggcccatccgggaaggcctcgctggcccagggcttcggcaccggcggccgggcctgagcgtgcgcgcacgcgccgacagacagcgccgttccagccctcgcccgatgcacgggtgagaacgcagctcgttagatgcgctcccgaacgggccgcggtctctgcgatgccccctccaagccttgcggtgcaaggccttaatcgcaggcacccacgccccaaccgggaccccgtcttcccagcatcacccctcgccgcgccagcacccgcccctcccgggcgcaggcatccctgccacctgctcccgagacggacccggctgccgagggagggtgacgcgcagacaggaacagccttgggtggggcgcgcgcgccgagacctctcgcgcgctttttcctcgccgcccccgggccgggtttggacgccgcatgctccagtcgagagcgcgcccctaagaagaaaggcgcgacgccggccgttccgcgaggggcgccccagcgcgcgccccgaacccctccccccgcggccggtgtccgcgcgggcgcaccagcgggtgggggaggggagcccaggcggagcgcgagcgacgtccagaccggccctccccggcgcccacgggcgcgcacgcgcattccggcaccgcccgccccttcgtgcgagaccctcatcccgcccggggcgctgggggagggggtgcggacgtcgctccccagtcgcttcccgcgcgcaggcgaccgacccgcagccgcctccctcaggcgccgtggcctgccgctcaccatgtttccggaaacgaaaaggagagggcaccgagagccgcagaagacgagagcgctgcagccgctgccgggacccgactgaacgcggcctctcccggccccttccgtttagtaggagccgcacaatgaggggtggggcgggcttccggcgctcccaccgcgagccgacgggaaatggagtccgctggccctgcgccgccgcctcgctcgctgggtaacggagtcttcccgccggccggctccgagctgcagtgcatgtagggaaatgtaggcccaggtcctgggcggcaccgcagcgcgcagcgcgagcccattggtccaatttcccaggaaccgctctgagcccggcgaggcggcgctcagtaaaatgacccgaaaacgatccccgactaagcggctctttatcccacagcaaaacggctttcttaagacccatctggtattatctggatcccttggcctgaaatttttgagtgaggttagggttttgcatttctgaatcgaagcaactattgattagcctggaatcccgacctaaagcaaaggaaatcacaagtatgaaggcgtcgtcagtcggataaacactagtactctgcatgtgtaaagccactctcgtctcctgaaaaaaggccatgtccaacgtcagtaaaacaagaataggaggaaaaggcacaggggaaaggtacaaggaaatctctgagagctttgttcttgtttaaagatgtttggcaaagtcatgaggcgttaaagggtaaagacgagggtttgtgcattcaattcaaggcttctttacatgcctttacgtgccaatgagaagaaatagatattaaaccagacttgaacccagctctcgagttgatagccaggtacatggttattctaacatccgcaaaactgagacaagttctgtggtagtatatgccttaaaaaaaaaaagaaacgagcgggggactccgggatgattttgttgttctagaacagtgaccacagcctcacactctgcaggaaaagactgggtcgcaaacaagtcagaggcaaacccagaaagggaactgggggccctaatcctataaacggaattaagggtgtaaacggagagcgatgcctgggagtggggtaccttgcagagcataccgggggttgtagtcggggacattccacagcaccgcccccgcccggactcccggcgctccaggtggagacagcagcttgaccccgcctcccgcgagcgaccctacatgaatatgaggctagcgcccccttttctgagccttagagtttccaagagcaacggggagagagaggggggcttcgcagttaccctggagacgcgctctcgcccgcccccagccgcgggatgccctagatgtccttattaggacaagagactcgagggggcggggccagcccgacagccggcttgaggctccttataaggccgcggcgggcgggaggcgggagccggagcccattggtccaatttagcttggctggggctactgcgccgtgggctaggcacagtcctgaggggcgggactggagctctggcgcccacctctcccttcctcgcaggctggagacctgcgtgttgcgacttccggcatagcagctagaggccgggtgctgcttcaaaccctggcgggtcgcctgtgtccaactcagctatacgtgtctttcaggcttctcaggttgaagccctttgtagggtttccatcttcaacctccctgagggtctcccacttccgattagccacaaaaatgacgaagtgttctcccctctacctgtgtctgggcttcttaacccgcagcctgctcctccgctcccaaacccaaccgcgtgcccatctcaggcctccccaactgccaggatgcccaagcacctcttacttacagtcctccttcctctaggcctctgacccccgacattccgagttctattttgggccttctcggcacgtccccgacttcctctccaccacacactctttgccctgtatcccggggatgaggatcaccatttcctccaagggtcctgcagctcctcctgccttacctttgtgtcctcatccccggcacccatttctgggtgtccctcccaccaatacgtttgcacccgtttgtctcctagcccccgcctctcctggactcttttcaagaccagtctccatctccagcctccttcaagcttgaggctgaagctgacaatcttaagagaccttagagccgccaagctcaggttagtccgttaagcgccgcccagccagtcctccccgtcacagggggcgctgtccgccttcctctcgcctacacaaagaccccgctctcgaatctggggtgacaggaaggagccggtccaggctccgggggctgggaaagggcgcgtctcaaaggctggctggagtggagccaagggaaaagatcgttagagacagcgcccctgaccaaccacttagagcagcgcaggggtgggagggcggccgcaggctctcctctcgttagtgccccctgtgtttggggccccgtgatctcaacggtcctgccctcggtctccctcttcccccgccccgccctgggccaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggtgggtcctggcgtggcccgatgggaaaagctgctggccaggtcaggcctgccctgaccaggtaccctacccctgcccggccaggcgctgcgttccctccgacggtacccactgccgctgcgcagcgggaaggaagctaagatcctacagcacttcggagacgggctctgccggatgctggacgagcggctgcagcggcaccgaacatcgggcggtgagcgcctcggaaaggggtcggtgatcccccacctcccccaggtggagcctccgtactctcctgggagcccttggcttttaagctccccactcctgtcccagttgccgttcggcctagggctagtggctggcgctccctgagcctccctcaccggtctcacgtaaccatctgagtaggttgcatcccagatcctcgcagctgccggattcgtggagtgtggagttaactcttttctctcccgcaggtgaccatgccccggactcaccatctggagagaacagtccagccccgcaggggcgacttgcggaagtccaggactcttccatgccagtgaggaaggggcaaggggagtggaaggcaaagtgggagtgcgggagtatgattttctggcttgggggatttggcaagcctgagtccaaatctcaccagtgatgcctggccttgagcaaatgacttatcctcttttcgacttagtattttaacctgtgaatagaaatattggtaacagccaatgagagaattccatgatcaagctacttaaggatcccagctcagttagttacggggtcaccattattgagttttcctgtctaattacacctgtcctgcagcgcatggtagaagtgaggccaggctgggcagacacccccacccactgccccgaaactgcctgctgttttatcccagatttgcagcggatcatcccatcacctggcccattttacagagaaggaaactgagagacaactgagtgacttacccagggccacaaagcctgctggggacttattcaaagatgactggctggctttcatgttcagaactcctctgtacctttcaggttcctgcccagcccaaagcgggaggctctggcagctactggccagctcggcactcaggagcccgagtgatactgctggtgctctaccgggagcacctggtgagcactgggctacaccgggaggcggaaccatggcagtggggtgggaggttccccgaggggcctggcccaggcagggcaggcaaagattatcccagccacctgagcgggatgaggaggggccctggcactgagcctaccctgtcttttctaccttggtttcagaatcctaatggtcaccacttcttaaccaaggaggagctgctgcagaggtgtgctcagaagtcccccagggtgagcacagggatcagggaggacaggcccaagtggctctggggcccaccaaagactgccttttcttgcagtgggcccatgtgtggcccatggctggggacacagggaacatggacttgtggtggtaccaggtgctctctgagggtctcttttctgatccacaggtagcccctgggagtgctcgaccctggccagccctccgctccctccttcacaggaacctggtcctcaggacacaccagccagccaggtggggccaactgcaggagatacaggagagcatgagtgaacttcttagtagggccttagagtcacccaacaactcccagagctgatgctgttgagattggggggggtgggcctttcctcaggagcccccactgttggaatacctggagggtgtgaaaccgcagcagcgggggtgggagggtgcggtggttattggaggaggagaaagccttttcagaggagatagcatttgacacgttttaggatttggcgggtagagatgcaggataagtattccgaggaggaggaaacagcattagtgaagacaggaggaaggaaattgtctgagacacacttcttgcagacctgagaatggcgctgagcaggcccaaggaactgctctaagagccaagaagaccaggaggagcaggagccactggggtcatttgtgcagggcgccaagggggtggtgaggccagcccagctgggggcaggcaggaaagcctgccaggaatgagtgaagaaggtagagctgtgttgtcccctctgcctcccaggtactcattgaccccagagggcctggagctggcccagaagttggccgagtcagaaggcctgagcttgctgaatgtgggcatcgggcccaaggagccccctggggaggagacagcagtgccaggagcagcttcagcagagctgtgaggaggagggcagaggagtggggaaaacagggaggaggggatgggaaatgaggccaaagccccgccccaacccatcacctgcagctgaactgtggctgcctccctactgtgggtgggtggtgggtgtcgggtggcatgggtgtggggcaactgccctggcacaaggggttctggcctcacataccaacaccccccacttagtgccagtgaagcaggggtccagcagcagccactggagctgaggcctggagagtacagggtgctgttgtgtgtggacattggcgagacccgggggtgagtgaggtggggagaaacgagggagatgatcagaggaggctggggggtaggcactgccctgctctgatctaggcttccctccttgccactccaggggcgggcacaggccggagctgctccgagagctacagcggctgcacgtgacccacacggtgcgcaagctgcacgttggagattttgtgtgggtggcccaggagaccaatcctagagacccaggtgaagggccgtggacaggctggcaccaggggcagggcctggtgggtaggggatcgcaagctaacggctggcttgtcagcagcaaaccctggggagttggtactggatcacattgtggagcgcaagcgactggatgacctttgcagcagcatcatcgacggccgcttccgggagcagaaggtaattttgctggctttgccaggcttccctgcctgctccgaagccccgttttcagcccagagcaatccaggggcacttctggcagcctccttgaggcagagccctttggaatccagccacacccaccctgtggctgctccaggatcagacccccacaggcccatccaggcgcacagtaggaagccaggtacctgcattcttgggctgaggtcaggagcattttaaagacctcttgggtacccagcccctgcagtcttggataaacaaggcataaacctccaggagtggaaatacagaggctgtaccttggtacttgctgctgggtggacccctagtcacagaggccatgtgccggcccaggggaggcttgaaggatgggcagtgttgagagatggagaaaaggctttctagacaagagtgtcagcatgagcaaagctgcggaggcccctgtgaggcaggtggagaggctagggaggatgcagaggctaactggtgggaacagggtcccggcaccattttgagtgtgacatcatggatgcccaggcatgtggtcatccagcctgaccctccctgtccactctgtacacttccctagttccggctgaagcgctgtggtctggagcgccgggtatacctggtggaagagcatggttccgtccacaacctcagccttcctgagagcacactgctgcaggctgtcaccaacactcaggtgagctgggagggcagggccaggcaggcaggcaggggcccctgtggtccatggttcatggtctaggccaggagccaccttccctctcttgggtcctcttccccaggtcattgatggcttttttgtgaagcgcacagcagacattaaggagtcagccgcctacctggccctcttgacgcggggcctgcagagactctaccaggtgagcagaggcccctttcccagtgtcgggacagagcccacaaggaattcaccttgcctgggccctgtgcatccccaaaagaagcaaggtgggtgagatccccatttctcaggctggccccccaaggctgaggactgggcaggggctggctggagttgttccttcgagctccagcctggcctcagtcccttcttccctcagggccacaccctacgcagccgcccctggggaacccctgggaaccctgaatcaggggccatgacctctccaaaccctctctgctcactcctcaccttcagtgacttcaacgcaggagccatcaagaataaggtactgtctctgcctagcttctcagacatggcctggcccagacccccactgatccagccctttcccgaacccaggcccagtcggtgcgagaagtgtttgcccggcagctgatgcaggtgcgcggagtgagtggggagaaggcagcagccctggtggatcgatacagcacccctgccaggtaggccctaaagggcccttaggtgtcctcagcccctgccctccatgcatggaattcaccttaatccatgcttcgtggagggggcctggccttgtgtgggctctgcagaccagagatagacagatcccagggtgctcgtggaggtcaagtggggaggaagccagcaggcccacatagtgtcccaggtagtggaggccacaggagggagggagacgtcccacctggtggagaagaggcttcctggagaaggggttgggccattaaggggagtgagggtgaaggtttggagcctttgctggttttgccccagagttcccacagggagggaggacagcccggctggcatggggccttgagtgccaagctcaggaagtggggcagtgtcccaactcttccatcccatgctgacccctctgcctggcccctcatggtgctggcccagagtgggccactgtcagcctcagaaactcaaacccctgccccccagcctcctggccgcctatgatgcctgtgccacccccaaggaacaagagacactgctgagcaccattaagtgtgggcgtctacagaggtgagggcaagagacggaacctggagggagtggcagggactggggctgccctaggcccagggcgtgaccctcgctgcctctcttcctgcaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaaccactaacagtccagttgcctcgttttatagaaaaacaggcccagggaactactagggcttatccaaatgtacagtttgaggcagagttaggaatggaacccagggcctcctggcgctgtccagagtggagtttcttaggacccctgcaagccagccaagtccaaatctctgggccggggcctggagtccgccctcctcgttacctcctctcctctcggggtgactgaagctcgtggtgcagagctcccagctcctgtcaatgggggcccctgggcctgaacatatagagacccccatttaggtgaacttggcctgcccccccaagtgccaccctgccccagcctgaggcttcctgcagtgtgacccgcccacctcagccaccaggactttctttctccctttattgcctttctcattctgcccctcacaacaggctcctcagctagggtagctgcagggagggtggctccctcctgctcctcagaaggtgtaggcccctacaaagacggtgagcctcagtacagagctggcccggtagctcatgagggaattcatggtgaccatctccaggtccagcacgtactcccgggggcccgtcaccggccgggcgaggaccagcatggcgctgacgttgttgatttgctgcagggcagtgggtggggggacatatatattgtgtcagcctgtgtgctaggcccctgccccagcgtcacctccctgccccgtggccgtgaggcagaggaacagccctggccaggctgccaccccagcctctcatgcagctctttgacaccctcgatgtctctcctccccacccaggctcctgccctcagaaatctcctgctggggctcttctcaccctctccagcctgctctgtctgacccaggctaactgacgattcaaggccacatgtggctcttgggactggtgggacctttggtgacccaaagtgagcagactcccttcagagcattcaatttcaaaaagaaagagaagggctggtactagacaaaccccttctcctgctgagacccatgcatgcggctgccagtcactgtgagcagctcactgtgagccgcccctggccccctcccacctaacagatccactagcaaggagtggactttctgaccccagggccctgcacacgccattcccttggtttgtgggtgaagaaactgagatcaatatggaaaaccagtaccaggactcaaactcccgtgtccgagtgcttcgttagaattgcatttaaccgttagaattgcatttagagtacccccgtcttcctgcagaaaccccgcctccgggggcggggctttgggggaggggtggggcatagcagcctggccgagttcccccttaaggcgtcctggagttcagttttagattgtgcatgtcagttgagggttgcagaaaccttaccctaatgtaaaagtccccctgcgagtttccagcacggatctgaaaggcattgtaggcaccggggtagacggaggtcgcctggatctggaacacgtcagcgggcacgctccgctccgaggtgatggtcatgtagcggtgcacaatggatgaaggctgctctcgacatagagggttggaggccgggcagagacagcggctagagaccccgaggtgggggacacaaatgagctccttgcccgtccccccaatttctcctaccctacaaagggagggaatcccaaaaggacccttctacccctgtgactggttttcatgaaggactatgattcccatcatccctcaggggcactcgctggtctgaatagatgccagtcagccccaaagccccctgggagacgtagtttctgtgggggcctggcatcgaattgactcacttctcagagacctggatgtagggctccacgcagcggttggtgtccacgcagcggtagcccccatggaagttgacacaggtttgggcctcggagcactggtgcgcaccagactcacactcatcaatgtctgtgccaggggagaggggctggaatcgggggcgtcaggctgccagctcctgacaccgtcctgcccatcccacccgggcaacctgtaccttggcagaggcgtgtggccagcagctggtaaccctgtgggcagtggcaggagaaacggcctggctcgttgatgcagcggtactgacagaggtagctggagtagctacactcatcaatatctgaggaagcatggggatggggaccccgggtcaagggcattcctcaccattcagtcccacaaacatttcccaagaaggcccagccccatgttagactgaatgtaggaagacagagggggatgagacaagccacaagttcagccgggagatggagggttcaaagaaagtttgcccaggctgccgcagctcacagacttctctctgcccagaactggaagaaacactaaataagttactgggaatctagaggcttgggtgtgaatcccaccagctgatctaggggaatctcattttcccaatcagtaaaatgagtgtgttagactagatgagtcttatgggtctggcttgtgctgtaacgcccaattcctgcaacccacagtcaacctgagcacccagtggtcacctccaactaactgtgagcttcacaggcagaacatttcctttctcttgttcccctcatgctgccaggtagcagtgaggcctcatcccgcagcaaagcataacatagggggtacatgccagtttacagggtgtaagaagtctgggatccagccctggccccatctcatcctggctgtatgagcttgggcgggtcacttaacctctcttagctgaatcatgaaagtcaccatttacccaggactttgtgattatttttatgtaatcctcccaacaaacgtggagggagatatgaatgtcctcattttgtagaggaaggagaaaatcatacctcctaggattcttgagaggaaggaggccaagtgtgtcagggaatacactacgagggcaggttctcattaagtggcagttcattcactttaaagcactgcagcttgagacttgctggagcccatctatcacactctcacctaatcctcaagacaacccattttatagaagaagaaacaggctcagagaggagtgacttgtcctagtgcaaaattcaaatgcaggtaaatgcaggtgagcctgatatgtgggacaggtggcacccacatcctcagtctcaccagtaggcttcagtaaggacgtagctgcctctccttgtgcctcccccactagcctgggagtgctccacagccagccggggtcgagtacccaggaggcagctgggtgcacagtgacaggaggcggaggcctcaaatggagaactgtgtggcaggaggcacggcatagctagggcctgggggtccacagaggagtacacagcagggatggagctctcaccactgcaggagaagccatcccgatgcagctcatagccctggtggcagcgacacaggaaggtcccataggagttgaagcagcgctgctcgcatggggcccccatgtcacactcgttcacatctgggggtgccaggaaaaacaggagggatgaaagcggaggaggagcccagagcctccactctacctgggctggtcaagaagggagcgcccccacctcacacctccctgcccaggacccaggagcctggcccagcccagcctcaccaacacaggagcggttgttaggccccagctggaagcccggctcgcactggcagcggaaggagccaggcaggttcacgcagcggtgctggcagtagcggtagcggcactcgtctatgtctagggatagaggcaggagaaggagggcggagggcagagggcagagggcaggtgggctcgagccggctgggactcaaggcttcaccacccataatcctgtgtccgaggagctgaattaggcagggtcagccaggacacctcccaaacactccccgctacagtcctctgtgtctgatgacggagggtgaggtggcaggggccgggggtgaagcctggcttgaatgggggtcaggtgctagggcaagggccagaccagggacacaaagccgggactacagaagctgcttcctggactcacccacacactcgggcccgatcttgcggtaaccatcagggcaggtgcactgataggagccaggcaagttatggcagtcctggctggggcgacagtcgtgcagggcctgggcacactcgtccacatctgcgagagacaccactcagcccctgcctgggatcccgcacaccacccaacatgacagatagttccaacacttgtattcggttctctcaacagcacgcgtaagagttcaccagcctggagccatcaggaaaggcacccctaacctctaaaaccacatgttgggggttgcacaggaaataaggtcctgtccaaacatccccagcaacactgattcctggactgtccttcctccaaggcctgtggctcccaggggacagacactggaaggcagacttcctgcagtgtctctgcagcaaccgaggggaggggcccggagctggctggagcagtggcacacaagctggggccacctgcggcaggtcctaaacaacatgagtgtctggatgagggtgtggacatcaccagtggcccttttgagctggggaggaacatgaggtctgagtttaagacgcctggtgagaggactggaagccaggcaccagagcagtccccactcacccacacagctgtcctgatcgtcgggctcatagcctggtgggcaggggttggggtgttgagcgggaggcactggtggcgggggtccctcgccgtgtaggtcgttgatgacggcagcggagcggggcaggcacaagtagcccccgtagtggttgatgcacttcatttcccccttgcaggcctcagggatggtcagacactcgttgacatctgcagagaggggcctgctgggcacagccagtctcctgggctggccctggagggagcggaggcaggaacccagctcggccttctctgagatgtgtggccccagcaaagccttcccactctgctcaacaagctaagtctgcctgctcaggacccctccccagggttggccaaggctggagatggggcagctgttcccactgttgccctcattctcggcctgcaagtgggtctctatccctccccacggccctagccctagctcagcccaagatggggggcctccttacccacccctggggacgctaccctcccaggttgtgatgagacaaagagctgggacaggagagtggttcagagaaggcgtacaggatccagctcctctgaggggtagggacaaggtttcctgggtttctgggagaggatgaggccacccctagctcaactggcctccagagagccagagctggcctctgtgtagcagagctgggcatagaacgggctgctgggctcccacggcagttcttggaggtggggctgtcccttggaaagcagctatcaatccctttccgggttcctgggggtgtttggtcccccaggcacacacaccccggcagtgctggctgtctgggtcccactcatagccatctgtgcattcctggaagggaaccagaagtggccagtggtcaccctaagatctcctccaactggccaggccaagactagggcctgagcctggccaccctccggcctgctccaaacaatggcccccagctctccaccagccaggggaggaagacttccccggcagcagtcaccctgggtcccggtctcttcctccctacccttcctgtcccaggccagcggccctcactgtccccaccgtgtagctgtcgggctcttcagaatcctgaggagaagctgatcccaagagcaacagtagcagcgcccagagcagtagagacccgggtaggcaggaggcgcaggggagcatcctggggctgcgagatggtggacacgggtcaggggcctctgcccgcggcacctcaactccctgtaccgggagcccgagcccagcccccgccactgcccgctcaggaccgtgcttgggcctcggggcctcccagggctgggggccgactcctcacaggcccaggtcccaggcccgggtcccaggcccacccgccccggccaccccgcccccgccccgcgcccctgcggcgaaggccgaggagcgcgggcctctgtgggcgctacgctgccgcggactcggccgagactccggcccacgccctcccccacggacggtcacagccactcacttgggcccgcgacacccccgcggcccgcggctctggcggctcggctggctcgggcaatgcctgcgggcagacggacgggcggacggcacagctccctggacgcgcggccccaggaagcgccccccgcccgcccgcctgccgcggcgcggcccaccccggcgcctccgcccgcccttcggcggattcctgagccagcgccagggggagggaccccgaccccccgcttctccgcccccggccagccacaggcccctacccggtcccccgcggcgccgccaggagccgcctcccggcgccggaccagggtcccccagtgctcgatcctggggccccgaccttgatgccaggcccccagactcacccgggggcccccagacgctcaccaaaaatgtcatcctgctcacctaggtcctacctaatctgcgcccccagaatttcatcctgtgcacccacaccgtaatcctggagcccccagattctcattgtgcgcctcccgagatcgtcctgggtacctagagcccacctaacccagtcctccagaccctcaatctgctccctgcaaaattttattctctgccccagaccgtcattgtaaaagatcctaaaacttcatccagggtccccagaccctcgcccaggaacgagaggctcccaggagcagaactgtccttctcgctccctcctgccctccacccccaggaccgtcttcagccgggtggtcctttcactacacacggcctcccccacaccctccatccacaaagctacaagtttgggggcgagggcggcagttcccttttggcacaaaatgaatggaagcccctgagaaggagggcagggctgatgtcggacgtgcgggatgccagagtcgggtgccaaggcgcctcctcgacctcctcgcaccagcgtcccccgcccggtttccgcctccgcccgaagtgggggcgtgtccttggggcggagtatgggcggggctggctcccaggaagggcgtggcctctgtttgcccacgtctttgggcggggccaggcgggaaagcactgcgtgtccggggatcccccgcctggggcccgcccttcctttccccttgccatccctgcttatccccgcagtcgccctccacgtgaccccggggagggagtctgccgaggaggggacgtgctggtgggtcccgcggcgagcgcctggggctcaggtgaactgcgcagtgcccgctcctcgccactctgccaccaccatccctcccagctgctggggcagaaggttaaataatagctctttaggggccggacgcggtggctcaagcctgtaatcccagcactttgagaggccgaggcaggtggatcacctgaggtcaggagttcgagaccagtctggacaacatggtgaaaccccgtctctactaaaaatataaaaattagccaggcgtggtggcgcgtgcctgtagtcgcagctactcaggagcctgaggcaggagaatcacctgaactcgggaggtggaggttgcagagagcccagatcacactgctgcactccatgggtgacagagggagactccatcttaaaataataataataataataggcccgacgcggtggctcacgcctgtaaccccaacactttgggaggccaaggtgggcagatcacaaggtcaggagttcaagaccagcctggccaacatggtgaaaccctgtctttacaaaaacacaaagaaattagctggtgtagtggcacgtgcctctaatcccagctactcgggagtctgaggcagaataatctcttaaacccgggaggcagttgttgcaatgagccgagattgtgccattgcactccagcctgggcgacagagcgagactccatctcaaaaatagtaataataataatagctctttaaaacgagaaagacagtaacaagtgttggcaaagatacggagaaactggagccctcatgcactgttggtggacaatggtctggcagttcctcaaaatgttatcacatgacctgacaatttcactcctaggtatacatacctaggataattgaaaagatatgtacacacacacaaatctgtacgcagcgtttatagctgcactatatataagagccaaatgcagaaacaacacaaaagccgtcaactgatgaataacaagatgcagtacatccacacagtcgaacattattcagccataaaaactaatgaagtactgatgcatgccacaatataggtgaattcttttttttttttttttttttaattgagacggagtcttgctctgtcgcccaggctggagtgcagtggcgccatctcggctcactgccagctccgcttcctgggttcacgccattctcctgcctcagcctcctgagtagctgggactacaggcacccgccaccaggcccggctaattttttgtatttttagtagagatggggtttcaccgtgttagccaggatggtctcaatctcctgaccttgtgatccgcctaccttggcctcccaaagtgctgggattacaggcgtgagccaccgcgcccggccaatataggtgaattcttgaaactactatgtgaagtgaaagaagccagacacaaaaagccacatattccatttattttttattttttttagatggagtttcgctcttgttgcccaggctggagtgcaatggcatgatctcagctcaccacaatctctgcctcctgggttcaagcaattctcctacctcaggctccggaatggctgggattacaggtgcctgccaccacacctggctaattttgtatttttagccgagatggggtttcaccatattggtcaggctggtctcgaactcccgacctcaggtgatccacccaccctggcctcccaaagtgcttggattacaggcgtgagccaccgtgcctggcccacgtattccatttatatgaaataaccagaataggcaaacccagaaaaacagaaagtagattaatggttgccagaggaaggtggggaatggggagtgtctgctaatggggtctgggttttctttgggataatgaaaatattctaacactagatagtagtgatggtcacacaactatgcaaacatacaaaaacccactgaattgtacacttcaaaaaagtgaattttctttgggaggccgaggcgggtggatcatgaggttaggagatcaagaccatcctggctaagacagtgaaaccccatctctactaaacaaattagcctggcgtggtggcaggcgcctgtagtcccagctaatcgggaggctgaggctggagaacggcgtgaacctgggaggtggagcttgcagtgagccgagatcgcgccactgcactccagcctggacgacaaagtgagactctgtctcaaaaaaaaaaatgtgagttttatagtatgtaataataccacaataggccaggcacggtggctcacgcccgtaatcccagcactttaggaggccaaggtgggtggatcacctaaggtcaggaattccagaccaacttggccaacatgacaaaaccccatctctactaaaaacacaaaaattagcgggctatgggggcgaacgcctgtagtcccagctactcaggaggctgaggcaggagaatcacttgaaccggagaggtggagtttgcagtaagccaagatcgtgccactgcactccagcctgggcaacagagcaagactctgtctcaaaaaaaggaaatataaaaaaaggcaggaaaggggtgctgctatcaccccatttcacagatagggaggctgagagacttgtcccaggtgaaggatgggacttgcactcatgtcccacggacttcaagactcgctgggctccttgccccatattagagcattaaggacccgccctgcaaacacccactctgtgccagccacagtggtgggtgctccactaagtatcttccactcaagcctcagcctgagaattgtcattgccaattagagatgaagacatgaggcccaggggggatgacttagtgcacagctggtgcacaacctagacctgaacctccatctttgcactatccagcccgagtgagccttccacttggagttgcctcctcagaatgcctccctcgtcctctgcacccccagtgactttccctgccttcgcctgctctgcactgggtccctttcaaggtcccagacaccactggatcagtgtctccctcctaccaagcagggagctcctctcaggcagtgaggcccctgtgcccatggcccagcccttactgggtaccagctgggatctgcagagtaggcagttgaatgaacaaatgagtgagtgggtggaggaagttcattgattcactcaacaaatgttttctcggccgggtgcagtggctcacgcctgtaatcccagcactttgggaggccaaggcaggtggattgcttgaggtcaggagtttgagaccagcctgaccaacatggtgaaaccctgtctctactaaaaatacaaaaagattaccccagcatggtggtgcacacctgtagccctagttacttgggaggctgaggcaggagaattgctggaacccgggaggcagaggttgcggtgagccgagatcgtgacactgcactccaggctgggcgacagagtgagactctgtctcaaaaaaacaaagcaaaacaaaacaaacaatgtttactgagtggccactgtgaagcagatgctgtggtgctagccagggacacagcactgaccaaaaacagacccaaacctcctggcctcaggagctctagttcaagggaagggaggagaggatcaaagggaaggccactgggccccacacctccagttccttttccccgtggcctcccacatcccctaccatcacaagaggcccacactgggacctccacctctgagggctgacatggagccttaactatcagtcacacacaggacaagactggctggggcccataactgggctctagaaccacagggccaggcaccactctggggatggtctgtccactgcatttcaataaaggcagcagcatgcttttcagatagagaagccccttggtttactctctgggcagggtgacaaagtgtggcctcacgactctgggaggaatcctaataaagaaacatggtaggccgggcgtggtggctcacgcctgtaatcccagcactttgggaggccgaggcgagcggatcacgaggtcaagagatcaagaccatcctggctaacatggtgaaaccctgtctctactaaaaaatacaaaaaattagccgggcgtggtggcgggtgcctgtagtcccagctactcgggaggccgaggcaggagaatggcgtgaacccaggaggtggaggttccagtgagccgagatcgcaccactgcactccagcctgggcgacagagcgagactccgtctcaaaaaaacaaacaaaaaaaagaaacgcagtagtgagcatgtaagtgaataaatcccaggattatagctgtcctgtctcccaccccatggaaccctagaaagccagctcttcacacccttctctggtcttggtcaccagttctcagcctgaactcctataggggaggtccccagcccaaggacccacttagaacaaaggcagcagtaacgggtgttaatgctgctgcccagcccttgacctcacaagtcaggctttggcctccctccgtctgtgatgctcaccctgttatccttctggctcttcagccccctcatcctcatccctagaccgtgggagggatgaggaacgggaggcactggctgcagttgctgctcccggactctgactctgcgctttcctgttttgttttgttttttgagatggagtttcacttttgttgcccaggctggagtgtaatggtgcgatctcggctcactgcaacctccacctctcaggttcaagtgattcttgtgcctcagcctcccgagtaactgggattataggcgcccgccaccatgcccagctgcttttttgtatttttagtagagacagggtttcaccatgttggccaggctggtctccaactcctgacctcaggtgatccacccgcctcggcctcccaaagtgctgggattacaagcgtgagccaccgtgcctggcctggttttgtttttttgacacaggatcttggacccacgctggagtgcagaggcatgatcatagctcactgcagccttaatcttccaggctcaagcaatcccactggcctcagcctccccagtagctgggactacaggagagcaccaccatgcttggctaacttttttttttttaagtagagatgaagccttgctcagttgtccaagtttgtctccaactcctgagctcaaatgattctcctaccttggcctcccaaagtgatgagattacaggcatgagccattatgcccggcctgctttcctgtttaaaactcatgatgatcaattgttcagtcaacaaacacctagcgagcctgactcatgcctagccctatcctgggaaccgaggacaccgaggacacaagcgaactgaacacttctggtgtggttggaggcagatgcccaatgggcacaggtgcagctgggctgaaggggctgcaaagcttctaccagaggttggggaagcagggaaggcttcttgaaagaggcggccattgagctgactgagcttcataggatgagcaagagtggttcccttggctgggcgcagtggctcatgcctgttatcccagcactttgggaggctgaggcaggtggatcacctgaggtcaggagttggagaccagcctgaccaacatggtgaaatgctgtctctactgaaaatacaaaaaattcgctgggcatggtggtgcatgcctgtagtcccagctagtcgggaggctgaggcaggagaattgcttgaacccgggaggtggaggttgcagtgagccgagatcatgccactgcactccaacctgggtggaaaaaaaaaagaaagaaagaaagaaagaaaaaggggtgggatggggagcagacaggcagggactgaaagcctgaaggcctgagcaacttgtgggttctaggggtccaccctccacccaccaagcctgtcttccccttcgtggtttctccagccccaccctcacaccgtcctcctcgatctgcgcggcttcctgcctccatgccactccagactgcaccggcatggcactgactgcccacccctcctgcctcctggccctgttggtggcaggcctagcccaaggcatcagaggcccccttagggcccaggtaagtgctcccaaacccttacctatgccagtcccacgcctggggtcaccccttcagaaacagctggcctgtcattctcatttttcagagggagttgctgaggctggagagggggctgacgtgcccaagggcacatgggaagacagaaaaggctaactggctgacccctagcccagtccttgcacggctgggaactaaggtggggccccagcaatgattcctctgcccactgcccctctccacccttggttccttgccaggacctaggtccccagccgctagagctgaaagaggccttcaagttgttccagatccagttcaaccggagttacctgagcccagaaggtatcacagggcacatacatctccagtccaagcccccactttttttttttttgagacggagtttcactcttgttgaccaggctggagtgcaatggtgtcatcttggctcactgcaacctccacctcccgggttcaagcgattctcctgcttcagcctctgagtagctgggattacaggcatgcgccaccacacttggctaacctttacatttttagtagagatggggtttgaccatgttggccaggctggtcttgaactcctgacatcaggtgatccgcctgcctcggcctcccaaagggctgggattacaggtgtaagccacggagcccagccatcccgctttgtaatagatgaagaaatcgaagctcagggtggggaacaggcatggccaaggccactcagcaggacaggccagggctgggggtgtgttccctggtttcccgaaggcatgagtgggtccaggatcattctttgctatggatctggagggcagtggcaggaggtggggtcctgccctagtcctacgtgatcccctggctccacagccacttccctgcgattctaggcagtggacagggggccaccacctagtcatttgctcattcagcaaacacccaaggacacccattttgtccccacattggggacttcttctctagcccatgatctaacccctgcccctgccctctcgctgtgctgatctctctagggggctgatctgtgtgtgccttttagcccagactgcctgtgccttgtcatctcctctccctgccatgttccagctctcctcctgtggtcagaggtgtaaaggacgtggcctggcaggaagctggtctccagccacacatccttgagtcaccaccaccggaccccttgcctggcttcccacctagggtggccagagatggtcctctggctgcctctggggaaaacccaaccctcggtgggctgggtaaccacttcctgggcctgggtatctgcagtggggccttgtgggggctacaggaaaggagccagtgctcaactgggtgggtgtgggtggaagggtgcccagccagcggctacttcctgcccctaagggcttgggagtcagcctaggacaactcccttttggtccagagcatgctcaccgcctggacatctttgcccacaacctggcccaggctcagaggctgcaggaggaggacttgggcacagctgagtttggggtgactccattcagtgacctcacaggtaccattaacccttctggctcgtaggtggtggttgggaagcgatctccccagggacactggcagctggacccagcggaccttcaatttttacttcccagggaaggaaattcatttccctgaggaccaggggcttgggtgctggtatcaaatcacccagtgcaggggcagaatctctgcagtcctgtgtcctaatccagcctaggggccagcgcagcagctgcagggaagcacccagcagggagcccagcctctctaggcttggcacccttgcctttttgagacagggtcttgctctgttgtccaggctgcagtacaatagtgcaatcacagctcactcagcctccacctcctagactcaagcaattcccccgacccctcagccttctaagtagctggggctacaagcccgcacaaccacgcccagctaatttttctactttttgtggagatggggtctcggactcctgacctcaagtgatccacccaccttggcctcccaaagtgctgggattataggtgtgagccaccacgcccggcctatccttgcctttttgcccctcagggaattatgggaccaacagctggagtgggagaggcagaacagggagaaggggtcaaaatggagacctcagtggccctgtctgttccccagaggaggagtttggccagctctatggctatcggagggcagctggaggggtccccagcatgggcagagaaataaggtctgaagagccagaggagtcagtacctttcagctgtgactggcggaaggtggccagcgccatctcacccatcaaggaccaggtatctgccgctacccagctggctctaattcagctaagtggtgggagggagaggggcacggcccgaacacctagccccgccccaccctctcgccctccagaaaaactgcaactgctgctgggccatggcagcggcaggcaacatagagaccctgtggcgcatcagtttctgggattttgtggatgtctccgtgcagggtagggttgggagagggtgcgcgtgtgacaggggagggaggcctaggggcctggtcacccacactgtcccttcttgcaccagaactgctggactgtggccgctgtggggatggctgccacggtggcttcgtctgggacgcgttcataactgtcctcaacaacagtgagtgcactgccccgccactctggacatctgcagggggacagggtgggcaggagcggaacctcctcccttgtcttgcttatctgcaggcggcctggccagtgaaaaggactacccgttccagggcaaagtcagagcccacaggtgccaccccaagaagtaccagaaggtggcctggatccaggacttcatcatgctgcagaacaacgagcacagtgcgggcagggcagggacacgggcggatggcagggacagacaccggggcagaggcagacacgctgggctactgggctagaagacaagagggggtggggggagcgaaggagcgagagacccacacacccacatgccaagggtctgatgatgttcctgtccccaggaattgcgcagtacctggccacttatggccccatcaccgtgaccatcaacatgaagccccttcaggtgagatgggggagctgatggggaaggggcatacaggagacttggccccacactcagcccctcggcccccaccccctgcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaaggtgagtgtgatctattgggggagggggcaaggcagaacaggcctcttcccaccttcccgcccctatgtcccctaacctcctagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacctctggcttgtgagcagactcttctggtggatgggctgagcacagacaccattccctgagatatgtctcagttcccaaggagccactgtacacatccatccttgtacacggacaccaggtgctcagagacagacacaggcacatctgcacgccccccacttgctccccggagcgaggaccagtctccaaactcagagcaactttattgtcagcgtgggcggagcgttgggaggcacctcagtcatgatacaggcgcaggaggcagccgcggagggtgcccatgtagcggtcccagagggcctggtgtctgtaagaacatgaacagtgacagctgagttttcacaacactcaccgtgatggaggccctgccctgcgtgctttctacaccttcattcattttgcccttagaaaatccttacaattcttctcatgatgaaccctagtttgtacatgaggaaactgaggcatggagaggttaagaaacctgccccaaatcacacagcttctaagagggagagccagagctttggtccagagactttggtcccacccccagggtagcagaatggggaaccttgagtctgcaggaggcgaggtcctggcaggtggcaggctggggcaaagccaagctggacaggaggacagggctgctcaccggaagccatcgagggagtggacagacgctgaatactgattcaggaagaaccgcacgtcgctgagtggccagtggtcggagcggcagggttccacaaactgcgggcccaagagaatacttagcacttgtataggccagggacagaccaggttgggtgtcagagagcacgacagctcaccttctccacgaggtccacaaacaggtctctgacatctttattgtgggtcagcttggcggccacgttcaccagcccccgggacaggttctgtggggcagggatccttggagctctgctttctgccccagaagttggcagctgagcacagaagctgggggaggaggagcaggcccctccccagatccatccacctccctccatcaaccaagtccccattgtttatgagctgctcccgtcagcggccaccagagggagcagcagtgccacctgccggccaatccctggcaggggcagagctgcccggtaggggtggcgaactggaggctgaagatgccaagggtcagaggctggatgggaccacagaccttgaagttggcttccatctcagagaagacgcccagctttccccggagagcagtgcacaccaggctgcagagagacagggtcacgcctatagccacctgggcccctactgcaggccccgccccatgggcccctacaaggtcacctcttgtgcaggtccagaaggtccttgtcagccactagcaccttgagctccttcaagtcctggagaaattccttgtctaagtccatgtccatgtcatccatctgtgagtctgtgaggccatgaagggggtgggggtgggtgataaaaacccctcctgtgatagcctaagcctttcctcacccaccaccttatttcccccctggggacaaaagaggaaatggagtgtcagagagatggagtgacatgccccaggccacagagaggcaatgggccctttgtctgcagacaaggtgtgtgtggggaaaacattctatgggcagggggagcctgggtgggggccatgaacaggagcggatgccaggaactgagggcctgtgggagaaactactggtggggaatcaggtcctgaggatggggaggcgtccaggcacctgggtcagtgggggcctcaccgacggctccaagggtccagttttggatcatgagctcagcgcagaaggcaaagtcaccgaagctcagatactgcagttttttcttccctgtctcaaagcggttgttagcaaagaagacgatggctgcatagtccctgcacagacgagaggagggtcctcttagggcttgaaattccttcttaggaagcagctcccacctgcaacctcagctgggtgtccgagttctggcctctctctgcctcaagtcactgtgtgacgtgtctcaagtcacttctctatgacccttccccatctgtgcgaagagaaggttccagctcaagtttactagtggatacagtgggagaccataagggtaacagttactatctactgagcacttcctaagtgccagggctgtgccatgggctttacatatggtacctctcaacagcccagctggaaatcgctggactgtgctttgaatccaggtcagtctggtccaaagtacagaccaagctgggtgcggtggctcaagcctgtaatcccagctactcgggaggctgaggcagaattgcttgaaccaggaggcagaggttgcagtgagccaagattgcaccattgcattccagcctgggcaacaagagtgaaactccgtctcattaaaaaaaaaaaaaaaaaaaaagtacagaccaaaagtgggataatcattcccccagcatactcaggaggtcagaaggtttggggtagggaaggtggacgagcctccgggcccaggaagtagtgtgcgggatggggaggtggctagctcctcacctggccaaccggtcagagaggaggaagtgttgctgaatattgtccaccagggagccccgcatttcctctaccaccttgaagacccgtttaaagttgtcaaactgcagggcagttagggtagaagagaggactggtcagagtgtacactgtgtcgctcacccaataaaccacttattgaacatctctcccttccccatccacctatccagtcagcagatgctgatttagcatttgttattccttcaaccaactattagttattagtacttgttatcaaatcaaatgcttagcaactcctgctgtatcttgccttggataaatgtttactcaatcttatctctaaatccaaccccattttagcaccatgctctccagatcttcacaagtttgagttggaagagactttcctggctaagccctagaaactaaaaaataaaaaacaaatgctaagctataaacagaaagctcacaggagatacaaaagaaaggcatcaaagacccagaagggttacttcttcctggcgtaccaaaaaggcttgtggagaaggtggcatctcacctcttgtcttggatttcaaggggtagatattgccaagaacagtaccctccaggtagaagcaacatgagtaaaggaaagcctggggctggagaaatgtaagcctagagaggtctgcagggatgagataacaggacagtccataggtcaaagccaaggagtgcagctgctacccaggaggcagtgggagccaatgaaagtttatcaggggtctgataaaatttcaggtcattctgaaaggtcactctggccatacagtacaggatagcttggaaggcacaacagggagccaggcacggtggctcacgcctgtaatgtcagcactttgggaggccgaggcggatgatcacttgaggccaggagttcaagacaagcctggccaacatggtgaaaccctgtctctactaacaatacaaaaattagctgggtgtgggagcgggcgcctgtaatctcagctactgcagaggctgaggcacaagaattacctgaacccaggaggcggaggttgcagtgagctgaggtcgcgccactgcactccagcttgggccacagagcaagactccatctcgaaaaaaaaaaaaaaaaaggaggggaaaggggaagggaggagaagactaggtatgaagctgctgccacaatcagaggctggaactgggccagtggccaaagggagggagtgaagtgtagatgggatgctgtgtccgtgtggatgcagtgcatacctgtctccggcagctcttgagggtgatgcctgttttggtgctgatgtcatccaggtctttcttggtgcctttggacagcttcttgcccagcacctcccgaacaaaggcctcatcaaaggcatagtaccttgtggagtcagagaacaccattgaccctccataaaagacaggaaagggagtctggcggggcctagcagggcctaggtctgaccccttccactctcaactttctgatggctgggtaaatcccatccctccctgggcctgtttcagccggcaaaatgggtatacagtcagactggttgatgtctccaccatcccagagggtgagcacctctcgatgagtagtgcctgccgggagggcggaatctggaagatgagctggtgcagtagcttgggcggcgcatgcagcagccgctcgagcatgtggaaggtgcggtaatggtccatggtgtcgctctgcagcaccgctgccgtggcgccagtctgctccaggattcccgagcgcacccgcagggccaccgcgtcggtcactggaaagcggacgctagcatcaggccccgccccgccgacgccagaggcccttaagggtttccatcccagacccctataacacctcttattcccaggcgctcgcccacttccctaaaggatgcccaagtcttagccccgccccctctcccattcaacacaaccgctccgccgactggcttccccacacgcccctcacggacccgagtaaccatcgagccagaggcgatacacgtcctcgtcgataagggtcgtgttccccacgaagatgtccagctcactggtcatggcgacgcccggggccgcagcgccccgagcaggagcgagcactgctcgggactggcgcgccgccttcaggccacttccgggagcgccgagattccgctcgcggcatcgggacccagcttatgaccacttccgggacacagccagtcggggaggggacggggcgggagcggcgagggaagagagggggaggcctgcgcggaggagcaccgcttcctcccgccgggagggggagtcccgggctcctgcgtcctgtctccctccccggccgtctgcaggagcacgaagggagtgcctcctcttcgtctcctcggtccccgtaacttctcccctcacttcctcctggcttttctcccaccttctctgccctcttcgggacctcctaagtttgacctgtatcctaaacttaggggtttcacagggctctatcctaaatctccgcaaaaatggggtatgacccgacttcctcgggctcttgctggagactggtttgtccatcctgcgcatgagcacctctcctgggtttggggcacctgctcccaccttggttttaatcccacccccagccccacgagctactgacgtctctaattctgcccctccgagctctgcctggaagtccacatccggaggggccgcctatcggccaagtctatccacactcttcccgtaagcccctcaaaagctcaacatattctagacagacctctgcctctccccatttgtttctttcctgcgtccctatctcagtgacagccctaacatccaccagttctcatacgagaaacctgggcgttcttccagactcctctctccccacattcagttcggctgatttgcctcccgaatatttctagtatctgtttgtcctctccacccccactgatgctgccccagccgtctttctgcttagctctccttgctcttgctctttgacaccgttactaatctccctgtttatgtcccctccccgcagggtccggcccacacagatcagcccaatctttttaaatacattttttttttcgagacagcgtctcgctctgtcgcccaggctggagtgcagtggcgcgatctcggctcactgcaacctccgcctcccgggttcaagcagttctctgcctcagcctcccgagtagctgagattacaggctcctcccaccacgcccggctaatttttgtatttttagtagaaacggggtttcaccatcttggccagttaaaggcatattttaaaatgttactcccttgcttaacatccttacaaatgttactctcttgcttaacatccttagtggcctttggaaatgctccaacctggtactggaagttcttaagaatctggcttttacctacctttgaagcctcgctctctctctcttagcattttctcgacacatctgcttttcaaaaaccaagctatcctcattgttcctaaagcagctaggctctttcgggcaccagtgtctttcactatgttattctctctccctgaaatagctctttacttggcaaagtcctatggatctaccagagcctcttggatagcatctcttttgggaaccctcttaaggaccctcagaccatactcctcccggatttatttcttgcttaacacagcttgacttcccggacagactgcgacctccttgaggatggaatcggtattttggttaaatttatttctgcatgggccttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcggagcccacggcctgggcagcgtctgtttggtactcgccggggttggggcgagggtggggtgctgatacagggtacaattcccatccagaaggactgcagaactaatgattcccccattacttcgagcctggggtgggatgcggggcagtggtaaaccagacttcccccatcgggcgccgggaccggccttaatccagcccctgaagtggctccagctcccttcccggctccttcctgtccaagacaatggggcaggaagcaggtgctgggggcctagaaccactcggccgcctcctctgaggctggaagggggcataacagcgcccctccgtggcacacgcagcagcactgtgggcccccacggggagaggggcggtaagcctcttcgcttttaccccagaggactgtctcccctcagtcccggagatgaggccgagcggatgtagccccacttgtcagataagacaaagtccaaaaatatcaaagaatttgtccaaggtcatgcagtgagtctgtagagctaaggctgggacctagggctccaaatactctcccattggcctctgggtccagtgaggcactcaggccacagcttcaagccttttattccattttggtaggtttgtataaaaatactctctttaggaaaataaatagcagctgccctcgctgtggaggcttggattccctggagctgaaggcttctcaaagctgagatccgcagatcagctcatcacagaagccaagggcgcctcctgagctgtgcggttcaggagggggcggcagaatggcctggtccaatcacctgctgctgctggcagtggggctggtgagttagtgttctaggtgggtaaagtggcaccttctgtcaggagatagggttgggtggatcacaggaagagggtgatggagagtgtggcagtgatctggaaggggttagggctccagaggacctctaaggatctacaaagtctctgggctgccaggattcctctggcacaaatgggaaatattttgtctctgatttagtgcaaattgtgctagagaggccagctcaagagaaacagtgggcagctttggtggccccaagctggctctactgtgaagcacaatatggtcagtctcattagagggatggagaagaagttgctggagttggatgtgggatactgtccaggccagctggaccggtgggggaaggggaggagacattggctagggtggcatctgcagggagtagggctcaggcgcctcacaaagcgaggagggttggagagccaagggggtcagaggatgggtctccgctgctgctgctactcttgcgatgagctgaggcacaaggctcaggagtgctggggtaggtgaagaccaggctgggggtgaaaggagttagggagggtgtggtcatgagtgtgggggtgtgcagtgcctcaggttcaagcacaggccctggggaaagggagatacaaggtacagggcggcagggggctggtgggctgctggtgccactggtactgcctgtgtccccctccttggctccttccgggattttgcagatgggtcggtgggcttccagcaccagctctaggcgctccttctgcttctgcagctcctcaatctctcgctgcagcccagatttctcatcttccagtttgtcagtctcctgtagaagatcaggagaggagtcagaaaggtgagggctgaataccccagagccgcagacgtttggactcagggttctgaggagctggggttgggcggggggagagggggggcagtggagagtccccagcaagtctggactacaactcccataagcccctgggagaaaatgggcacaactcccatcaggcccagacgttttaggagattgctggcaccaggcagtgactccggcctgtaatcccagcactttgggaggctgaggcgggcggatcacttgagaccaggagtttgagaccagcctggctaacttggcgaaaccccgtctctactaaaaatacaaaaattagtcgggtagggaggcaggcgcctgtagccccaggtactcagcaggctgaggcataagaattgctggagcctgggagacagatgtcacagtgagccatgagccgagatctcatcactgcactccagcctgggtgacagagcgagactctgtctcaaaaaaaaaaggagattgctggctgagcttcagctctgctgtgagtgagacatgctgcagccagtttctaatcaatttttcctcatcattttcccagaaggactgcccctcagacaaggagctaggatggtgaggagggggctacatatactggggctctgggggctctgggagacagggtccctctgagctcggtggaccagggctggtgctcaccgcctgcaggaagtcggtcagttccttcctccggttcctgcacttggccgcagccagcttgttccgctcgcgccttactcggcggcgctcctcttcctccgggctgatctgggggtgagacccgcagtgaggaggaccctgggctactggctgcctggaactcgcccctcatggtggcccagtggtaggaccctggcagaggtcatggcagggccccctcagccggtgatttagggatcactgcacccaaccagttccctgcactgaggcgctgtctgctttgattggtaaaatttcctcctcgcacctagctttagtgcacattcctctcccataatgccctccccctccgcaaaccctaaccctcctcatctcccaggactcaactaagatgctcctgcctccaggaagccgtcttattccccagccagaagtgacctttccttctcagcaccctctttgcaggaccctcatccttctggatctgtggacaaccaagtctcctcttccatgagctgtaagcactaggaggggctaatgagtgctgctgattaagttgcaatttattggaaaactactatgtgccagccaagtactttacgtagattcttgtttttcactgagaacatgcaaagattttattttattttattttattttttttagacagagtctcactctttcccaggctggagtgcattggcccaatcttggctcactgcaacctccacctactgggttcaagtgattctcgtgcctcagcctcccaagtagctgggattacaggcatgtaccaccacacctggctaatttttgtatttttagtagagacgaggtttcaccatgttggccaggctggtcttgaactcttaacctcaggtgatccaccctcctcagcctcccaaagtgctgggattacaggcatgagccactgtgctcggcctttttttttcttttttttttttgtgtagtgacggggtctcactgtgttgcccaggctggtctggaactcatgggctcaagggatcctcctgcactggcctcctagaatgtttggattaccagggggagtcaccacagctggcctcttttttaaaaaaacatagattcttttttttttttttttttgagacggagtctcactctgttgcccaggctggagtgcagtggtgccatctcggctcactgcaagctccgcctccggggttcacgccattctcctgcctcagcctcccgagtagctgcgactacaggtgccttccaccacgcccagctaattttttgtattttttagtagagacacggtttcatcatgttagccaggatggtctcgatctcctgacctcatgatccaccttccttggcctcccaaagtgctgggattacaggcgtgagccaccatgcctggccttaaactagattcttaacgcaactttccatgaaaaactgaagcccagagaggataacttacttatggttccagagcaggacttagaacccatagaactcactcactctattccacattgagtgacaggccagatgagagagaccatttcaccaaaaggatccaactcacagctcacagccctacctggagaacccaggatcaaagggtcaccctcaggaccaggctgaaggaaggacgcacaggagggtttacccctggcccgcttctgcggctcataccacagtccctcctcaccacaaaggccagacattctgttctgggaaacctgtctctggctgatctctcacctttcccagggccctaacctctctccccatcctctacctgccgaccaagctttttaacctcatcccctgtagtctcccacaccaaaatgccccagggagaggaaagatgagccactcctttaaagactcgccatctcttactcacttattttggtaagggctttggggagccaagaattgtcagttccctctactttgagccttctgttagcttccagtgagacagcgtggcttggtgattagttttgggggttttattttattttgttttttcggtagagacagggtctctctatgttgcccaacctagtcttgaactcctggcctcaagtgatcctcctgcctaggtctctcaaagtgctgggattacaggcatgagctactgcacctggccctggtttggtggttaggatctgactttagagttgtatagacctggggccaaggccagtcctgtgtcattactcactacttgtgtgatcttgggcaagtgactacccttctgtgccttcatttctttggtggaagatggggaaaaccagagtacattccccagagagattttgtgaggattaaatgagacagggaaactgagactgagggagtagctgaagggaaccctcttgttcctgttctctcccagacaacataagcgccccctctatgcatgtcagcaggtggagaccccctcaccattccgtgtgcgcaccttacatgttcttgcctccgcctccatccttgctcctgccacccccgctacctggaatgtcctttccttcctctctgcctctgccagtcctacccatccttctaggctaatatgccaccttttccaggaagctttccctgatctggaagtgactgttgtaccctctgggcctcccgtggggctcctatcactttcagccttgggcagtagtcacctgtagcctaccttaccccctcctaagcctgtgctctcctttctggcaggagcttctctgcaccctagcactcctgggcggggtcggaaccactgcaatgcctctgtgccttacctgttcacaaggccttcgacgtacccctggaggcggccccagggcccggatgactcctggccggggttgtggggggctgtactgagggtaggtcagaggcctggggtaactgctgggccccaggaaatgaggctgtaccatccactgcagctcctgactgccactcatggtgttgatgcttggcaccaggtggaacttctaaggaataagaaatggaaggccacagatgaggtccgtgtggattgaggggcttccactgggcagaggctacactgctgtctaccttcaatgtacaggctagctctgggaacagaaagagcacagcttggcagtcagagactgacctggtggcaaatccctgctcataagctgtgtggctttggggcaggtcacataacctctctgtgcccccatttccccattagaactaacatttataaagcacaaactgccaggaactgttctaaccactttacaaatactgactcatatcattggcacagtaatatcttcattttcttttctttcttttttttcttttttttttttcagatggagtctcactctgttgcccaggctggagtgtagtggcacgatctcagctcactgcaacctgcgcctcccaggttcgagtgatcctcctgccccagcctcctgagtagctgggattataggcgtgcaccaccatgcccggctaatttttgtatttgtggtagagacagggtttcaccatgtttgccaggctggtctccagctcccaacctcaggtgatccacccgcctcggcctcccaaagtgctgggattacaggcgtgaaccacagcgcccagcctagtatcttcattttcagacgggagaacagttgtccgcagacacagagccaatgagcccagcagctgggctcttacccactcctgcacccgtttgcacgaagaggataattacagctcccagctcaaggggaggctgtgagaatcaggtgagagaatgtgtgcgacagtctggtaagtggcaggtgcccagtgcagaggggctgaggcaggaaagagtcactgctctgggttcaggccattccattgcttttttttttttttttcttgagacagggtctcactctttcacccaggttggagtgcagtgacctgcgggctcaagcaatcctcccacctcagcctcccaagtagctgggactaccgacgtgcaccaccacatttggctaattttttttttcttttctgtttttttttttttgagacacagtcttgctttgtcacccaggttggagtgcagtagcccgatctcgcctcactgcaacctccacctcctggattcaagcaattctcctgcctcagcctcccgagtagctgggactacaggcgcccacaactgtgcccggctaatttttgtatttttagtagagacagggtttcactatgttggccaggctggtcttgaactcctgacctctggtgatccacccgccttggcctcccacagtgctgggattataggcatgaggcaccgcgcacggcctggctaattttttttaaatttttttgtagagacagggtctcactaggttgcccagggtggtctcaaattcctgagctgaagcagtccacccacctcagcctcccaaagtgttgagatgacaggctttagccacctggcatggcaggctgtcccaattctaatctcagctctcagctacttactggctgtgtgaccatgggcaagttatttaacctccatgtgcctcagtttcctcatttttaatattgttacaggtgaggattacaggatttcactgatgttaagaagtaccctttaatagctctgaaatcatagtttaattggcaatttaaaaaattttagtggactaggcatggtggctcatacccagcactttgggaggctgaggtagaaggatcacttgagctcaggagtttgaggtcacaccgggcaacacagtgagacttcatttctacaaaaaaattaaaaaattagttgggtgtggtggtgcgtgcctgtggccaggtcgcttcccagctaggatctcagtaggattgcttgagcccaggaggctgaggctgcagtgagctgtgattgcaccactgctctatagtctgggcaacagagggagaccctgtctcagaaaaaaaaaaaaaaagaaaagaaagagaaggaaagaaaattagtggcataaagttatagtgggtttttttttcaatcgatgaggtcttcgattccgtgaaatatggtaaatgatgtagcaagcgcccagcacaacgtccctgttcccattctatcagccagctatctgaggagtgggttgggatggggctcagtgttctgggagaagtgggttctagctctgccgctgggccctgggtgtgggcgcccaatcgtccgggaagcgcccacaagcccaggcaagtcccgacagcggtagcccgagcccaagcgctgcgggcccggcgtcccagtgaccccagttccgggtccgaggcaccgccggcggcatctcccactcccgggcccgggccgctccaggccaggaagggagggacgccccgggtgactcagccgccgtgactcggccgccgtgactcggcggaacggacgcccctccttccctcccctgtcgacacgtgctcgcagcccctcgacaggaaatgggcacctgcagcctcccgggtgccccccggcgggcagcgggcgccgttaggggctgagagtggggtcgcgagagtcgcccgcagcctgaccccgcgcacgtcccggaacctcgaggtctctattcgccgcattcggcaaagggatcgagggccggtctccggggacctggcaggttccactgcccggacccccctggactccccaggccgagaaacgatagggacttggcgacggaggggcgaaggacagacagacggacggacacgcggagggtcgcagaccgggccgggactcccaccctggcccagctgctctcccgacggatcccgcctccctcccgtgtggggaccctcaccccagcccagactccagatcccaggaattcagcccgaagcggagagaccctcctagccttcgaggcgaccaccctaggcgcccacgccccttctgaagcagggtggacgcagaagtcagaggtgggcaggaggagagaaagcgggcacggagacggagggacggacgcggacggcgagggagaagggggcggctgggagaaggggagttcgcgggtctctgctgcccgctgcgcggtgggggcaactggccccggacggcgaggggcaggatcctcgccccagcccccagcccggccccgactccggttccccgctccagtcccggagcgtgcgggagttgaccccggcctcccacgcgcggtcctcccgtgggaccaccggcgtcgggccccactcacctgctgggctgcctgcgctgcggccgggggctgcgcggggccgccgtacccgccgccgttcccggagctcgggccgggttccccgaagtctcggaacatgcccggggctggcggctctgcggggtacacggctgctgggttctgactcacccgcgccgtgcggagtcttttctttttatgaatgaaaagttctcgggctgaaccactgcgaccgcggggggtgggggcgttgcagcggcgcggtcacctccaggctccacccccgagacgcgccgccttggcccgtcggtcccgaacttggcgacgcctccccaagtccggctgcagccttttcaccgggatgggcccggctcggcgttccccggaggctgcgggcccgcccccctgacgtagctgcccatacatggtgtaacttcctcgccgcgcccaggtggagccccgggttcccctgcggactgacgcacctgccagagcccgcgccccgccccagccctctcgaggcctgggctaacctccgtttctgctcccacaaaatagcacgaaagaatcacatctctaggagccacgccaaccgccacccaaagcttcgtggagtgaggtctttccactggccttgttttaaggcttcgagtatatgaaaagtgaataaatgacaaaccagggttacaaaaatggtggcatattttattttactttatatttttgagaccgggtctctgtcacccaggctggagtgcagtggctcgatctcggcgcactgcaggctcaacttcctgagctaaagggattctcctgcctcagcgccccctccaagtaagtgggactacaggcgcgcgtcaccacacccaggtaatttttgtgttttttgtagggattgggtctcgccgtattgcccaggctgggtggtatattttaaatgtttgcgataaggtaatgctttgaactaaccccacataaaatgcaatataatagtattactcaggataatttcaggagctataacgagttttaattcagggccactacaggtgtcctgaggtctgataaacgccatcttcattacggtcagtgcctttcggaggcttgtggccaccagacttgtttggagagtatgtcaaaggtgagtgaatgtgaggcaggtatcatcctcatctctgttttacagatggggaaactgaggctgggagatgctgaaatgaattgcttgaagtcgctaagtgagtagctggcacaggttgccaagtcacagccgtgggcactccaagcccaggctcagccaagattttcaaagcccttacaccttcacagacaccttgtcgcacatccagaatgttagtgctgggcaccatcccaaagcttctctctgattacttccatcatagatgaggaaactgaggcccagatggagtactgagctgtcagttgtcacacgactacagaaagagggctggggccaggtgtggtggctcatgcttgtaatcctagcactttggaaggccaaggcagaaagaaccatttgagaccccatctctacaaaaaattataaaattttctggacatggtggtacgcctgccttgtggtcccagctgttctggaggctgaggcgggaggatggcttaagccagggaggttgaggctgcggtgagctgtgactgcgccactgcagtccagcctgggggacagagcaagactcaaagtaaatagatcaagagagggctgggctctcctgcttctccatcggtccttccatttcatcagctctagctttgccctctgggctactttccttgggaacacaggccagaagcctgtgggtgcactcaggacttagagccaggaagtccagattgcccctggggttctagtcccagagctaccattttctgtctgtgtgacactgggcaggtcaccttccttcaactgggcctccctgctgatctcacagagctgttgtgggatcaagtgagatcacagatgtgaaaatgctttgtaagctataaagtgttatgcactcagaaagtggttaccagcctggtgcctctcctttgcctttgagcgacccaatgcttgtcaccctcttgtcatcatcatctctgtgtgtgtgtgtgtgtgtgtgtgtgagagagagagagagagagagagaaagagagagagaaaggagaggagagtgtttttgaggcagtatgatccgtggacagaacacccgtgctggggtcagacagctctggggtctgggtttgaatgtggttaggctgctcaccagttgtgtgacctaggtgaggcacacaatctctcagagcctctttcattatctgtgaaatggagacataatgataactatctcaagggttgttggaggacacaagtaatgtcacatgcttagcacagcacatagtaagaatttgacacataggctgggtgccgtggctcacgcctgtaatcccagcactttgggaggctgaggcaggtggatcacgaggtcaggatttcgagaccagcctgactaacatggagaaaccccgtctttaccaaaaatacaaaagttagctgggcatggtggcccatgcctgtagtcccagctgcttgggaggctgaggcaggagaatcgcttgaacccgggaggcggaggttgcagtgagccaagattgcgccattgcactccagcatgggcaacagagtaagactccgtcaaaaaacaaaacaaaacaaaacaacccaggggtgagagcctttgggactgatcacacatgaaggcactcacacagcacatgtgcacacacactgatacctcaacttcttggcagagcccaagctggacaggtcaagtgtgacacaggtaaccaggggaggggtgacacaggtcagccttgactgcattcacttgcctgctccagaaacatcaccctgcacctgaccccaccgcccccaagcagtggatgctggggccactggggcagctgagggagcagggattcaggtctggggtgtgtgtgtgtgtgttacatgactttgaaagtctcttcctgctctaaccgtcactggagccacaaggaggtcctttcagagggagcacattccaacctcctcagtcactaacccccgccttgtggctgcagaaacgttcctggcctctgacctcaccagcttccacccagggaggccaggagagaaccccagggggccacagccatcgctggaagtttgggggcagggaggcctgagggaccctgccactgtgccttggtggctctgtaagactggctcagtcccttcccatctctgagccccagagaatccctgccttttggggctgcagtgaaggagaggaggcttggcaccctgtgcattctcagcatggccagggcattggaggtgatatttatgtttatcagtttctattcactctttaattgaagtctatgttgtttttgtttgtttgtttgtttgtttggtttgagataggatctcactctgatgcctagatgcctaggctggagtgcaatggcaggatcgcagctcactgcagcctcaaccttctgggctgaagcgatcctccctcctcagtctcccgagtagctggggctacaggcgcgtgccactacgcccagctaattttttttggctcaagcaatctgcctgcctcggtctcacaaagtgctaggattacaggtgtgagccaccgcacctggcctttgaagtttacatttttacttgagattaaattcatgtaacaaacaattaactactttaaagtgtacacttcaatgccatttattacattcacaatgttgtacaaccaccacctttctttagtttcaaaacttcatcactccagaaaacaccccacacctatgaagtaattactccctatttcccccttccctcatcccctggtatccactaatttgcttcctgtcgctatggatttgcccattctgggcatttcaaataaatggactcattcatatattatgtggtcttttgtctgacttctttacttagcataacatttttgctttttttttctttctttcttcttcttcttttttttttttttttagatggagtcttgctgttgcccatactggagtgcagtggcccaatcttggctcaccgcagcctcggcctcctgcactcctcaagtgatcctcctgcctcagcctcccaaactgctgggattccaggtgtgagccaccgcactgggccagcataacattttcttttcttagtattattattttttttaaaaacggagtttcgcactgtggcccaggctggaatgcagtggcatgatctctgctcactgcaagctccacctcctgggttcacagcataacattttcaaggctcattcatgttatagtatgtatcagtactttgctcatttctatggctgagtatatataaccatttatttatttatttttgagatggagtcttgctctgtcgcccaggctggagtgcagtggcgcgatctccgctcactgcaagctccgcctcccgggttcacgccattctccttcctcagcctcctgagtagctgggactacaggcgcctgccaccacgcccggctaattttttgtacttttagtagagaaggggtttcactgtgttagccaagatgctctcgatctcttgaccttgtgatccgcctgccttggcctcccaaagtgctgggattacaggcatgagccaccgcgctgggcgttttttggacagatatctattcaaatctttactttttttttttttttttgtagaaatgaggtctcaatatattgcccaggctagtctcaaattcctggcctcaagtacttctcctgccttcacctctcttcacgctgaaatgacaggtgtgagccactgctcccaaccattgcccagactggagtgcagtggtacgatcttggctcactgcagcctccacctcctgggttcaattgagtctcctgcctcagtttcccaagtagctgggattacaggcatgtgccaccatgcccgggtaatttttgtacttttagtagagacagggtttcaccatgctggccaggctggtctctaacccctgacctcaagtgatcctcccacctcagcctcccaaagtgctgggattataggcgcccgccaccacacctggcacattgcccattcttaattttttttctttttttgagatggagttttgctcttgtcacccaggctggagtacaatggtgcaatctcagctcaccacaatctccgcctccctggttcaagcgattctcctgcctcagcctcctgagtagctgggattacagtcacgcgccaccacacctggctaattttgtatttttagtagagacaaggtttctccatgttggacaggctggtctcgaactctcaacctcaggtgatccaaccgcctcagcctcccaaagtgctgggtttacaggcgtgagccactgcgcctggccaattttttttttttttaatgttgagttgttctttttatattctggatactaaacctttatcagttatatgatttgcaaacattttcttttattctgtaggttgtcttttcacattcttgaaaatgttctctttttttttttggagacggaaaaatgttctctgatgcacaaaatgatgcattactattttttattgaagcccaatgtatctttttgttgttgttgctcatgctttgggtgtctaatgtaaaaatccattgccaaattcgaggtcatgaagatttactcctatgatttcttctaagagtttatagttttagctcttagatttaaattgttgactaaattgaagtcaagcacacatacagtaaagtgcacacatcagtgtgttcagcttaatgactttaaaataattcattattttttattattattattttgagacgcagtcttgctctgttgcccaggctagagtgcagtggcatgatctcagctcactgcaacctccgcctcccgggttcaataaatactcttgtctcagcctcctgagtagctgggactacaggcatgcgccaccacacccggctaatttttgcatttttagtagagatggggtttcaccttattggtcaagctggtctctaactcctgacctcaggtgatctacctgcctcagcctcccaaagtgctgggattacaggtgtgagcctccgcaccccgccttatttattattatttttaagacaaggtctcactctatctcccaggctggagcacagtggtgcaatcatagctaactgcaaccttgtactcctgggctcaagctatcccctaacctcagcctcccaagtagctgggactacaggtctgccaccatgccaattatttatttatttatttattagtagagaggaggctgttgcccaagctaatctcaaactcctgagcttaagtgatcctcccgcctccgtctctcaaagtattgggattacaagtatgaaccaccaagcccagcctcaatgacttctgcatctatataaacccatgtaactaccacccttatcatgatgatgtttttagcaactcggaaggctcctctgagtcacactccccacccataagtagccactattctgacttctgtcatcatagattagttttgcctgttcttcaacttcatatacatttgaccatatggcacgttctcttttggtcctggcttcttttagtcaacatgtctgcgggattcatctgtgttactgagtgacctggtagcttggtcttttctgttgctgcatcccattgcacaaatattccacaatcggtctctccattctccattcccctgctgatgacttggggggccttccagttttggactattatgaataaggctgccatgaatatccttgatacatccttttgggagccagttgtattcatttctcttggctatgtgcctgggttgggaggaattattgggtcatatggttggtgtacattcagcttgaatcgaatgtactctccaccagtgctccaacatggatgtaccattttgcatcccacccatgttgttcaatgggtaacagttccagttgctccacatctggagatgactttttttttttttttttttgaaacagggtcttgctctgtcacccaggctggagggcagtggtgtgatctcagcttactacaacctctgccccccaggctcaaatgattctcctgcctcagcctcccaagtagctgggactacaggcgcctgccacaatggccatctaatttttgtattttgtggagacggggtttcatcatgttgggcaggctggtctcgaactcctgacctcaggtcatccgcccaccctggcctcccaaagtgctgggattataggcatgagccatggcacctgacctggagatggcattttaattcacttctacaaacatttattttccttggtcctggccccttcctctctcccctgaatgctctccacagcttccagctcagcacttcccaccctgcagccttagggatagttttaatcacaaaaaattttaagagtctgagcatttcaccctcagacttggacctaccccagctggaattgctacccaggaaggcctgaagcctgggaagggatgggctaagggtgcttggcgtaccctgtgttcttttaggttacgtgctgcctgggagacttgaggggctaagaggataacactagtggctcttgctcattgaacactgatgaaccagatgccattccaagtaacatgtttaatcctcacagcaaccctgtgagagagatggtataatacacccattttatggatcaggaaatggaagcacagagagattaagcaacttgctaaaagccacacagtgaggaaggaaagtgtgcggaatccagatcctcgtaaatctggcggggcttggccgaatgcacaggattttccttcataggcacctgctcactctcagtcccaggctgccagacggagcccctcacctttgcacagatggctccctctgcccaagggacctcccttgtcccctcacctggctgactcttatgctgcagctttcagtttccccaccatttcctcagcaaggtcttctgcgagccccaacccaagtgaaatcccttaatcccttatgcaatgagcaatacagtcccctcgtgcaatgaaggacattaccttttattctccctgcttggaataatgtttgaaggtattgcattttggagacggatatgcgtgtatctatatgtatatctgtatctgcatctaccaagttgatggccataaaaaggggatgtggaaaataaattattttattttatcatattttatttatttattatttgagatgaagtcttgctctgtcgcccaggctagagagcagtggtgcgattttgacttactacaacctcttcctcctgggttcaagcagttctcctgcctcagcttcctgagtagctgggactgcaggcacctgccaccatgcccggatacttttttgtattttagtagagacagggtttcaccatgttgcccacggtggtcttgaactcgtgagctcaggcaatcagcccaccttgacctcccaaactgctaggattataggagtgagccaccacacctggcctggagaagaaattattttaaaacgtcgtttttattttttatgttgctttacactaaaacatttaattgcatttctttttcgaccaggtaatacattaagatattttaaaattcaaaagctacaaaaggggtagagtgagaagcctcccctccactgtaaccagtttcttgcgtattttttcacccagaaggtagcctatctacatcccgtatcgtttcttgctttttggttttctaataataatcttggaagatctttcactgagtatatgtagatctgcctcgctggaaagaaaaatctagctgagcactgtggcacacgcttataatcctagcacttcgagaggctaaggcaggaggatcacttaagcccaggagttggaagctgcagtgagctgtgatcagaccactgcactccagcctgggcaacagagtgagagcctgtctcacgaaaacgaaaacaaaagctacctcgtcgtggtttatcttacattcggtagaatgcacactttgttaatgtgctggttatgtgtatacacctgcgtagccacgttccaatccagatacagaacatttccatccccctagaaagttctctcctgcctctttgcagtcgattcccccaccccaggaaatcacttaactcatttctgttgtcatcgattacttttgtctgttgcagaatttcacatcaatggaatcgttcaccgcgtgctcttttgtgcctggcttctgtcccccactgcatggatgtaccacagtttctttatccattcttctgaattaactgaactaaaagttgaatggagccagatgtcggggaggtagggacgattaaagacttagtcccaggcgcgtggtggcgggtgcctgtagttccagctactcgggaggctgaggcaggagaatggtgtgaacacgggaagtggagcttgcagtgagccaagatcgtgccactgcactccagcctgggtgacagagcaaaactctgtctcaaaaaaaaaaaaaaagacttggtcccaggccaggggtggtgtctcatgcctgtaatcccagcactttgggaggccaaagggggcagatcaccggaggtcaggagttcaagaccagcctggtcaacatggtgaaaccctgtccctactaaaaatacaaacattagctgggtgtggtggtgcactcctgtaatcccagctacttgagatgctgaggcaggagaatcacttgaacccgggaggcagaggttgcagtgagctgagatcgcgccattgcactccagcctggccaatagagtgagactccgactccagaaaaacaaaaaacaaaaaaaccccagcaacttcgtcctcctggccgcaaggcactttcagcccagagaggtggtcagacactcagactagtcctggtgctaaggagacagtgctggggggaggagccagagagtgccagggccattactggagccccaaaaggaagagttctttccacctgtggtgggggtgggtaggagaagacttcctggcagacgaggatttgggaaaaatattcataaaaagtggggctcgctttccctcaccagccacccctccagcccaggactgtggggtgaacatcaaagacacagctccagcctggctgggtctctagtagttcaagtgacttcattatgtgacttcgggtcagtctctttccctctgggagcctcagtttccccttcctgcagatgagtggtttacatactgtggaccctgaaactagaggtttccatggagatggcaggggccgggatgaggttttgggcccctcatccttgcttcagtaagcatcactcagcaggcaggaggggatctggcagtggacgacttgggtttgaatttcagttcagccacttcctggctgggcaagctgggcaattccctaacttctcaatgcctcagttccctcacttgtaaagaggatgctggccaggcgcagtggctcacgcctgtaattccagcactttgggaggctgaggcaggtggatcacctgaggtcaggagttcaagaccagcctgactagcatggagaaaccctgtgtctactaaaaatacaaacttagccgggcatggtggtgaatgcctgtaatcccagctactcgagaggctgaggcaggagaattgcttgaacctgggaggcagaggttgtggtgagccaagatcgtgccattgcactccagcctgggcaacaagagcgaaactccgtctcaaaagaaaaaaaaaagatgctaataatcggacctgcttttcacggttgctggggagtgactgagccatggcatggacagtgctgagcatggcaccagtacagtaagcgatggataaatgttagtgagaattttcttgctgttttattttgtgctttacgggcaatttcctctgaagggagatatcaggggctctgctgtcagtgcccaggatggatttgcctgcttagcctggccccttaagtttcttggagtggctcctgcttcctgcagacccaggctcagacagttggagcctgtcacccagttctcaggctccccctaactcctcagacctgggccataccccgacccagtaccccatgggtgccagctcctgctctgggccaggagtgggatgaaacgcccgtcctggatgaaaggctggcaggcctgggctgggccaataaaccaccccacccatcctgggaggacctccgggcaccggtgtaaactgagtcatggggggtgagggggtgagtcacacagcctgggagtgggagccaaatgggacagagctcgcctgtgtggggtccctggccccatctcaaacagccacaactcagcccacctccaacacccatcaggcccctggcccatggcagaggtaagtggggccagaccaggttcccagagggcaggagcctggaggctggagtcccagcacgcacgcatgtatctgtgtgtgagtttgtgtcatgtgttgtgaggggcgggtggcagaccggaaagggaggctctgactcgggaggaaaggatggattggggtttggaaaagagtcaaagccctggagagattttggcgggaatgcttcgctgccctctcctggcctctgagggttgggctgattttcctgcctgaaccagctttctccctttaggggagggaggaagaggaactgggccctggtgggtgacctccccgtcctctagggtctacagagggcagactcggtcggaggagggaagatccccagaagccaatttgggcttcgccccagaaaggtctttaccctcggggccagagctgctcagggaccagggacagagctccctgggacacgggtgtgtacaaggactcttgggagttgtggaggtccccagagcatttctagccttgaccttggccaagttgccaagttatttaacctctttctgcctcagttccctcatgagtaaaaggaggaggtctgtgaggaccataatgagttaatgcagctgaactgcttagggtgtgcctggcacagagtaggtctgtatacaggtttgctgtttttctttttctagacaggtttgccaggctggagtgcagtagctggatcatggctcactgaagccttgacctcccaggctcaagcgaccctcctccctaatagcctcctgagtgctgggagtataggaatgtgccaccatacctggcttttttttttttttttttggtagagatgggggtctcattgtgttgcccaggctggtcttgaactcctgggctgaagcaatccttccgcctcggcctcccaaattgctgttactataaatatgagccaccatgcccagcccatgtttacttttactatttgagcctgttttcttatctataaaatgggtaagaaaggacccctgagggaggtggcccttgtacaggtttctctctggtctcagtctctggttttattccctgggaagttgccccctaagccctgccaccctgcctgactctatctccctgggattttttcccagtaagcaaaggaagatggggttggtgggcttctcagctgggtgtcctcaggtttacccctaggtgcctgggggatgtgtgtcagaggagtggggagtttccctcctcagatgaatcagctgtgtgacctgatcctcatccctgccagagcccctcccagccggcaagagtggggcgcagctgccccactgggaaaatcccccaaatcctgccaaagctcttgctgaagcgttctcttgactcagctgttttagtcctctttgagtctgcccaagttccaacaggagtcaagtcgggcagattctctccttccctggacagaccctctggagcctcctccctggggtctggggtttgcagtatgtgggagtgggaggaaaaggagttggggctttttcctggcctcagtcacccttcccctggttttataaaaggagcagagcacaggacttgtccaagtttgcccagcaccccctgggccaaaggcacttccctgctccaaggtaggaacaggccagccaaatagggcagaactcactgccagcctgagggggtgggttttggggggccattgacctggcagggggccagttcccactgtagacctggagacccttcctgcccagtaggcttcgtcattgcactctctaggcctcagttttttcatcggtaaaaaaagggactttcggcggggcataatggctcatacctctaatcccagcactttgggaggcaaaggtgggcggatcacctgaggtcaggcgttcgagaccagactggccaacatggcaacccaggaggcggaggttgcagtgaaccgagatcatgccactgtactccagcctgagtgacagagtgaaactccgtctaaaaaaaaaaaaatagactctcagttttggcccagcttctctcccaggtggttctgaggacccaacctcctgtgtgctttagaaaccagatgctgagtcctgcagggtctcatctatccttgcagcccccaccccaacagcacttcgataaagtggaggttcaacagtgcataaggtgccctggagttggatgaactgggtttgaatcttggctctgccacttactttcttcataaccttgagccaattattgaacttgtctgggtctcagtttcctcttttgcaaaatggcaataataatagagccaggtgaaacttagatgaaatcatgtaggtaaacgcttagcaccgtgcctggctcttgtcatgaatagaatgaggaaactgaggcccagagagagagtggctttcattcactcactcatttattcaagaatgtttggctgagtgcaggggctcatatttgtaattccagcactttgggaggctgaggtggtaggatcgcttgcgcccaggagttcaaagctgcagtgagccatgatcatgtcatcgcattccagcctgggcagcatagcaagaccctatctcaaaaaagaggccggccgcggtggctcacgcctgtaatcccagcactttgggaggccgaggcgggaggatcatgaggtcaggagatcgagaccatcctggctaacacggtgaaaccccatctctactgaacatccaaaaaattagccaggcgtggtggcgggcaccttgtagtcccagctgctcgggaggctgaggcaacagaatggagtgaacccgggagccggagcttgcaatgagccgagattgcgccactgcactccagcctgggtgataaagcgagactcatctcaaaaaaaaaaaaatgttaatttggcatctgcactaggttgggccctatgccggatgctggaggataaagcattgtcactgtctgaagggatcttacatacagatgagagcagcaggcaggcgggagctgtgggagcctaggggacatgcctgcaacacttggggtgaggaaggatccggaagcatcctgaagaattacacctgagccagtgggtctgcaacgtggcgccagccagggaagtgggcgagggtaagctaagcagaggctacggcaccagcaaaggcgtgaaagtgagaaaggccaccatgtgtacaagaaagtcacacgcagctcaacgttcttggacaaggagtgcaaagcagggaatggagatgggatgaggcagaagggtccagcaggggctggagtcgccaattacctcattcattcatgtaataacttacggagtcgttgttctggccaagcactgtggtaggctctgggaacagggctgagatctagccactgttcctgccttcacagagcacagtgtgggcatggggcttaggggccagcaggagacagacatcaagccattacacaagtcaccacacactctggccatcagggctgcaaggcaggtgctcgagcagaaggaacagcccgaggcccagggctgtgcaccagggggtgaaggaagtaacagatggctccagctgggtgagcatgggcagaaaggggtgcccgagggaagcggggaagtctatgggaaccaggtcacggccagtgcaggagagcagactccatcctgcaggctgtggggagccatggaagggcttttggcaggacatggccactctgcaggagggatctgttgacctggctgtggagaacggagcggggacaagaggagggtggaagtggcttgggagacggtgagttgtgggctggggcaaggcacagggatgaagaggggctgtgtgtgtgacacactcagctatggaagaagccagtgctgttgaccccacttgggcatctctgtgggacccatgaggtaccttggcccactttggtggagtgcaaggccctggcagcccgagggaggcagagcaccaggctccaactcggagaccacccagctctggggacttcccaaggctgggcagagggggactcagccctggggaagctcagggtggggaggaagctggagagagcactgagccagcatctcatgactcagccacttccacccagtcagcccggtggcatctccgctcccctgctctaaattccgattcggtgagactgctggaggctgagtcagtcccggcacggcacgagagctgtgtcccaaggggctccctgccagacaccctggcccccaatcaaggccagggccaggcacggggctggagaggtggcggggtgcaggagccaggctccaaggctacagcaagtcccagcagagtggggcggcccagtgagatcacgtaagtgaacatgctttgtgagttatgaaaagctccctgttttcctcagtgggctcagggacctcattgcccgaggaagggactgggatgcaagtcctagctctgcccacctcatcgcatgacactgagaaaactcctttcccctcttggcttcaatttccttgaccacagaatggggccaacatctcccaaaggggttgggagaattaaatttaatgcatatgaaagcgctttgcaaactgtctagtgggccctatgatggtcagggtggtaggagaggagagtatgaatggcagggcttccagagagactacctagggttgtgcaggttgttcactgcacaaggatgtctagcctaaggtgctgaaatccagcccatcccatcctctgctccccaaaccgcgtaccccggcctaggactgcttggacttggtacctttctctaatatgcacaaatgcaccctgagggctagcagtggccccttagacgttcctggaggggtcaacccctggaattatgggaaatctctgagaaactgattacggatggaggggaagtggggctggttttgcagaggttcttagagacagtgcctaacctcagcagtgaggcacaacttattgctaggggcagctatgggggcctggccgggtcaagggggtagtctctcctggccctgcccctccctagcaacgaaagcaggtaaccaccaagacagtattttaaaaaacactcaagacacagacccaagccgggttttattgaaatgccaggagcaggcacatgtcaaagtagccaaggaaggggggacagtggtacaggctgtgtaagttggcagggatgggcaagcctcatgtccatggtcctggcatcccctctgccaggggataagtaggcacaactaccctcccctcaaaatggcatgctcaggccagtggggcccctacccctggaccatgaaggctccaagaagggctggaagcactaagttttctctctcctgagggggaaggaaagaaggggagatgcaggaggaaggggaggtatagcgggggatgagcgttccaagaagtctctccttctaggtgtctgcacccaactcatggtgctgggcagtggagaggagcagcattacaaagggaggctgaaggctcatccctcagggaaccggagccccccagcctgtggggcttgtgtcagccctgaacagagggcagaagttcaaggggactgaagatgcaggtagttcccaagtgacctaggagtccccagagctggggggtgtggccttcataggacaaggaggaagacaggaggatccaaccccagcatggaggggggagtgggcagtctccccaatttggcccccctaggtcagttccacgttgttggcacggtcaagcactcgggagccacgggcactacccccaagctggaaacggctctcatagagagtggggcagaggtgccagcgattggcccggtagatgcccaggtaggtgtagacatcaggcttgtaggtgagcaggcacttaatgcccgctgcacggatggctgaatccgcctccagtacacccaagcggtccgtgaagtcgtccgtgtaaacacagatgacctggcgcccaccctccttggcacgtgggctcaccttggccacctgaagctggccttcaaccacggcccgggcaatgccagcccaggcgtggtccagcttgaagcccggtgccagatgcataagccacttgcccgagagcacgtggtgggtgatggcgagctggcgcagggtacccggtgtgatgggccgcccactggtctgcagagcttcccaggctgcctgcaggccctgcacgtccccggagttggggctgtagccctgcccatacactgcaatccagcccacaggctctgagttgggtgaaccggggtccccatagcgggtaacttgggatggtgggtacttggccagccaggcatccagctcagtggcaggcgttgtgcgggcatcaaacactagccaggggtccatgtcagctgccatggcctctgcagccaggtgctcggcggtgaagccatcctcacggccacctggagagccctcctcttccagctcctcacctggttccatcctgctgtgagggaaccgagtcagggcagggtctgagacaataactacagatgccaggcactggattaaactgtggccttgagtaagagttactgtcgatgcgcctcagttgcctcatctttacaatgggataacaactgttcctgtcccgtagatctgctatgaaaattagatgcctgaggagtcagcgctccagaagggttgctgcagttattactattctccttgacttacagaaaaggaaactgaggctgagaaaaaggacttgcccaaggtcacacctgcagtgcgtggcagggccgaagggtgaatccaggcgtgggagcaaccagccccagctacacctcccggccctgccaaggcccccttttcctggcaggtatccggtgcgctggcatttaatagaggaacgcaaagaagcgcacgttcgcgcagctcccgaggccggctctgtaaggccaggcctcccaggcaggcgttatcgggcccacttacagacgaggacgctgaagtccagagaggttacaggccgttccgaggccaatggggcggttcccagactcgaaccagggcttgttagagcctgcaggagagccaggctccggccgtgccgcgcccgccgccattaacgcccacgggcccgagctgtgctcccgccccggccctgccctgcccctcccgccgcccgcagtcacctccggccttcgctgcgttcgacgccggcccagccccgggcccggctccgctcctgccgtggctccgcgccaccgccaccgcgccccacccccgccacggccgccgccgccgccgccgccatcttagcgccgcgccacctcaacaacaactttatagacaggcgcagccacagggcggagccgcgggcctcagcggccgcagcggccgcgctgtggggcggggccggcaggggaaggggcggggccgacggggaggtgctgactcgggggcggggccatcgcgggaaccccgggaggggcgggccgcggggggcggggccaacgttcgctcttctggccttgggggcgggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggtgagcacgtggcagagcccggcaggagtgggcccggctcccgggtggcttgggcccagttcccgctgggcaggcgggcgcgccgcggtgttcgggggcctggacgccccgccccctccatgccctccccgcgtccgtgtcccccgccccctttctccggggatgccccttcctcccccagcacccccttaggggacggtggcgacggggtctgaactctgctcccccacccgcaggcgcggatcaagaagatcatgcagacggacgaagagattgggaaggtggcggcggcggtgcctgtcatcatctgtatcctgccgggggcggaccgggtcgaggggcgtgggggagggaggcagcgggtcgccctctcctgccccggagttctccttgacgctcctcagcccgggcgctcgagctcttcctagagtcgctgttgaagaaggcctgccaggtgacccagtcgcggaacgcgaagaccatgaccacatcccacctgtgagcggcgaggagccgggaggggccggcgggtttggcgcggggagttcacacactgaggaaggcagagcctgggtggcgagggaggtgggcggcagccgggacaccagcaaggccacagactggcagaggagaggctgggcttccaggcagagggagccacctgagtaaagcagggcaggcccgggagcggagatcggcccgggctccagcctgacatctggggccccttgctgccacccactgcgggtttgggtgtctgggcccctcttgagtgccagcccctcctcacctcttccaggaagcagtgcatcgagctggagcagcagtttgacttcttgaaggacctggtggcatctgttcccgacatgcagggggacggggaagacaaccacatggatggggacaagggcgcccgcaggtggggccagggcctggcatacagtggggaaggccaaggccacagggcttgggggtggccaaggagtagggagcactccgggcagatggactgtaccttcccaaaggggccggaagccaggcagcggcggccggaagaacggtgggatgggaacgaaaagcaaggacaagaagctgtccgggacagactcggagcaggaggtgagtgaggccccagcccttcgccctgcccttggtgatgggacaggcagcctcgccccaggctgaactggcaggaggccagctctcatccttttctgcaacctgtttgctcactggtttatttgtaaattggggctatgagggtctactgctgtccctgccactcccagtgatgggttcgtgtcttttcttgtcaactctgacctctgcggtgctcacaggatgaatctgaggacacagatactgatggggaagaggagacatcacaacccccaccccaggccagccacccctctgcccactttcagaggtgagcagcccagaggcatgggagggtgctggcagactccccagagccaacttacccctcttgttctccctggccccttggtcttgttgattgtggcagatttgtggggtggaaggagaataactgaggagggcttgaaggcaggagactgttctcccgaaagatcctgctccaccctgccagggcccgtgggtggggcctgggcctgccctgcgtgagctgccctgggccttggccgcatggatctggagggtggtggtgggagggtcagatgggggagggagggtcttggcagctgcccctgtggagggcacggtggggctcaggcctgactctctcctgccttctgccctgcagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcaggacgtcatggttgccatcccatccacccacctgccttccccacatgaaactgggagctggggccgggtgcggtggctcacgcctgtaatcccaacactttgggaggctgaggcgggcagatcacctgaggtcaagagttcaagaccagcctggccaacatggtgaaaccccgtctctactaaaaatacaaaaattagctgggtgtggtggtgcatgcctgtaatcccagctactagggaggctgaggcaggagaatcgcttgaacctgggaggtggaggtggcagtgagctgagatcacgccactgcactccaacctgggcagcagagtgagactccatgtcaaaaaaaaaaaaaaaagaaactgggagctggggccgcgtcagtggcaggtgaggtggcagcgaggggagagaggggtcatccggggaggctggaggccctgggtctgctgagtgcaccacagctgcggacagaagggagttgggagagcttgcaagtgctgggcatgcgggggacacttgccacgtggtgctgctgacccccggtgggctgctgacccccggcgggctgctgccctgctctgagcagccccttgtctctctgatggagactgttctgccccctgtagtctgctgtgaagggataagtgggacagggaacaggtacaggtcttggaaactgtagagtcctgtgtccagtgtagtgaagggcaggtggaaaggagcaaacatagagagatggtggagggtcttgaaggtggtttttgagcagggcagtgacacagtctgttcatccagataacctttcagagcagacccaggagctgtgctgcctgtaaagcagaggtactcggtgaggctggggagggcgcaggtggcccacatggggcctcctggagcccgcaaggcattcagttttaaaggtctgctggcatggtggcatatgcctatggttccagctgcttgggaggctgggacaggagttccaggcagcagtgagccatgattgcaccactgcactccagcctgggcaacaggagcaaaactccatctcaaagaaaaagagtctgacatccccaagtactgcagaggaagaggctacacggcactcatacacagctggtggaaatgtcagtaagtacaaccacttcggaaaaccgttcagcagtttcttattaacacacacacttcccctatgacccagcaattccactcctaggtagctaccaagagagatggtggcatagggccactggaagacatgtacaagcctgtagccccaaactggaaacagctcaaatgcccatcagcaagagcaggaataagtaaatggtggaatgttgtatgatagaacagcagtaaaaggaaccactgtcaatgcaactccctgggtagatcttgtagaccttacgtggagcaaaagaagccaaacaaaaaagtacatgggccaggtgcagtggctcacacttgtagtcccagcactttgggaagccaaggtgggcagatcgcttgagctcaggagttcaagaccagcttaggtaacatagtgagaccctgtctctacagaaaaatacagacattagctgggcatagtggggcccgcctataatcccagctactcaggaggctgaggtgggaggatggctttaacccaggaggtagaggctgcagtgagctgagattgctccactgcactccagcctgggcgacagagtgagaccctgcctcaaaaattaattagtaaaaatgaaaaagagtacaccctgatgtaattcatttaagccaagctcaggaacaggaaaaactaatcaacagtgatggaagtcagtacatccataaggggtggggattggctgggggtcgggtacagggagccttctggaagtgttcttcaacttgacctgggttatgtataaaacgattaagctgtacactgaagattggtgcacttctttgataccttcctaaaagttttacttaatctttatctatctattgagaccctattgcacaccagacactgttctaggtagtagcgatcaagtgaacaaaatgttcttggagtttatttctgaagtggtgagacagacaataaagatgtatcatgccagtcatggtggctcacacctgtaatcccagcactttgggagggtgagacgggtggatcgcctgaggtcaagagttcgagaccagcctgaccaacatggtgaaacctcgtctgtactaaaaatacaaaaaattagccgggtgtggtggcagacgcctgtaatcccagctacacgggaggctgaggcaggagaatcgcttggacccgggaggcggaggttgcagtgagccaagattgtgccattgcactccagcctgggcaacaaaagcgaaacttcgtctcaaaaaataaaagatgaatcgcatgtcggatggtgatccatgctgtggggaaaataaataaagcaaaacaggcgatccagggtgataagggaggcctgcatcctttttttttttttttttagagacggagtctcgctgtgtctcccaggctggagtgcagtggcacgatctcagctcactgcaatctccacttcctgggttcaagcgattctcctgcctcagcctcccgagtagctgggattacaggtgcctgccaccacgcccagctaattttttgtatttttagtagagacgaggtttcaccatattggccaggctggtctcaaactcctgactttgtgatgtgcctgcctcggcctcccaaagtgctgggattacaggcatgagccacaacacccagctttggggggccagcattcttaactgagttcaggcaagactctggtgacagtgagcatggagtgggcgggctcacagccttccgtggggagagggctccagggagagggaacagcaagggcaaagtctgggagaattggatttaatctgtcagtttccctgtggtctcctctgctcccactgcgtcagccaccacccagggcctgactcaggggccaccagctctggactcagcccaccttagctgggaggtgtccttgtggcactgacagccccttgggcctgagaagcttggtgcaaagggagaaggaagaagcatggggcacctaccacacccctgccctgggtgctgctggacctggggccccagaggctggggaaggaggcagaaggggaaggagagttgaatgactgagtgaacctgctcgtcctctcccagcctcatccctggcctggtcagggagctgacgtgctatgggatctcttgatttcccctttccctctctgggctttgccctccacagccatgaaataggtctgcggatgcctcccccgtggttgatgggaggcaggaggcgttgcagcagcacgttgctctgtgcttgtcaggtgtgaggccaccatcagtttccctgcacccccgagccctcctctaggagagatgtcctcatacccccaccttatggatgaggagactgaggctctagaagtgacatagtggcccagaggtaggcaggggtttggtctaggcatgtatgtcgtccaggacttggagaggtggagttaacagcttaacccccaatacacacccgagggccatccctttctctggagcagggacacttggctccaggacatagacacgaccaaattcccactcaattaggctatgggccctgaggcaggggactggcacccgtgctctggacaatctaccaggggcctggtccctcccctctttggtgcagggcctttgatgagagtgggtctggactttctcggggggctccttgtatccggagagtgacagggctatgtgactgccacctcccatcatcagagtgaactatttctattctgaaatcccatttttcctattgtgtgttcaaatgtcgttttaaaaaatggaataaggactaagatttttgccagtaatcagagagctgcaaagaaaaacaggatcccacacaatgcccatcagataaaactgaaaaccggataaaacctgttgctagtgaggatgccagtgaatggaattctggcatttggtaggcatgtaagttagtggggatgtttgaaagggcattttggcagttgtgtgtcccctggcaggtccactcctgggttaaacctctcacaagcagagagatgtgtcctaggcatggtttgaggtggcagaaaaatcagtgtccatcaatggagaactgcctgggcagaaggcaacagggatagagcttaaatgcagagtgctgagtgacaaatagtcaaatagagaacaagaaacaaaaaacgcagacatacatgagaatcctttatacggcatttctgccacttactctgttaccttggacaagtgactttaagctgtctctacctctgttttcttttttctttttcttttcatttttttgagacaatctctctctctgtcgcccaggctggagtgcagtggagcagtcttggctcactgcaacctccacctcccaggttcaagcgattctcctgcctcaacctcctgagtagctgggactacaggtgcgtgccgccatgcccggctaatttttgtgtttttagtagagacagggtttagccatgttggccaggctggtctcaaattcctgatctcaagtgatccgtcagcctcggcctcccaaagtgctgggattacaggcatgagccaccgtgcctggcctgttttcttttataaataaataaaagaaaggcaagggaatggtacttgtgatccagaccctccaccacgggtctggtccctcccctttttggtacagggcctttgattagggtgggtctggacttaaacacaggtgtgtgtgtggaacagggcatggagaggtgaagttaacaacctatcccgccacacctgaggccattccttccaagttacagggatgctcggctccagaacatggacgagaccgtatagatacaaatatatatgtatatgtctctatatacacaaatatatgtatttttatatgtatatgtgtgtgcctatatatgtgtgtatatatatgtgtgtgtgtgtatgtgtgtgtatatatatgtacacacatatatatatgtatatatatattttttgagacatgggatctcactttgttgcccaggctggtctcaaactcctgacctcaagtgatccaccctcctcagcttcccaaagtgctgggattacaggcatgagccaccccacctggcctctacctctgttttcttttctttttttgaggcggagtttctctcttgtcacccaggctggagagcagtggtgctatctcggctcaccacaacctccgcctctcaggttcaagcgattctcctgcttcagcctcccgagtagctgggattacaggcatacgccaccacacccggctaattttgtattgtttttagtagagacagggtttcttcatgttggtcaggctggtttcaaactcctgacttcaggtgatccgcccgcctcggccccccaaagtgctgggattacaggcgtgagccaccttgcccagcctatctctattttctaatctgtaaaacggggatcataatagcacctccttcagggacatgtgatggtttcatgagatatgatatgtaagtcgctcagcacagtgcctggcatacagtaagcacccaataaatggtgcctgctgttatggacatttatggaaataagatcctggaaagcagattggaagggcatgtactaaacagacaaggggatgtcgtggctcaaagcagcaggagtaggactgggatgcagggaaggggagagtccattgaaaggggaagctttaggctgggtgtggtggctcaagcctgtaatcccagcactttgggcagccaaggtgggcggatcacctgaggttgggagttccagaccagcctgaccatcatggagacaccccatctctactaaaaatacaaaattagccggacatggtggcgcatgcctgtaatcccagctactcgggaggctgaggcaggagaattgcttgaacccgggaggcggaggttgcggtgagccaagatcgtgccatgggactccaacctgggcaacaggaacgaaactccatctcaaacaaacaaacaaacaaacaaaaaagaaaagaaaagggaagcttttcagggccctatggctgcatggagtgccccaaactaaggcgcatgtctgcttgattctatgcaccctgtgttgaaaaaacagaaaagacattgtcagaatgggcccaacctcaggggacagcatcacatagggcagggtaaagcatggccctgcaggattcatgggatcatacattgtcttcattcagtcactcaagaaatatttgctgagtacctactctgtgccgggccctgctctgggcttggggaaggtgaactcagagaaaacacacagagcctctgctccctagctcagtccagttgggggaaggggcagcagactgatggtaaacaaataggtacattcacgcctctccaggggtagtggggagaggggaccccgaggaggccagcgtgttgaagccgcagcaagcaagtgggtgggcagggccctggttcctccaggggggtgcggctgccctgtttttagccacagatgctcttccattccagcctggtgcccagagtcggtttcactttcctcttacccgttttcttagagtttggtttctgttttgtgggttccctgccccccttccgcctttgtctggagttgcagattagcctagtggttctcaaccctggctacatcttagaaccctggggagcttttttttctttttttcttttttttttttttgagacagggtctcattctgtctcccagactggagtgaagtggcgcgatcttggctcactgcaacctctgcctcccaggttcaagtgattctcctttctgcctcagtctccccagtagctggggaggctactcgccaccacgcctggcaattttttgtatttttagtagagacaagttctcaccatgttgaccaggctggtctcaaactcctgaccttaagtgatccacccgcctcggcctcccaaagtgctgggattacaggcctgagccactgtgcccggccgaccctggggaactttaaaatacccatatctgggcctgtcttcagttagatcagaagccctgaagatgagccttcccaaactctggtctcgtcttcttaactcggtgagaacaacggttgccctcccagtgcagtggtaggaaaatcacctatgcaatgtcagggctcctcccctttatcttccgtttttcagggatcacagccctgagctgccctttgtctaatatctgaaaacacttgtttcctgtgctttgtccagtttcttagctgtttgtagaaaaagggcaatttcagttcaccttacttcctcaaggccagaacctagagtccctcctcatcctttgaactccccaagtccttcacctgtcccctctccaagtttcttcccatgctctggctgggataactgtgcttgcaggtttcacctccacttctggaaagcgcccctcttggggacacagggcctgtcggattcacgtctgtgtctccaggatgtctcacagggcctggcacgtggtaggtacgtggtgggcatgtttttgtgcatgggtctgccctgcccttcttccttcaggccaccccaaatcatatccgtatccctagagaactgacgcccaccccactccaaccaggtggcacctccaggaccgctggtcaagataccctccccacagccattggtcaggggtggccgtgagactcaagacagcacatgtggccgggtgcaatcgctcacgcctgtaatcccaggactttggaacgctgaggcaggcagatcacctgggatcaggagttcaagacaagcctggccaacatggcaaaaccccatctctactaaaaatacaaaaattagctggatgtggtggtgggtgcctgtaatcccagctactcaggaggctgaggctgcagaattgcgagaacctgggcagtggaggttgtagtgagccgagatcgcaccactgcactccagcctgggcgatagagcaagactccgttttttaaataaattacccagttccaggttttctgttataagcaacagagaatgggtgaagacatttatttttatctttaataatgtatttaggccaattgtatgctagagagacctgactactacaagacatcattgtatgcttgccgaataaatgaaataccattgattaatttgcaaaccacattcccagtgcacctgaggtggcttccaacaagaacaaggaaggtaaaatttaaaaaacagaaatggagattcaagaatgtggatgggtgcagtggtatacacccgtgctaccagtggtgcactcccagctactctggaggcccgaggagggaggatcacttgagaccaggaatgtgagtccagactgggcaacatagcaagatcttatctctaaaaacaaaaaattttaggccgggtgtggtggctcatgcctgtaatcccagcactttgggaggctgaggagggcggatcacgaggtcaagagatcgagaccatcctgaccaacatggtgaaaccctgtctctactaaaaatacaaaaattagctgggtgtggtggtgcacgcctgcagccccaggtactcgggaggctgaggcagcagaatctcttgaactcgggagatggaggttgtagtgagccaagatcgtgccactgcactccagcctggtgacaaagcgaaactctatctgaaaaaaaaaaaaaaaaaaaaaatttaggccacatgggatggctcacaccataatcccagcactttgggaggccaaggcaggaggatcacttgaggccaggagtttgataccagcctaggcaacatagtgagaccctgtctctaaaaaaattattaaaaaattttttaaataaaataataaaatataattaaaagagaaaataaagatcagaaacaatagcatacatatataaatatgcaacccataaaggcctgtaaaagtgctttattaattcaatatcaaatttagttctgagctttctggcagccaaagcaaaaaacttttttttttttttccggagaaaacttcttcagtggaaagaaattttttcctagactttagctgcaaaagaacagtttcagatggggcctgcggtgtgatgtggtgaaggccaatctcagccgcattcgcacagccaaagcctgtaataagcctcccacaatgagtccttggagaatgggtccaggcgattcagttgttctcatttgggctcgccttgacctctcagtggctcttgtcatagttggtcgcttgcctcctctttgaaacactttcttcacttggatgggggccctcactctcttggcaatctttttttttttttgagacggagtctcgcactctcacccaggctggagtgcagtggcgccatctcggctcactacaagctccgcctcccgggtccacaccattctcctgcctcagcctcccgagtagctgggactacaggcgcccgccaccacgcatggctaattttttttatttttactagagacggggtttcaccgtatgagccaggatggtctcgatcttctgaccttgtgatccgccgcctcatcctcctaaagtgctgggattacaggcgtgagccaccgcgcccggcctctcttggcaatcttcttccccaccgtgggctgtggtcttgtctccatggccacatctccctgacctctcttgacctctgaatggtggtgggcccaggctcagacctctcccctgccctcccttcccctcccttcccctcccctcccacttcctggatgacaggccactgtttccaccccaggccctccagtctaatttctactcacagccagagggagtgcagccattacatcttatgctgccatttcctcatcgtcctgtgatcacctaaagttactaaacaaatctctattaaagtgcccagttttgtgtagtggccaaatcccagaacttgatttagaatgaagtattcttgggctgggcgtggtagtacgcacctgtagtcccagctggtcgtgaggctgaggctgcagggatcgcttgagtttgaggctgcagggacccaagatagcaccactgcactcaagcctgggcaacagagcgagagcttgtctcaaaacaaacaaacaaacaaacaaacaaacaaaaaaaacgaacacagctttttccacttctggccattgcagcccccactgataaggagtcagggaagtcgggtctgcgcctctccctggccccattcccaggcttgagaagacgctgcctttggagaacagggagggagggcagtgggtgcagagagtgcatcctggattgacactggtgtaagatggcatctcactccttgggtggcagctgtctaaagctggctcctgccctcaggggttttatgggctcccttatgtactacccccttgactgaaactcctggcaaaggggcagcccctctctgttgactggctctggttttctttcaagtggcatgcactaccccactctgttgcataccctgtgccagagaaaacaagcccgtggggccagacccctttttccattcctgcggtccagtgcccactgcaggtcacctcctttctggaggcctttcctaccaatgacccacgggggtgccatgactgcaggaagcccacctcaagcgctctggggggcttccttgaagcacttctcaccagatttgaggttagaaggcagctccccagctccaccccctgcagactcactgccatagcagctctttccaaatcaaatcaccgcaaactgcccctttcaaatccaccctcgatccctttatactcttgcggtggatgaggggcttcgacagtggcaacatgggtttctgctttctttaaaattttgcagtttggccaggagcaagcacttcactttggcatttcatatccattccattctagagcctcagtcaaatattcttgcacgctgttcatccttaggacaaacccagaatcctttccctggctcccaggccccacgtgatctgactcttgagcacccccccatggaggtttatttatttatttttttgaggcggagtctcactctgtcgcccaggctggaatacaatgacgcgatctcagcttgctgcaacctctgcctcccgggttcaagtgattcttgagcctcagccttccgagtagctgggactacaggtgtgtgccaccatacttggctaattgttttgtatttttttagtagagacggggtttcaccatgttggccaggctgatctcaaacctctgacctcaagcgatctgcccaactcggcatcctaaagtgctaggattacaggtgtgagccaccgtgcccagccccccatggaggtttaaaatatcaaaataccaacctgggcacagtggcacacacctgtagtcccagctactcaataggatcgttctagcccaggaatttgagtccagtctgagcaacatagcaaaaccccatttccaaataacataaaatatcaaaataccaaaaaacattacaaataattgtatgttggtaaatatagaaacttaagcaaagtaaatacctttctggaagaatgtgaaatgtcaaaattggcacaaaaatatcaaaacttcagtagacccataaccaggaaagaaaattgagtagctcatgcctgtgacctcagcactttgttttattttgtttttgagatggagtctcactcttattgcccaggctggagtgtggtggcgcaatctcggctcactgcaacccctgcctcccattttcaagcgattctcctgcctcagccttccgagtagctgggattaaaggcgccagccaccacgcccagctaatttttttgtatttttagtagagacagagtttcaccacgttggccaggctggtctcgaactcctgacctcaggtgatccacctggctaagccttccgaagtgctgggattacaggtgtgagccactgcacccgtcctaacctcagcactttgggaggctaaggcagaaggatcatttgaggcgaggaatataaaatcagcctgggaaacatagcgagaccctgtctcttgggaaaacaacaacaacaacaacactacaataggccgggcacagtggctcacgcctataatcttagtactttgggaggctaaggcaggcagatcacctgaggttgggagttcgagaccagcctggccaacatggtgaaactctgtctctactaaaaatacaaaaattacccggatgtggtggcacatgcctgtaatcccagctacttgggaggctgaggcacgagaatcacttgaacctgggaggtggaggttgcagtgagccgagatcactctactgcactccagcctgggcgacagagcaagactccatctcaaaaaaaaaaaaaaaaaaaaaactaaaagaaaaagaaacttgtaatctgagactccaatgtgaaaaaacccaatagaaatgtttttatagggcagttctaccagcctttggaggaacagatggtccttatctcacaccagttgttacagaagccagaaagagagaaggctgcccaatttcttgtatgacccccgcaagccagataaagacagtatcagaaaagtctgtacacagagcatttcgttatggacacagatgttaagcgtaaactaatagaatagaatataggaaaataccccacctagggataggaaaagaaagactctcaaaatacaaagctctattcaaaaacatttatgagtctaactccatcaaaattaaagattttttttttaccagacttaaaaaaagattaaggatttctggccaggcacggtggctcacacctgtaatcccagcactttgggaggccaaggtgggtgaatcacttgaggtcaggagttcgagggcagcctggccaacatggtgaaaccccatctttacaaaaattagccagtcgtggtggcacatacctgtaatcccagctactcgggaggctgaggcaggataattgttttgaacgtgggtggtggaggttgcagtgagctgagattgcacaactgcactccagtctgggtaacagagcgagagagcgagaatccgtctcgaaaaaaaaaaaaaagtaccagacctcattttatgaccccagggttagtcaaaattcataaggtgaataatgtcaatgtttggtgagaatgtgggcagacagaaatccttggtcttctgtaggcacataaactgacagcccttctctcaagcaatctgaaattaggtgtatgtttatgccaagaccttacactctcagccttggataagtaggccagagagattctcattcaggtgtacaaagaggcatgtgcagcggtgttgaccacggtgttctttgtgagaacaggacttgggagccagtctggcatccattgtcagaaggatgaattaagtaaagcatacaaagggaaactacggaacactatgcaacagtcaggatctacaaggcttttaaaacacagtgcgggccaggcacagtggctcacgcctgtattcccagcactttgggaggccgagacgggcggatcacctgaggtcagcagttcaagaccagcctggccaacatggtgaaacctggtctctactaaaaaataaatacaaaaattagctgggtatggtaacgcaagtctgtaatcccagctacttgggaggctgaggcaggagaattgcttgagcccgggaggtggaggttgcagcgagctaagattgcaccactgcactccagcctgggcaacaaagcgagactctgtctcaaaaaaaaaaaaaatcaaaaaacaaaaaacaaaaacaaaaaccacagtgttagcagcggagggtggcatgtgcccataatcccagatacttgggatgctgaggcgggaggatctcttgaccccaggagtttgaggccagcctgggcaatatgagaccttgtctctaaaaacaaaacgatggggcatggtgattcatgcctataattccagctttttttttttttttttgagaaggagtctcgctctgttgcccaggctggagtgcagtggcatgatcttggctcactacaagctctgcctcccgggttcacgccattctctggcctgagcctcccgagtagctgggactacaggcgcccgccaccatgcccggctaattttttgtatttttagtagagacggggtttcaccatgttagctaagatggtctcaatctcctgacctcgtgatcctccctcttcggcctcccaaagtgctgggattacaggcgtgagccaccgcgcccagcctaattccagcttttatttatttatttatttatttctgagatggagtcttgttctgtcacccaggctggagtgcagtagtgtgatctcagctagctgcaacctctgcctgggttcaagtgattctcctgcttcagcctcctgagttagctgggactacaggtgtgtgccaccatgcccgactaatttttgtatttttagtagagacgggatttcacagtgatggccaggcttgtcttgaactcctgacctcaagtaatccacctgcctcggcctcccaaagtgctgggattacatgcataagccaccttgcccagcctgattctagcattttgagtaggcttaagcgggaggagtccttgaggccaggagttcaagattagcctaggcagcatagtgagacctctgtctctccaaaactaatttttttttaaagtagccaggcatggtggcacatgcctgtagtccaagctactcaggacgttgtggttgtggtagaggatcacctgagcccaggagttcgaggctgcagtgagctataatcacaccactgcactccagcctgggtgacagagtgaggccttatctctagaaaataaaataaattttaaaaaccctaaagcacagttttgaaggaaacgagtaaggaacaaaaatgagatcaatactgcttatgcaaattaaatacatacaataccatttatttatttttatacttagttttattttttatgtttttcttgagacagggtttcactctgtcacccagactggagtgcagtggtgtgatcatagctcattgcagcctcaacctcctgggcgcaggtgatcctcccgcctcagcctcccgagtagctggaactacagggacacgccaccatgcccagctaatttctttgtatatttttgtggagctggggtttcaccatgtttctcaggctggtctccaactcctgaactccagcaatccacctaccttgacctcccaaagtgctgggattacaggcgtgagccactgcacccggaccacaataccacttacataaacaaaaaatacatacacacaaaaatgataaaagcttcacaatgatccgttaacatctttctttctttctttttctttctttctttctttctctctctctttctttctttctctctttatttatttatttttttcagagtcttgctctgttgcccaggctacaatgcagtggcatgttctcagctcactgcaacatctgcctcccatgttcaagcaattctcctgcctcaacctcctgagtagctgggattacaggcacgtgccaccacgcctggctaatttttgtatttttagtagagatggggtttcaccatgttggccaggctggtttcgaacacctgacctcaagtgatccacctgcctcggccacccaaagtgctgggattacaggcatgagtcaccacgcccagcctattcacatttaaataggatggagcggggatcaaagatgaagaagaaaatacaaaggcaaaacaagagtcgcattgcatccattgatgctttttgtatgctgtgaaataaggaatacaataaactcagctatctgctccccaggactaatgcagaagagaaatgtgcaaaggacatggacaggaattcacagaggtagcacaaatggtccatggagataggaaaatacttgaacctcacaaataatgaaggtgtggagacaaaaatgaccccatcttagacgtgaatccgccatgctgacttctgaatagctgcagtcccgtgaatacctcctgattcctactctatttactgcccttagcataagactatgtccaccttgatgttatcacaccaattataggctataacgtatgcagattcttgcctgttctggagggctgcctttaattgtcttgcacagaacactcataccctttccctatggtacataagccttggctctaggatgacaggcacggagatctgtttgtctcgtggctgcccaagaccaagcttgtctgtaaggtcacccaaataaatcaccctgtaccagcaaactggatttgtctgccttgttctttggtttctctgctccttcagcattcgggagctgccttgcatatctggccctttcatgaaagagaagagaatacaagttattgcaacaatgcaataatagcttttcatctatcagattagcaaagtgaaaattataattgctggtgagggtataaatactgttgatggaaatctataatgattgagcctttagggggaataattaggcaccatcaagatctaaatggcttagagctagctagtttgcttatagaacattaccttgcagaaatctcaagacacatttccagggatgtccgcagctgcagtgtctggagtgaggacgcaagcggaagcagtcccggtgtttgacaaaaggacacaggtgatgtacattaggtgggtcagacagccaaacagtgatgatggtaaagactgggtggctctgtatgtcctgacatggaaagaatataacattctagtaggcaaaaccaggatgatctcatttttgttgaaaaatatgtatatgtaggtttgtatacacacacacacacacacacacacacacacacacacacacgtctatctctaaaatcacaagatattcaaatggtacactggctcaggtcttggttttgcatcggaggccaaggacaaagcaatagccccagggccctgcattgctaatcaggtgccaggcccccttgcagtgaggacaggacactcctgacctcaagtgatccacccacctcagcctcccaaagtgctgggattacaggcgtgagccaccgcgcccggcccagactagacatttcaatttcaatttctgaggctgttcttagtgatcagaggacttttcactacctgaggtgacttgagaagtcatagtgcctgctcacgtcttatccaggcctgggaacggcttggcccaagggggagtgggtgggtggaaaaggatgcagctgtctctgtccgaatgctgcaccccgccttgctcagggtgtcagttccacatttgtttgtgctcacaggggaaaaacacgggccaaatacacacccaaaagttaacagcagttctactgcacagatttaatttttttttagacagagttttactcttgttgcccaggctggagtgcagtggtacgatctcggctcactgcaacctctgcctccctgattcaagcgattctcctgcctgagcctcccaaagtagctgggattacaggcgcctgccaccacaccctggtaatttttttgtatttttagctgagacggggtttcatcatgttgaccaggctggtctcgaactcctgacctcaggtgatccacctgcctcagcctcccaaagtgctgggattacagctgtgagccactgcacctggtcatatttaaatttttgacagtgtgcatatattacttctattatctgaagaaccaataaagatgttttctatctgtacatgtatttattattttattgtattgtatttcattttattttattttattttattttattttttgagacagtctcattctgttgcccaggctggagtgcagtggtgtgatcttggctcactgcagcctccaccccctgggttcaagcaattctcccatctcagcctcccgagtagctgggactacaggcatgcacctccatgcccggctaatttttttgtattttaagtagagacagggtttatccatgttgcttgggctggtctcaaactccggtgctcaagccatcctcctgcctcagactctcaaagtgctgggattacaggcgtgagccactactccaggctcccattgcaggttttaagcagaagtctttaaaaaatggcccaagctggccgggctcggtggcttacgcctgtaatcccagcactttgggaggcagaggcgggtggatcatgaggtcaggagatcgagaccatcctggctaacacagtgaaaccccgcctctactaaaaatacaaaaaattagccgggcatggtggcgggcgcctgtagtcccagctactcgggaggctgaggcaggagaatggcgtcaacccaggaggcggagcttgcagtgagccgagattgcgccactgcactccagcctggacgacagaacaagagactccatctcaaaaaaaaaaaaaatggcccaggctgctgggttgggaattgaccatgaagaagcagaaagtctatgtagaagacaacggatgttgagaatgctccaaatagctggtggtaagcgttcagattctgaatgcactttgaaatcaggaacaactgttggataggacatagcatttcagagagagaaaagcctaggcttttggttcgagaaactagaaggatagcatagtcactaggccaagatggagagggctgtggggagggtcagggagtcagtttcagagttgttgaatgtgagatgcctgttagacacctagatggagcagtggactgggtcattcgagtttgggaggcaggactcaccttctgagcttgagggagatgtctggactacagataaaagtggggttcattgtctgatagattttatttaaaatgagcctgtcatgcctgtaatcccagcactttgggagtctgaagcaggaagatctcttgagcccaggggttcaagaccagcctgtgcaacatggctagacgttgtctctacaaaaaatacaaaaaatcagctgggcatggtggtgcacacctttagttccagctgctcaggaggctgaggcgggagtgtcacttgagcccaggaggtcgaggctgcagtgagccatgatcacgcaactgcactccagtcagtctaggtgacagagtgagaccttgtctcaaaaaaaaaaaaaaacaaccaaaaacccaaaaacacaaaaccatggtcctggtgagtccagtaaaagaggagctgtggccgggcgtggtggctcatgcctgtaatctcagcactttggaggccgaggcgggcggatcacgaggttaggagttcgagaccagcctggccaacatagcgaaaccccgtctctactaaaaatacaaaaattagccaggcatggtggtttgcgcctgtagtcccagctacttcggaggttgaggcaggagaatcacttgaacctgggaggcggaagttgtggtgagtcaagatctcaccactgcactccagcctgggcaacagagtagctgtggacaaagaagacagacggggcagctgtccctctcctgcaagaggaggaggaactggcagaggagctggggaagagctggccactgacctcatgttagtgggagggaaggcatcggtgattttggcaggtgcaggctcacagggtggtgggggtgacagcctgcctggagtgggttcaagaaagaaaggcaagggggaaattgaccttgcccagtgaaaactctttcagaaggctttgctgcaaagggaacacagaaatggggcagtgttgaagaaggggaagtgagtcaagaaagaaggaacagtagtgctgatggaaatgatgccagagagatgagacattgctgatgcaggagagagtgggaggacggccggagccacatcgctgagcaggcaatcagcaaatgaatgaatgtgtgtgaagcggtgataagagaagcagagcaaatggtggtgcctattagggacttaggggatctgggcagggagggcttctttggcaggtgtcattttagcagaaacctagaggtcctgaaggagtaagccatgtggattctggggagagagcatttcaggaagaagaaacagtcggtgcaaagggccttagggcagactggctggcgtaccgaagggagagtgtggttggatcggagtgagaagggatcatggtggcacttgtgagcaaacacctgtgaaacatgcaggacctagtgggccagtaaggactttgccttttactcagcgagacccaggacccatcacaggcgtgatggactctgtttttttttttttgttttttttttttagttaaggtcttgctctgttacccaggctggagtgcagtggtgcaatcagggctcattctgcctcctgggctcaagtggtcctcctaccttaacttctctagtagctgagatcacaggcatactccaccacacctggctaattttagtattattttttgtagagaaggggtttgccatgttgctcaggctggcctcgaactcctggcctcaagccatccgcctgcctcagcctcctaaagtgctgggattacaggtgtgagccactgcgtccagctgggctctattcttcacagaatcacactggttgctgagtagagaatggtatcaggacaaaagcaaaaaccgggaggttgggtgtggtggctcacgcccataatcccagcactttgggaggctgaggcaggtggatggcttgaggccaggagttcgaggccagcctgggaaatatagtgagctcccatgtcaataaaaaataaataaataagcaaaagccggagattaagcgttactgaaatgatccagaagagagagggtgttggtttggagaagtgctggattctgcatgtatttcaaaggtggagctggtagggtttgctaaggcattaggggcagaatgtgagtcaaacgaaagagtcaaggatcatgccagggcgttgacctgagcaacaggaatctcagacatgcccctgactgggatgaggcaggccagtagtctgaccttcagcatgtcaagttgaaatgcttatttatccaagtggggatgtcagatgggccactggatatttaagtatgggagaggtcaggctgagatacgtaaacctggggacgggtggaaaacagcaggtgctggcctggcgcagtggctcatgcctgtaatcccaatgctttgggaggccgaggcaggccaggagttcaagaccagcctggacaacatggcaaaaccccatctctaccaaaaaatataaaaattagccgggcatagtggcgcgtacctgtagtcccagctactcgggtggctgaggtgggaggatcacttgagcctgggaggttgaggctgcagtgagctgtaatggcactactgcactccagccggggtgacagagtgagactctgtctcagaaagcaagcagcaggtggcttttaaggccatcagactggatgagctcacttagggagggagtgtggtaaaggaaagaggtctgtatgcacctcatgagaatatcaacctgagaaacccagacctgccctctgccaaggaagaaagtggcccagagttctggactgtccaggaaatcacctggggttgaggtctggaaggggctccgtttctgaaagtgaagctgcctacatgtgccttccactgggccccaggtgtgggagaaggatggcagccccctagaaagaaaagagtttgcatattttgggtggcaaaagagcttcacccggagcagcactatttaggatatttacattggatgtgctcattgtgaggtgccactgggatggagtctgagagcagaagaggagccacagggccacagtctgagaaaaatcctgcctctatggcatcttccaggatagtctgcttccctggggccacatcattgattaattaataacagcaacacggcccggtgcagtggctcacacctgtaatcccagcactttgggaggccaaggtgggtggatcacttgaggtcaggagttcaagaccagcctggccaacatggtgaaaccctctctctactaaaaatacaaaaaattagccgggcatggtggcacatgcctgtaatcctagttacccgggaggctgaggtgggagaatcgcttgaacccaggaggcagaggttgcagtgagccgagatcacatcactgcactccagcctgggcaacagagcaagactccatcacaaaaagaaaaaaaaaagataataagaataacagcaatgctaacatagcagttcccatgagccatgaggatgttctgtttgtatctgcatagtgatttaatccttaccactaccctgggagtagatccgattataaccatcccctccccattgcctatgagaaaacaggcaccgagagggtacgggacaagtggaggagctgggatttgcacccaagcgcttcctctatgctcttagccatgatgctctgctgcctcaaaagaacggccagctagtgttagtaataataacatttaccgatgtcatcgtttggggtttcatgtagtccttgcaacaaacctatgagctgggcccgtgattccagttttgcagagtggggagttggtcacagagctagtgagaccaggcctccagcccagttggtccgtctccagggcctcagctcagcaccacatccctgtactgcaagcctcagtggtcagcaccaggcgtcccatggggacttaagattccaaggcttttgagcactgctagaagtttggggtaagatcttttactttttttatattaaaaaaatatatttttttgagatggagtctcactctttcgcccaggctggagtacactggtgtggcctcggctcactgcaacctccacctcccgggttcaagagaacccggagagggagagcctcagcctcccgagtagctgggattacaggtgcccaccaccatgcccggctaatttttgtatttttagtagagatagagtttcaatccaggtgggagatggggtttcaccatgttggccaggctggtctccaactcctgacctcaggcaatccgcccacctcggcctcccaaagtgctggaattacagccactgcccggcctggggtaagctttcaatgttgtaactccctccagaacctcatggcctatgaagatggccaggtgggcctgggcccaggctctgaatggcctgctgcctctctcctggacacagcattcaacttcctggctggggctgggagtgcaaagatttgtttatttgtttcttttttattgagacagagtctcactctgtcgccctggctggagtgcagtggtgcaatctggggtcgatgcagcctctgcctcccgggttcaagtgattctcgtgcctcagcctgagtagctgggattacaggcatgcgccaccaggcctggctaatcttttttgcatttttggtagagatggggttttgccattttggccaggctggtcttgaactcttgacctccagtgatccacctgcctcagccccccaaagtgctgggattacaggtgtgagccaccactcccagcctgggagtgcaaggatttaaataaaatcttgtgaaagttcagtttggctccttcagggactcggccaggccggggggcagcacaggagacaggctgactcccctgtacagatggatggggaaacacaggcagagtagggacaggggacttacaccaggtcacacggggagcctgtggatgaggcagaggcaggacttgggcctgggtctctgcgctaaatgactcctgggcatcctgctgaactctctcccagaaggagattggcctcacataccccactgaccccttcctagcatgctttttgccagacccattgagactggctgaggactggttgccatagagatggcctgttaggcagttctacggtgcggatgggggatggggcaggatggggcaggacaccgatatgctaaatacctaccaacagttggttaggaccccgtcggtgtgaccagggcaggacgtgcggctccaggctccaggaaccagaacggggctgctcaagctgctgtcgaccgtctctcaggacaagcaggtgagggaggcccagtgaggacacttccagctgcctagagccaggtgggtcagggaggcctgggctggggaggcccttgagaagccacaagacctgagctgaggtccagatgaaactcagggaggcaggagtgggacagggaccacagggaggcctaagggccttgggagaagccgagggatgacgcccaggagtgactcccagggatgatggggccattcagggaacactgcggaaggagcaggtttcaggaaagatgaagaccaccttgatgaagaccaccttggtttctgccttggctgtagcaggtccagggcccagtgggacatttgggagtgcagtccagggcccagaggtggcctagcgcaatggtgacaaatctgggctccaccacttcccagctgtgtgacctcagttactcagcctctctgagcctcagctttctcctccacatgatggaggtgatagtgagtaccggcctcctagggtccttgggaaggttacgtgtgtttatgcatgaaagtcctgagcacacaataggtgctcagcaggtggcagctgttgctattttaatatgcagaacggaggtggtgctcggtcgggtttttttgtttgtttgtttttttgagatggagtttcactcttgttgcccaggctggagtgcaatgacacaatctcggctcactgcagcctccaactcctaggttcaagcgattgtcctgcctcagcctcccaagtagctaggattacaggcgcaggccaccacactcggctaattttttttgtatttttagtacagatggggtttcgccatgttggccaggctggtctcgaactcctggcctcaggtgatccgccccccttggcctcccaaagtgctggggttacaggtgtgagcaccacatccagccctgtttggttggtttttatggtaacgagggcccagagggacccagccaggcccagccaggtgcacagagggagcacccgggtgaggtgcaacacagtccaggaggctgctcaagctggctgctcctcccctactgtctctgcccagggctgcctggggagtggtgatggtgtgccaaatcaagacctgcagcagaggtctcagagctcaaggcagacagcaaagaaggaccgcaagcccaggggccagagcaagaaaggacagggctctgaagagtctgaagagtaagcagcagtgggatgggtcaggaggctgttgggggtcagggccctctgggggctggcgccgaccctgacccccaccctttccttcttcagtcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctggggcggtgtctccatccctactggcaaaggggagctaggatcagagccccccagtggtctccagctgcctgggaggaggccaggatcaggatcggcgtccgacaagcaggtccagctgcaaagcctgggtgctgaggaggccgagaggggtctgagttctggggtgctgccccagcgccccaggagggggtcgatctcagaggaggagcaattttcagaggccacagaggaggctgaggagggagagcacaggactccctgcagaaggagggctggttgtcagagaaaggggcagatttctggagaggaagcctccgatgagggagaagtgcagggccagagccaggggagcagccccagcttcaacaacctccgaaggcgacaatggaggaagacaagggccaaggagctgcaggggccatgggacctggagaagctgcacaggcagctacagagagacctggactgtggtgagcgtggggctcagagcctggattcccccgaagctacaccgcagggaacagggagcagtcagggaggcaggggctcaggcaggctgggctgtgctctgggtgctggggggcgttgcctggtgggctgagagggagagggcagcccctgacttggtcccactgtgggcaggcccccaaaagctgccctggaagactttgagggctgccttccaggcctccaagcggaatggaaaggcctatgcctcgggatacgatgaaactttcgtgtctgccaacctccctaatcgcaccttccacaaacgacaggaagccaccaggtaagagggaagagaagggagtgggagcccagaatgagaagtagagatggagccacttctccaagagatgcttaggcatttgaactctcattcatttctttatttatccattcaccaaacttttggatcatccatccatccatccatccatccatccatccatccatccacccatccatccatctatccaactactgataacatccactcaaccattcatccatctctctcaatacctggccaattatctattgatacaaccacttttatttcccatcttttgttccatccatccattaaattattaactaagtgattaatgcaacgtttattatctactcatgggcccttaggatataactattaaaagacttggaattagctgggcatggtgacacgtgcttgtagtcccagctactcaggaggctgaggtaggaggatctcttgagttcaggagatcaagactgcagtgagctatgatcccaccattgcattcagcatgggcaacagagtgagacactgtctctaaaaaagaagttaaggggccgggcgtggtggctcacgcctataatcctagcactttgggaggccaaggcgtgtggattgtctgagctcaagagttcgagaccagcctgggcaacatggcgaaaccctgtctctactgaaaatataaaaaattatccaagtatggtggtgtgtgcctggagtcccagctactcaggaggctgagacatgagaatcacttgaacctgggaggcggaggttgcagtgagctgagattgcagcactgcactccagcctgggtgacagagtgagactctgtctcaaacgaacaaacaaacgaacaaaaaacccagcctggtcaacatagctagacccctgtctctacaaaggaaaaaaaaaagattagcctggcttggtggaaagtgtctgtagccccagctactccagaggctgagtcaggaggatctcttgagcccaggagatcaaggctgcagtgagccatgatgacatcactgaattttagtctggacaacagagcgagcctctgtttctaaagcaaaggagacagtgggagctgaaggggagactggaggctgtgaggagactgttggcaacactgaggtgaggaaccaagaggccctgtggatggagggaggggatccatttaagagacacttagaggctggttcaataggccatggtgactggtgacaggaggcatgtgagggcaggggagagttcattcagcattcttatagcaccccacaattttttttttttttgagatggagtctcactctgttgcccaggctggagtgcagtggcacagtcttggctcactgcaacctccgactcccaggttcaagtgattctcctgcctcagcctcccaagtagctgggactacaggagcccaccaccacgcctggctaatttttgtatttttagtacagacggggttttactatgttggccaggctggtcttgaactcctgacctcgtgatctgcccgcctcggcctcccaaagtgctgggattataggcatgagccactgcgcccagccacaattctttttttaaaatttattttatgtaattgataaataaaaattgtatttatggtgtacaacatgaggttttgaaatatgtttatattgttgaaggtctaaatcaaactaattaacatatgcattacctcggtttttttttttttttttttttgagacagagtcttgctctgttcccaggctggagtgctgtggtgtgatctcagttcactgcaacctccgtctccagggttcaagcaattctcatgcctcagcatcccaaatggctgggattaccggtgcctgccaccacacctggctaatttttgtatttttaatagagatggggtttcaccatattggccaggctggtttcgaactccagacctcatgatctgcccgcctcagcctcccaaagtgcggggatcacaggcgtgagccaccactcccggtcttacttgatttttttttttgtagtgagaacacttaaaatctactcttttattgatttttaagtatacaatacattgcttttaactacagacaccagatcatacaatagatctcttgaacttatttctcctctctaactgaaatttcttatcctttgaccaacatctcccttcttctccccacaaacccagtgaggacttggtaaccaccattctactctctgcttctatgagtttgactttatttatttatttatttatttagagacagggtcttgctgtgttgcccaggctgcagtgcagtggcacaatcatggctcactgcatccttgacttccagggctcaagtgatcctcccacttcagcctcctgagctctaggactgcagtcatgagccaccatgcctggctaatttttttttttttttctgagatggagtcttgtctcactgttgcccaggctggagtgcagtggcgcgatctcagctcactgcaagctccgcctcccgggttcacgccattctcctgcctcagcctcctgagtagctgggactacaggcacccgccaccacacccagctaagtttttgtatttttagtagagatggggtttcactgtgttagccaggatggtctcgctatcctgacctcgtgatccacccgcctcagcctcccaaggtgctgggattacaggcgtgagccaccacacctggctgctggctaatttttaaaattttggtagagatggggtcccattatgctgagtttgacttttttaagatttggcacataagggagattatatggtatttgttttcctgtgcctggcttatttcacttaacatagtgtcctccaggtttatgcatgttgttgcaaatgatgggattttcttctttttaaggctgaagaatgccattgtgtatatataccaccttttctttatccattcttctgttgatggaatcttaggttgatctcatatctttgctactgtgaatattcctgcaatgaacataggagtacagctacctcttcaacatactaatttcatttcctttgaatatgtacccagaagtgggttgctggatcacatagtagttctacttgtaattttttggggaaccttgatattgttttctataatgactgtactaatttatattcccaccaacagtaaacagagattcccttttctccacatcatcaccaacccttatctttcatcattttggtaatagtcattctaacaggcgtgaggtgatatcttattatcattttattttgcatttcccagatgattagtgattagtgatgaaaaagacatttgtatgtctttttttgagaaatgtctatttgggttatttgcttattttattattattattattattattattattattattttgagatggagtctcgctctgtcgcccaggctagagtgcagtgccacgatcatagctcactgcagctttgaattcctgggcacaagtgaccctctcacctcagcctcctgagtagctgggattacaggtgcatgccaccacatccagctgatttattttttaactttttatttgtagagataggtgtcttgctatgtggcccaggctggtctcaacccctggcttcaggtgatcctgctgcctccacctcccaaagtgttgagattacaggtgtgagtcaccatgccctgactctttgccttttttttttttttgagatggagcctcacttcgtcacccaggatggagtgcagtggcataatcttggctcactgcaacctccccctcccaggttcaagtgattctcttgcctcagcctcctgagtagctgggattacagacgtacatcacgaggtctgcctaatttttttgtatttttttagtagagacagggtttcaccatgttggccagactagtctcgaactccagacctcaaatgatctgcccgccttggcctcccaaagtgctgggatttcaggcaacagccgtcgcgcctggcctttgcccattttttgagttatttgctttcttgttactgagttacttgagttcacatattttggatattaaccccttttcagatgtatggtttgcaaatattttctcccattctgtatgtcatctctgttgattgttgccattgctgtgcagaagcttttcagtttgatgcaacttcatttgtctattttagcttttgttgcctgtgctttctgggtcatagccaaaaaaccattgcccagacaagtgtcgttaagctttcttttgtgtgtgtgtgtgtgtgtggtgtgtgtgtgtgtatgtgtctgtgtgtgtgtggcagagtctcaatctgtcacccaggctggaatgcagtggctcaatcatggctcactgcagtcttgacttcctgggctcaggtgattctcccaccttaacctcccgagtagctaggactacaggtctggtccaccatgcctggctaattttttgtatgttcagtacagatggggtttaaggctgaagaatgccattgtatatatagaccaccttttatacacaatatatacacaatatataccattgtgtatatataccatgttgctcaagctggtctcaaactcctgggctcaagcgatccacctgcatcagccccaaagtgctggggttacaggtgtgagccaccatgcctggcctttttttttggctcaagattgcttttgctgtttggagtattttgtggttctatattaatttaaaattgttttttctatttctgtgaaaaatgtcattggaattttgataggcttgcattgaatctgtaaattgctttggataatatggacattttaacaatattaattcttccaaagcacccttcatttcttttttctttctttctttttttttttttttttgagatggagttttgctcttgttgcccaggctggagtacaatggcgtggtctcggctcactacaacctctgcttccctggttcaaacaattctcccacctcagcctactgagtggctgggattacaggcatatgccaccacgcctggctaattttggcatttttagtagaaacagggtttcaccatgatgaccaagctggtctcaaactcctgacctcaggtgatccgcctgcctccacctcccaaagtgctgggattacaggcatgaaccaccgtgcctggcctggaagcaggagacttctagaaagagtagggaaaggccttgagctgggaccgagggctgagcctccagggcagtctctgtcatggacttccatgacaaaccctactcccaggacactggctctggacactgcagcccctccccacaggcttccatattcccttatccagcccctggccctccgtgaggctcctgctgcccgtgaacctctcattccccttccctttctcacccaaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggtagggagcctgggcttcgggaggcctggttgggagagggcagggaggccgtgtcaggtctcagtctacaggaccgaggagcaccagccctcgccttccctggggctaaccaggccacttcaccgcgtttccagataaggacgctgaggcatggggagaaggggtctgtcgaaggccacccagttaataatgacaatctctgcagctgttgaatggtcaaggttaaaatattctacatgtatgatcacactttcaaatcttcattttctgatttccaatgccagacatgcttgttataaaatttcaaagattacagaaataatgcctggagaaggtgaacagccgtgtgaccccactctgggagacaaccattgttcacagtcagctgaagagtcgcgttttgttctcttcctatattgtgaccattttcctttttttttttttttgagacggagtctcgctctgtcgcccaggctggagtgcagtggcgcgatctcggctcactgcaatctccgcctcccagcttcacgccattctcctgcctcagtctcccgagtagctgagactacaggcgcccgccaccacgcccggctaatttttttttttttttgtatttttagtagagacggggtttcaccgtgttagccaggatagtctcgatctcctgacctcgtgatccacccgcctcagcctcccaaagtgctgggattacaggtgtgagacactgcacctggccgtgaccattttcctaataagcagatttgtgggcaaacgtttttggactcctaacaggtccgtgaagcagggagtattgctgctggtgggccaggtcaggttcttcccttggccgcacaaaagaaaaagtttattgcaaagcaaaggccaccctgaccaacatggtgaaacctcatctctactaaaaatacaaaaagtagccaggtgcggtggcacatacctgtaatcctagctattcgggaggctgaggcaggagaattgcttgaacccgggagatggaggttgcagtgagccgaaattgagccactacactccagcctgggcgacagagcaaaaactccatctcaaaaaaaaaaaaaaaagcccaccctgaggactgctcagagggagagacggcagcttgtgccttaagaggaattccttttatggaagttgtttatacctagtcacaaaatactggtgaggtcaggtatgcaaaggtggacctgtggtgggcgcatgcgctcagcatctgcatgctccaacacgcatcacatgtaacattagcatatacaatctctacctaggggtgtgtttttttaccatcaaaacgaggaaaatgttgctataagctaaaccttgagcctagctgtgtatgcggaaccccgagaagtccttagctccctccaaggcaggaatttgtagctaatagcttcttgggcttttggtgctgattggctggagatcggggaagctacattatgaataaggggcttttgttttttttttcctgggctgtgctaggtatgagggaacttgtagccatctggtatcccctaagactgcttatcttgcaaaagagttaggtactcggctgtacgccgtggctcacacctgtaatcccaacactttgggaagccgaggtaagtggatcacctgaggtcaggatttcgagaccagcctggccaacgtaatgaaaccccgtctatactaaaaaatatatatacaaaaattagctgggcgtagtggcgcgcgactgtagtcccagctacttgggaggctgaggcgggagaatcacttgaacccgggaggcggaggttgcagtgagccgagactgcaccattgcactccagcctgggtgacagagaaagactccgtttcaaaaaaaaaaaaaagagttaggtgctgatgcacgagggcacaggggctgcagagctcctgcgaaaggagcccctggggcttcatacaaggggaaaagtcagtacggcccgctcaccttactatcctaccttggtatctccacctgcataaccccaccggtgaggaacctgaggctcagagatcttcaataatttgtcaaaggtcatgcatgggcagcagaattgggttccagccacgatgctgccctgcctgagcactcaaatcctccgcttttagacgaaaggcaccaggaccttcccccaagagcccaaaccaatgacacatgtaacacaaataaatcaaataaatatgaccaaaaccagtgccattgatttgagcacctcctgggtgcagcgggcgcagggcatctttttctgcaccctgtctcctttggtccgtggcaagtggggtgagggtcctgccctgccttaaggccactgacggctcagcggggttcttatcacctactctttgaggctcagtctttttttttttttttttttgagacagagtttcgctcttgttgcccaagctggagtgcaatggcgcgatctcggctcaccgcaacctctgcctcccgggttcaagcaattctcctgcctcagccttccgagtagctgggattacaggcatgcgcctccacgcccggctaattttgtatttttagtacagacagggtttctccatgttggtcaggctggtcttgaactcccgacctcagctgatccgcccgcctcagcctcccaaagtgctaggattacaggcgtgagccaccgcgcccggccgaggctcagtcttaatcaccccaattttacagatttggaaacagaggctctgaaaggtcaagtgtgttttgggggactgcttgggccaatgtttagggggatcctttctccttcccaatcttgctctgttgcccaggctggagtgcagtggtgtgatctcagttcactgaaacctccatctcccgggctcaagcaattctcctgcctcagcaacctgagtagctgggaccacaggtgcgcgccaccacacctggctaatttttttgtatttttggtagagacagggtttcaccatattgccccagctgtctcagactcctgacctcaagtgatctggctgcctcggcctcccagagttttgggattacaggcgtgagccaccgcgcccagccaagtgttttgttttcacagtgaggcaggaagtgtaaggttcagaactccaagtggcaggtgcagcaaaaagagtgattcaacctcactccttttactttctatttgagagggctaaggcataagtaggtatctcccatgcagtctctcagccattacagcctatgaacttcgctgtctgagcggaacaggagactctgtcctgcctaggaagggcaggcacaaaagaggttgtcctgtgggagggagggatgtgtctccttccattctgagatgatggacggggctgacacccataggcaccacttccctttctgctcagggctcctgtcattgtttttttgagacaaagtctcgctctgtcgccaggctggagtacagtggtgcaatctcgcctcaccataacctccaactccccagttcagacgattctcctgcctcagcctcccaagtagctgggattacaggcgcacgccaccactcccagctaacttttgtatttttagtagagacagggtttcaccatgttggccaggatggtctcgatctcctgacctcgagatctgcccgcctcggccagctcctgtcacttctaacagaaatagcataaagtatccagcaggaaaagtgcacacaatatcacagaaaagatagggactgccagctcatttcccacctccccttgtaactgccataaattccttcctaaatggtgaaagccgtttttgcagtaacttgtgttccgggccatgggttttcaagtccatgtctttttctcaatgaaggatggttccttccctggcacagggccacagcaagggtggcatggcccagcaaggctgagtttttccaccgggcccagcacaatcgctgaggtcccagtacaggtcttggggtcttgtctgtgtctcccctcccctcctgtcctcttgtctgcgtcttccctcccctcctgtccatgggtgctgcctccacacctcaaggcctctcttacatgcttcacagatggatgcctggtcccatgtgggtgtggctcgaaggtccctcttgctgctagagtgctctcttcatgagtggcagtgatactcaagtttgtcaaacagacacatttctgacaagtgcacaaactgggttttgggttttttgagacagggtcttgctctgttgcccaggctggagtgcagtggcacaatctcagctcactgtagcctagacctccgaggctcaagcgatcctcccaccttggcctcccaactacccaggactacaggtgcataccaccatgtctggctaatttttgtagagacaggatttcaccatgttgcccagtctggtctcaaactcttgggctcaagtgatccaccctccttggccttccaaagtgctgggattacaggtgcgagccaccacgcctggccaaattgggtttttataaatgaaaattgtgcttccccagtggaaccctgatctctcaggggtgtgttttttaaatttgaaacatatttttttttagtttctctgtcccattttccaagctgtctgcttacaagaaccacagagaatgctggcaagcttgtccgatccctactatagcacagtgaaataaactgagcccagagccaagagcccagagagaggcctcacccaaagtcacacaaccaacaaccacagctccccctcaagggaaagaggatggggaggggaagctatgtaagcacgtgtctggaagctcagaagccagcactggcccctttcccatggggctggcacaggaggatgggcaagccccagctgcacagggctcggcccctcacttcccagctgcacaactttgaacaagtccctcaaccctcccgatccatccgtaaattgggtgaataatttccaccttggctgacttcacaaggaatccaggcaagaatgggaatgaaatagctttgtaaaggtgagggtgaggacatgaatatcaagtccttagtgaagataagcgggctcaggaatggagatcaacagttgtgtccatggttagctgcacaaaggcctgtctcccctgcaggcgccaggagcgacagcgctttgctgagtaccaggcggagctgcaaggcatccagcacagggtgcaggcccggcccttcctgttccagcaggctatgcaggtgaggctggcacctgggcaagcacatagctgccccctgtgaagagctggctgagtgggtagggaagcaggatgcgagtaggtccctgcagataggatcccagggctgctgccctctggaatccctgggaccccctcagtaacccgatccccaccttgccctcggcagccctggtgcagagcaggaagccgtcttctctctcctcaggccaatgcccggctcaccgtcactcggcgcttctcccaggtgctgtcagcactggggctggatgaggagcagctgctgtctgaggcaggaaaggtggacagagagggcacccccaggaaacccaggtgagtctccccgtcaggtcaagaactgactctgccatgctgctgcgggaaggggcgcccacaccagcactctgggctctggagggcctcccccaggacaggcagagagcccagaggaaggcaaggccagggttgtcattcctacttctcaatgaggaaactaaggacctgaggggaagggccttctttaaggacgcaggagcgaacaagcagcagaaccagtctgggactctgcaaccatctgagcggccacacaccaagtccctcattaggggctggcaccaccacgctggtcaccccatgccttagaataacctggtacagagcagcgattatgaagcccacttgacaataaggaaagtgagactcgagaagagtcactttgcccaggatcacacagcaagccggcactgaagcagggtttgaagccacattgtcagtggtttccttgggcatgggggtgggagctgcagagtcaggggcctctatctgtgtcttgaaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggcaaacacagtatgagatttctggtggtgggggtggtggaagctacgggttggaagttggaggtggcaggtgggtgggcagcaggcttagctctgtccccgcaccccctccccaccaggagctttggctcttttggttccccccacccagtacacacagccccttctctgctcctgaggagtggggacatctcaaagagcaagagctgtgacttctccaccccatctccaatgtatatgttgggtcctataaattcaagcatgaataagatgaaatgactcctgcctctgaggacgcccagtgagtgggagagggggtggatccttaaaggggcgcatacaacatagcctaacacatgctgagttgtgccacacagggagccacagactgagcaaccactgggtgaggggaggggtttcaggagagattgggattgtgtgcactgcgctttttttttttttttttaagacagagtctcgctctgtcaccaggccggagtgcaatggtgtgatctcaactcactgcaacctctgcctcccaggttcaagcgattctcctgcctcagcctcctgagtagctgggactacaggtgtgcgccaccacacccagctaatttttgtatttttagtagagacggggttttaccatgtaggccaggatggtctcgatctcttgacctcgtgattcgcctgccttggcctcccaaagtgctgggattacaggcgtgagccaccgcgcccggcctgcactggggttttaagtcccaatagttttaagttagggctggtctcctcaagaaaaaaactcatacacacagatgtgccacattttgcattcaatttcaggggttccagggatacactgacgcccatgtggagctcctaaacaatcttaacagttcacggggccaggttttaaaaatccaatccagggccaggcgcagtggcgcatgcctgtaatctcagcactttgggaggccaaggcgggtgtatagcctgagctcaggagttcgagaccagcctggccaacatagtgaccccaccccctacccccgctccccaccaaccatctacaaaaaaatacaaaaattaaaggggcgtggtagcgtactctcgtagtcccagctactgggaaggctgaggtgggaggatcacttgagcccaggaggtcgaggctgcagtgcgctgtgatcacgccactgcactccagcctgagcaacagagtgagatcctatctcaagggaaaaaacaaaacaaaacaaaacagggaacgtgggaaggaagcgttccctgacgatactggttatagcgggtctgaagctgggctgtggaattggagatctcgggaaaacaacacccgttggagccacgaccctaggagtccactaagcgagcgcccattgtaggagggaggtgtctacggaaagaccgtgaggtagtgaacaccccgttgccggtgaagtgcaagcgcagggaggccggggaggaacttaaagccacgaagacactgacttaatgggctctaagtccttccagttctgggatcccacctccgggttaattccgcttcccttgaggagcgcatgcgcaatgggaccactcgctcaaagaacccacccgacccgagacggcgcgaatgtgcagtcgagcgctgatcccggccttcccatgagcctctggggcaggctccaaggcgagcgacggaagcagccgctcttagtttccggcaacacgacagcggctgccgagcgacccggaagtattcccattttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccggtgaggaggcggggcctgcgcagggggcgggtcgggcgggggtcccggaacgcgtgggtctgggtgtgcgcgcagtgtcagcgaagctcttcaggccaggaaacccccaagctgtttaccagctctattaaatagtctttctacgggatcccttgagcccaggagttagaggctgcagtgagctgcggtcccgccagtgtactccagcctgggcaacaaagcgagactctgtctcaaaaagaaaaaagtctttctacggttgtttaggattagaggttgactttctccactcagctgcttgaggacagagggcttctgttttcctcagttgtctggtacaatcagattctcaataaatatgttgaatgagtgaatgaagtagtgtcagcatatacagaggcaagaaaaacctggtattggacgaatcgtgtagggcgcatggtagagaaatgagggagtaagatagacagggatgtgaacacaaaggaccctgtactgtagtctctgttaagaactgtagattgtcttgaggatagtagggagccatggatgtgagttgaggagtgagttgctcagatccgtattttgtaaacatcactggattgagaatttagtcaaaggtagtcaggactggagaccaggaaaccaggagggctataggccaggggagggctgatggtggcctgcaccaaggcagcagcagtgggattgagagaagtggacaggttggagaggtgttttggaggaggaatgaacagaactcagcacttgtatgagggtgggaagaaggaatggaggatgactccttgaattttggcttgagcagccagataggtagtgggtgtcatttctactgaaattgaggagtagggaagagaagcagatttggagcgggggtggggggagatagttcacttttggggttgtcaaggttgatggtaatggggaaatccagagtttggactggataaagccattgggagtcagtatctgggtggccagtgaagcccctgaaagactgtgacatgagaagagggggtcaggactagaacctgagaaatgcccttatgttagtagtaggcagagaaagatgttaccaaaaaaaggagacagagtaaccaaaaaggcaggaaaacctttgtgtcatgggaactttgggaagagagtattgttagaaggagggagcgatcagcagtcccacataccacaggagatcaagcaaaaccagaaccgaaaagaacccactagatttagaaacgaggaggctggtgaccttggggagcctggagaggttgggatccatggcccaggtggagagagaagcctttaagataaaggagaaggtaggatgcaggatgggaatgcaggaaaggaagagttttttttttgttttgttttgtttttttgagacaaagtcttgctccattgcccaggctagagtgcagtggcacgatctcagctcactgcaagctctgcctcctgggttcaagcaattctcctacctcagcctcccgagtatctgggattacaggtgcgcaccaccgtgcctggctaatttttatatttttagtagagacggggtttcaccatcttggccaggctggtcttgaacttctgacctcgtgatccatctgcctcggcctcccaaagtgctgggattacaggcatgacccaccatacccggcccagaccttgtctgttaaaaatgaaagaaaaaagtagagggcagagtggtgactacagcagtttggatgtcttgggtcaggaaaggaaggtgcacagaagaggcagggctctgagactggactcgggcagaggagctgctggggagcttgggtggaagaagctgctgttttctggtgtttcagcaggcccaggtgctggtgaggggccctcatttttgttcctgcagctggagccaacgatgctggcttcttggccctgtgttcagctcctgagccatgcttcttcttgttccagctgccagctccaaaactagctcaggcgatgcctcctcactcagcatcgaggagactaagtgagtactgtctcccttgtttctactttgtttttctaagagaggtggctctggggccagcacgggggaggctttctcacatgaaagtgtgctaatcagagttggaaagattgtttaaatcatcttagccaacagttgacttatagaagagaaaactaaaacctaagagtaaagtggcattcactggttagacgcagaccaggctggtgcccatgtttcctgctttggaggccagggcccttcccagtgtcctaggctgcctggggcagactttgtgtttgggaccactcactcccaccctgtttctcctcttgtctgtctggaaatgcacatggcaccctgtgtctttaatagcccctaacacttgtatctcttgttgtcagcaaactccgggcaaagttggggctgaaacccttggaggttaatgccatcaagaagggtgagtatggggctgaggatagggtttgggggaaagaggccatctgaaggggtctttgaagaaggtggggttagagggcaggttcagcactgtttagtggtcttacacatgcatatttgccggaaggcatgaggtccctccttgctggtataatggggatctggggctccgcctgctctctgagttggagctgtggccgtcgcatactcactctggctgtgagttgttagatggactggaagatgtgcacacttgctgcagactgcgctgtgcgggggtgggtttcttgtttttctttaaagcacgatttgaggggctttggaagccacagagggtcctgttgtgctgcatgggttggccaggagtgtggggacgaagtgggagcagggaggtgaaggattgttccttcctgtcctgaccccttctggccccctgagctggaagggggcagggtgagtggctccctcctctccccaccagccatgggcgggcatagcctcacgtctgggccccccttccagaggcgggcaccaaggaggagcccgtgacagctgatgtcatcaaccctatggccttgcgacagcgagaggagctgcgggagaagctggcggctgccaaggagaagcgcctgctgaaccaaaagctggggtgaggggtcctggccagggcaggcaagggaagggctggggaggccaccatccttggctgcctcttgagtggggtggggagcaggagctgggctccttgagcatcactttttcccctcttcaggaagataaagaccctaggagaggatgacccctggctggacgacactgcagcctggatcgagaggagccggcagctgcagaaggagaaggacctggcagagaagagggtgagcacctgggcagcatggggtggtcgcctagtgcttctggtggcctgacggcactgaggcgggggccaaccccagagaggtgagacggggcttggagaagggaagggccgtggtcggtagcatctactttggattctcagcagctttcctgcaaggcctgccctttttgcactccgcttggtagagccctgagtgttttctggtgatgctgagtggcctgaagtcctaggtcacccctccctgtcccgtaggccaagttactggaggagatggaccaagagtttggtgtcagcactctggtggaggaggagttcgggcagaggcggcaggtgaggctgcagcaggggtggtacaggggacactggtggccttgctaccggaatcccgaggttgggtgcgtggagggaggttcctgactcgccgattcttcccttaggacctgtacagtgcccgggacctgcagggcctcaccgtggagcatgccattgattccttccgagaaggggagacaatgattcttaccctcaaggacaaaggtaatgcgagctgggtgccctgggtgggggcacagcctctgctgagttgcggacaagtgtgaatggccactgctctgtgctgcccccaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcaggcacggcctgggcaggctgggtggcgggggctgaggtggagaatgtcgggaatgggggctctgaggaggtggtggctcagtggcttttcaggagccagcctgggtcccaacctgtacctcttgccttgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgagccctcccgtgccttatactcggggtcaagattctccctccctctggggctcctgccctgcccgcaggcactgagaagacagggcgagtatttgtgttcacaaagcgcttggcctcgcgggtgagcactaaatggcaaccgggggaggcaccaggtgtggatgggtcagggctgctgagccagatgggccccagtctgtttcggctctgccatgctgccagctcgtgccttggataaaccatttaactgtgagcctggggcaccccatctggaatggcagtgacaggagccgcctcctgaggttgctgtgaggatgagtgacagcgtgggtgaggggtgactggagaggtgtgcgtggattctgtccacagggtgactgtgtgaacgtgaggtagacagctggcgcggtaggcgtcttcctcagtgggtaagagcaggactctggagccagactgcccagctctcccacctaggagctgggcaaccttggggaaggtacttaacctccctgtgccccagtttccctagctcaccagtggaattgagatagtaaccaccccacatgttgctcatgtgtgggaagcgctcaggacgctggctagcacagaggaacaccaaagaagtgttcaccctcgagggcttgtggcgacctgcctttctgtggcccccgctccatgtctcgcccctcttcccttaaggtgacctttaaaaagaccaagcggagggtgaagaaaatccgcaagaaggagaaggaggtagtagtgcgggcagatgacttgctgcctctcggggaccagactcaggatggggactttggttccaggtgggcttggacacggtggtggggcgagatggctgggctggggtggcctggggaccggtgctcaccagagaggcctccttccctcagactgcggggacggggtcgccgccgagtgtccgaagtggaggaggagaaggagcctgtgcctcagcccctgccgtcggacgacacccgagtggagaacatggacatcagtgatgagggtgagggcccggccagggggtgggaggggcagggacaggagccgcgggttggaggagatggtctgagcaggcatcccctgtgtttcccccagaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtgaggctgggcatgggcagggtgactgcgtcagcagtcacctgtcctcacgagcacctgtgtcataggcgacagccacattcctgtctgaagcctcttttccatttgttttttgttttctgggtttgttttttttttttttttttgagacagagtttcgctctttcgcccaggctggaatgcagtggcgcagcctcagctcactgcaacctccgcctcccaggctcaagtgattcttattcctcagcctcctgagtagctgggattacaggcgcacgccaccagacccggctaatttttatatttttagtagagacggggtttcactatgttggccaggctggtctccaactcctgacctcatgatctgcctgcctctgcctccgaaaatgctaaaattacaggtgtgtgccaccgtgcccagccctctattctgtttaaagtcatgttttgcaaaaatttttagatgcctgctttagtaggggatcctttccttgcctctctcttctgtgcatgtttgttgaatgcctgctgtgagtagtgcattgttcttgggctgagaaggtcattggtgaacaggatagccatggggccctgggctcatggagctggctttctagagtgtgtgggggagagcgtggggagcagcagtgactgttaatgcaggaacggtaatttctgatggtggtgggagctgggcactcagtaaaccaagataacgtgccgggggttgggatcttagatgggagagtgcagggaagacctttccaaggtactagttcatctgagacttgagtcacacagaggagccagccttgcggggggttaggggtggcagcaggtggacaggctggcatttaggcagtagaccaaccagcaggtgtctcaggagaagtgaccttagagtgcctgagggccagggaggctggagcagagcagagagtgaggggtggcgtgagctgagatggagaggtagggggccaacgcagggggagccttgaccccatggtcgtcgctgccccagaggcacagtgggccgggcactgctcacatgttctgtgtttgttgattcattccatcctcccagcaacaccctatgaggaaggttctgtcatctccatcattccagaggccacacttttagccctaccccacacttctcacctaggaagaagccaagaaagcgtgtccaggagagggagcaagggagggaagcttctgatactactgggaggcaaagtggggacagttgcagtggattcaggacccggaggacaggggagttgaaaaagtgagggctgaacccgggacggaggccaggcttactgttgaagggctggagaggacgtatttgaggtttaagggcatatggtctctgttaggcaccttgaatgctgtgctgttatagggaaaacagccaagacagtctgtaagtgagtgggcgtggctgggttccagtaatactttatttctaagaacaggtgttgggacatagtttgcccggctaaaaaggaacagagaaatggagcaataggctgacagggctgttttatgactgaaatgaacataagggtttctagccccgtggatctcagcctgcctgcacattagactcacctaggaggttgtttttgttgttgttttaagaaacaaggtctcgctcggttgcccaggctggagtgcagtagtgcaatcatagttcactgcagccttgaactcctgggctcaagggatcctcctgcctcaggctctcaagtagctgagactacaggcgtgcgcctgtgggtctcagtgtgttgcccgggctggtctcaaattcctgagctcaaacgatcctctcgcctccacctcccaaagtgctggggttacaggcatgagccaccaggcctggtgtagcctagaaagtttttgttgttgtttgagacggagtctcgctctgtcaccaggctggagtgcagtggcgcgatctcggctcactgcaacctccatgtcccgggctcaagcaattctcctgcctcagcctcctgagtagctggaactacaggtgcatgccaccacgcccagctgatttttgtattttttagaagaaacagggtttcaccgtgttggtcaggctggtctcaaactcctcaccttgtgatccaccctcctcagcctcccaaagtgctggaattagaggcatgaaccaccacacccggccacctagaaggttttttaaacatatgagccacaccccacacactgtgcaggcaaaaaagtggaaagcctatcacagtgaacacctttgtcctctagagtcagtaattataaacattgttacagttcttttctttctcttctttttttcctgaccactgggagttgcagatatcatgacactgcatccttaacgacttcagtaggcatctggcgaaatcagggccttctcccgcatagccacactgccctaacaagcccataaatgctgtaaaacagcagctcgcatgccaacattttccagttatcccccaaaatgtctttttagttttttgttgtaagcagcatccaatcaagtttcccacccgcaaaggagccttttctgactaccggagattctagagtatgtgggagacacatttatgacggaagaagaaaaagatctcggcaggcggtgctggggcctagagtgcaagtggagggtgggcttgagtgaagccagctcgtgtcatcatttatttcaggagggaaggtggggagggcacagcagctgtgggtgaccttgtttaggggaagtcaaggcagcccatggccgattgttctggtgtttttccagtgaagaggtggcagaggtggtggtgcaaagagatgggagatgctgttctggagagtggagagcagatacaccctgggagaagagcaggcctgccagtggcagtgtggatggtgggattcatgagctgaggagggggatggtggaattcatgagctgctgagggagggggatggtgggattcatgagctgaggagggggatggtgggattcatgagctgaggagggggatggtgggattcatgagctgctgaggagggggatggtgggattcaggagctgaggagggggatggtgggattcatgagctgaggagggggatggtgggattcatgagctgaggagggggatggtgggattcatgagctgctgaggagggggatggtgggattcatgaggtgctgaggaggggggtggtgggattcaggagctgaggagggggatggtgggattcatgagctgaggagggggatggtgggattcatgagctgctgaggagggggatgggattcatgagctgctgaggagggggatggtgggattcagaagctgaggagggggatggtgggattcatgagctgctgaggagggggatggtgggattcatgagctgaggagggggatggtgggattcatgagctgaggagggggatggtgggattcatgagctgctgaggagggggatggtgggattcaggagctgctgaggagggggatggtgggattcatgagctgaggagggggatggtgggattcatgagctgctgaggagggggatggtgggattcatgagctgctgaggagggggatggtgggattcatgagctgctgaggagggggatggtgggattcatgagctgaggagggggatggtgggattcatgagctgaggagggggatggtgggattcatgagctgaggagggggatggtgggattcatgagctgctgaagagggggatggtgggattcaggagctgctgaggagggggatggtgggattcaggagctgaggagggggatggtgggattaatgccctgaagcagtggatggtgggattgaggattgggttttctagggaggagggacaaggcagttaagggtttcacaaaggagaggttctgttgatttccccctgagtctaaactgggtaatgagggacataacagagaatgatgggtgtgaggacagggcctggagtcgtgatgtggttgaagaattactggattgaagttaatacagtcaatgagctagaaagaaaggctggagagaacagaaaggatccttggaattgaggggttgttttgttttgtgatagtgtctcactttgtcacccaggctggggtgcagtgactctatctcagctcactgcaatttccacctcctaaaggtgctctgtccacatacagtcattgggggttagggcttcccgatatgaatttaggggttacacaattcctagataggacaatatattgtcaagatgtccatctcatgtagttcatttctaggttaaatgcaactccagtaaaaatcccaatagggattattttggaagctggaaaatgattctgaaattggataaagtaggggcattgtggcagtgtgggattgcataaggatagactaacagaacagagagaccagacagcggggccccgagacagaatcgtgtcccagtgggaagagtcgctcgtcagtgcagcgagtgggcgtgggacagtcagttatctatttggggaaaaaatgaaattgggtttatacctcacaccttgcagatagattaagaacttcaaagtaaaaacttcacatttcggaatcaaattaaggaaattacatttataactttttggtagaaaagattttttaagttgtcagcatagccaaggcaggagaattgcttgaggccaggaatttgagaccagcctggggcaacacagcaagaccaccccccctaccaaccccatctctaaaaatgtttttttaattagctgggcatggtagcatgtgtctgaagcctcagctacgccggaggctaaggcaggaggattgcttgaatctaggagttcgaggttatagtcagctatgatagactatagctgactatatcacagatagctatgatagcctgggtgatagaacaagatcctgtctcaaaaaaaaaaaaaaaccaagaaacccacaggttccatgggtgagtttcttcaagaaaccatgaagaaaaaagtgaacgtgtaactacatagaaattgagaacgtggccgggcgcgatggctcacgcctgtaatcccagcactttgggaggccaaggcgggcggatcacgaggtcaggagatgagaccatcctggtcaacacagtgaaaccctgtctctactaaaaaaaatacaaaaaaattaaccagacgtggtggcgggcacctgtagtcccagctactagggaggctgaggcaggagaatggtgtgaacccaggaggcggagcttgcagtgagccgagatcgcaccactgcactccagcctgggtgacagagcaagactccgtctcaaaaaaaaagaaattgagaacgtaagttttttgttttttgtttttttacaaaacataccatgaagaatataaaaaggcagaccaaaaagagaagatatttgcccatatataccaccaagaatgggttggtgtcaagagtatacaaacagacaaaacaaatcaacacaacaggaaaataggcgaaagatgtagataagacaggcagttcacagaagagaaagcctaactcaccaggaaaatacccggtgaatccagtttcaggagggatcacagaaaggtgaaccaaaacagtgaggcacctgccacctgccaacaattccgcagaaaggtccaagcctgacagtagcgagtaggagtaaaggacatggagcggccagagtcctcagccacgctactcacagccatgggcaggagtctaatcagatgagagggaatgtgtgcgtgcccggggcccaccccacacctctcccgagtgtgcccatgtgcaccaggagacattgtcagtgggcctgcagccgcagtacttgggacaaaaaaagtccatcctcagtgggctagagagccagatcaaggagcatccagctcacgggctgtgattccatagtggaaactgatgagctacagccgtgtgcatcagggttactctcaggggcacagatttttttacaaaacaaatcacagaagagtcatacagtgtgactcaggttatagaataattaatacacaacaaaataactgttcaggggcaggtccttatgtgctaaagccatgaagacaagccggtgagtcatgaccatggatggggaggggacactcaagtctgggcagggcattagtgatgctgccccagccccagggagagggacatgggtgtgtgtttagttaatgttttaaaaactatatcagccgctgggtgcggtggctcacacctgtaatatcagcactttgggaggcctaggcaggtggatcacaagatcaggagattgagaccatcctggctaacatggtgaaaccccctctctactaaaaaaaaaaaaaaaaaaaaaaaaaattagccgagcatggtggtgcatgcctgtaatcccagctactcaggaggctgaggcaggagaatcacttgaacccgagaggtggaggttgcagtgagccaagatcgtgccacttcactccagcctggccaacagtgagactctgtctcaaaaaaaaaaaaaaaaaaaaccatatcagccgggtgtggtggttcacacctatagtcccagcactttgggaggctgaggtgagtggatcacttgaagctggttttgggaccagcctgggcaacatggtgaaaccctgtctctactaaaaatacaaaaattagctggttgtggaggcatgcacctgtagtcccagctacttaggaggctgagggaggaggatcacttgaacctgggaggtggaggttgcagtgagcctatatcgccccattgcactccagcatgggtgatagagtgagatggtctcaataaataagtagcatatgatgcattagatatacctcgttttatgtttacaatgttcattaaaaaataagtgttcctggccaggcgcggtggctcacgtctgtaaccccaacactttgggaggccaaggcaggcaaatcacgaggtcaggagatggagaccatccaggctagtacggtgaaaccccatctctactgaaaaaaaatacaaaaaaattagctgggcgtggtggcgggcgcctgtagtcccagctactcgggaggctgaggcaggagaatgctgtgaacccaggaggcggagcttgcagtgagctgagatcgcgccactgcactccagcctgggcgacaaagtgagactctgtctcaaaaagaaataaaaattaaaagacaaacaaacaaacaaatgttcctggatgtcctggaagactttttttttttttttttttggagacagggtattgctctgttgcccaggcttgagtgcagtggcaagatcacggctcaccatagcctcggcctccaggctcaagcaatccacccaccccagcctcccaagtagctgagactacaggcatacaccaccatgcctggttgatctttgtgttttttgtagagactgtgcttcaccttattgtccaggctggtctcgaactcctgggctcaagtgatcctccagcctcggcctcccaaagtgctaggattatagatgtgagcaaccacccggcccctggaagaattttttttttttttttttttcgagacggggtttcactcttgcccactcttttgagtgcagtggtgtgatcttggcagccttgatctcccaagctcaagcagtactcccacctcagcctccccagtagctgggactatgggcgtgtgtgaccacaatgtctaatttttatgttttttgtagagatgggatttgggtatgttgcccaggctggtctcgatctccggaactcaagcagtccacccgcctcagaagatttttttaaaaaaatgaatgtaatataaaatgaaagaggggtgcagaagtggacatagtgactcgaaccttcactgaggagtgaggactttgctgtctgggctgcagggttgagggagaagttttttaaagaggggagatggtaatcattgtgtgtggctgggcatctgcgacaggagggaaagcagagggtgctggtgcccgtgtgggggtcgctggattcagtgctggcagcatgagtgagttctcttcccatgtcacggaacctgctttcttggtgaagcaggaagcgagaagctgggctgtgggaagtcaaaagcgtgggccacctcaccaccctgcgggttctagaagtgctgtctagagtcctgaaaccggagtttgtcgggggaggggcaggtggcaggagggagcctggaggaaggagtttgaggctgaggtagtgtgtgaggggctttggagggggattggcacaggcctggtcaggaaggccctgtaggatgttgggtattcattcaaagggcatccaaacccattgatgggtttggagcagaagagtgaccccagtgaaagaggtgcagagtggagttaggcggcagatagcagctgggcctgcatgggctgtgggcgtggcctgtctggctgctgccagggaggacccttaggttcctgggtctcaatggcatcaccccagaaactgctgggtttgcccacagccgctccctcccccaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggtgcgtctggggcggccccgccctctgcttccctcggctgggtgggctggctggggcctgggccgaccctggtcttttgtgccccaggactttgaacgggatgaggagcgctcagccaacggtggctccgaatctgacggggaggagaacatcggctggagcacggtgaacctggacgaggagaagcagcagcaggatgtgagggccgcgccgctggggggtgggcgtttgggggtgctcaagctggagatgagcaccgggctcggtgtccagagcctcagcctcctcatccagagtgggctctgcagacctcccagggcgatctgaggagtaaatgaggaaattaaatgttgtggagggctggtgcctggcaggtggtgaccagtgggtggggctgagaagagccggtatggcctgctaaccacccccgccacgtgtcccgtagttctctgcttcctccaccaccatcctggacgaggaaccgatcgtgaatagggggctggcagctgccctgctcctgtgtcagaacaaaggtagggagctcagggcagccatgacttgggtgggcttgggtgctgctgcaggtgcaggcagggccccctccggtcccctctgctgcccctttctctcagtcccaatgctggagccagctgtccggcccagagccactccttcccctccactgtggcatctgtccgtctgctctgcctttgaggctccacacctgcttggggaaggagaggggagttgaaactgttccagctgtggcacagagagccctggtgttaggaccccagctctgccatttccctggccagtgacccttggcaaggggctcatttctgcatctttgctttgcctgtagaacaggcctgatggctttccagaggcaaggaaagggaggtgcccccacagggcctgctctgccttctcaggcggccctggagctgtggctctcgaggggttgggagtctcacaacccctccatccctagggctgctggagaccacagtgcagaaggtggcccgggtgaaggcccccaacaagtcgctgccctcagccgtgtactgcatcgaggataagatgtgagtgtggtggggcctgtgcagggctgaggggcctgtgccagcttggagcttcgggaccacagcaggcggcagctcctcacactaaggcctcctctgtctcgggccagggccatcgatgacaagtacagccggagggaggaataccgaggcttcacacaggacttcaaggagaaggacggctacaaacccgacgttaagatcgaatacgtggatgagacgggccggaaactcacacccaaggaggtgagcagggccttttgcaggcggaggcccggcctgccacagggaggccaagcccagggccatgcaatgccccgggccatgcaatgccccagggtcctggctccaccagcctctggctgggggcctggtgaatgccacggatggggagggggccctcagggctgaggaaggctgtgcctcagtttgtctctagtgggcacagcagtctctttgcaagcctggcaggagggtcagacaggcactcgggacctctgccctcctgtcctcacctgcgtgagcccttcactggctttcctggcccgcagggccattccagcgtccaggcccttccagcactctcgtaggccgcccgaccgtcctgccctaccactcagctgcccccttgctctctggggtttgtctccctgcagccccagccccagccccagcgtccaggcccagcccctgcgtggcaggtctccaggttccccatgctctgcccccatggcagcgcatccactagccaagctggtctcccggcctctgctggggccctgcagggtgccagcgtctgtgctcttttcccatccccttcccactgcaccccaggcctggcattggggtcaatcaacacccgccctgttattatacaccttgtgggcacaggtggctccggccccacccagggccctgcatctcctctcatgccccgcgtccccaggctttccggcagctgtcgcaccgcttccatggcaagggctcaggcaagatgaagacagagcggcggatgaagaagctggacgaggaggcggtgggtgcccttggggatgtggggggccctgtgcctgccggggcaggggtggctggtgtgtggggcctgctgcagccctttctgagtggccccgacccctcagctcctgaagaagatgagctccagcgacacgcccctgggcaccgtggccctgctccaggagaagcagaaggctcagaagaccccctacatcgtgctcagcggcagcggcaagagcatgaacgcgtgagtggctcgaggctggtggggtagggtgtggtggggaggggtggcgtggcctgtgcccgcctctgcagcctcacgcccctgttcttctctgcaggaacaccatcaccaagtgacagcgccctcccgccccggccctgcctcaaccttcatattaaataaagctccctccttattttttcctccctggtcgtggtacagattccagggttggatctttggttgggtgtggcacagagtctggctcctgctaggtgagacctggccatcaaatgacacaaacaactaaacgatggaagagagagcgagcccgggtcctctaaggctccttccttctcccctggctgtcggtcacacctctgcagggccggctctctgatagaaagtggaaggcggttttagaaactcatcaccctgctctctcctggcctcgggggctgcacaggtcactgtcctgtaatgtctcccggtcagggcagcccaggactgcccagcctggtgggctggggattgggctttgggtagggcacaggtgccaccttctgtcctggctgtcctgtgccaccctggtctgtgtctagaggagtgaaactcccagggttgggctgggagtatttggtgcacgcggtatggggagggctgagctcagtgcctcctgggagacttgtcccgtgtacagtgacccagaaagatgagattccttggcctgaactctgtgatagagtgtgactgagctgctgggggacatgtgagcctcaaatccatagaaagacaaacggccaccttgggtgcccaggatactggtgcctggccccacgtacacccacatacttctcagatggctcccacattttaagattttaaaaatgaaaccaaaaaataaattgaagaaaactgtaaactttaaagaataatcagctgggcgcagtggctcatgcttgtaatcacagcactttaggaggctgaggcaggaggactgtttgagcccaggagtttgagaccaacctgagtaaggtggcaaaaccccatctctaccaaaaatacaaagattagccaggcgtggtggtgagcgcctgtagtcccagctacttgggatgctgaggtgggaggatcacttgaacctgggagacacaggctgcagtgggccctgattgagccaccacactgcagcctaggtgacagtcagaccctgtctcaaaaaaaataaaaaaaatttaaaataatcttggggtgaggaaactgtagacaaggtgcaaaacccagtagcctgaaaatgcatggttggcattgatgctgtcgcttctgcacggctagagctgcggggctgagtcttagcctgaaaatgcacggttggcactgacaccattacttctgtgcagcgggagctgcggggctgagtctttgggtgcccttccttgagctctgtattctctatagtttgacatctgactcttgattctgttttcaccttggctgcttccttggcttcctcaggaagggtgtcctggggtgtctaggctgggactaggacttggggcagtcacagtctgtttctctcaaaagcctaggaggaggctgggaacagtggcacatgcctgtaatcccagcactctgggaggctgaggtggatggatcacttgaggccaggagttcaagaccagcctggccaacacggtaaaactccgtctttgactaaaaatacaaaaaaaaattgacatgtaggctgggtgcggtggctcacgcctgtaatcccagcactttgggaggccaaggcgggtggatcacgaggtcaggagatcgagaccattctggctaacacgttgaaaccctgtctctactaaaaatacaaaaaattagccgggcgtggtggcgggtgcctgtagtcccagctattcgggaggctgaggcaggagaatggcgtgaacctgggaagcggagcttgcagtgagctgagattgcgccattgcactccagcctggtcgacacagcgagactccatctcaaaaaaaaaaaacaaaaaacggcatgatggcaagtgcctgtaatcccacctactcagtagaatcgctggagcccagggggtggaggttacagtgagccgagatggtgccactgcactccagcctgggtgacagaatgagaccctgtttcaaaaaaaaggaagcctaggaggtgcttccagggttgggactgggcagtcaggtgtccctggcatggaccccaggccctggcctactgtccaagtcacaccttgacgtctgcaggaaatggcccattaggaggctgtcaaagctgctgtcacagctgaaaatgaccgcagcctgggctagagcccaggtggagccagggtagaaaagaccagcttcagctctgcagccgactaactttctggctctagtaactgggcagactacgtggtgaaccaggggcctcctcgttcgcgccatcttgcttcctctctgcatctctggctcttggtcctagcccagagacttcccttctctgccctggtgtactctgctctgctccccagctgtgtcctgcccatgtgcccagggctgggaggggttggggactaccaaatccctggaggcctgagcccccagagcagacagaacccaaggcggcttcccacctctgctgctcggtagccggacaccaacggtgcttcccctgccctcaggtacctgaggggcagcgatggctcaaaagctgccctgagggtcagtgagccctcaaccagggcctcagccaggtgggtggcactcagggaggacagggtgcttatgtttgccctctatgtttcccttcactgctgcctgacctgaggcaggtcaccaagtctctgtcttacctacaaaatgtgcgtgttgagggtggggggcgtgatctcaagacttctagggccaccctactgcatagttgaggactgatccttccacagcttcaacaaaaatgtaccgagcatctgcgagcgctgcctaagaacccagagcaaagccggacaggctgcctgggcccatggggcatgggccctaagagcaagcagccactgcgcaagggcacagccaggtgtgaaggatgggacgaggcccagctcctgccctcccagggcccatctctcctcgtgatgggccttccgggtgtggtgatgccaaccccagcccacagcccagcagtccagtgctgtgtggccttggctctgagcaagaccaggatggggtccccctcttgctctcggggcctgccctctcctgtgcgcaccccctgcccaggtcctccaggctcctccaagcctctgcctgtggccccaaacctgccccacccagccccaggcagggccctgcctcttcctccacaattcagagatgctctggagggtgcaggcaggccctgccagcatgggctccctgtggacctgggaaaaggtgcccttctgggcagtggacgcaggcctcaggagcacagcctggtgggcagattcgcccccattcatcctacagagtggtccctggcgcccctcagtgccaaacccacgattgccccggggctttagttccctgccctgccttccccagctggtcctgtcattgtcccttggcatcctcaagaagggctcagcccaggtgtacattgggcagtggactgaaggggacaaccagggtgaggacctggctttgctggtgtcgggtctctgcgtttcagtgccatgggtgggaagggcgggctggtcccaggaaagtggggattcagcagtaagttcccaggaggagcaggattaattggctggagttcccagagagacccaccagcagccacgtggacagtggagagcagggtggggctgaggaccctggcaatgcagaggttgctaaaaagatttttcgaaaccgtgatactgtttagaacccataggagaaaaatgatagctactaagattaaaaaaaaaaaaaaaaagctacagaacccataggaaaagttgcaagcgatacaaagtgtttccccttgaaccatttgacaatcggtggtcaaggggattccgtaccgccccaactaagtgtgtgtttcctgcaaacaagggcgttctcccacataaactaacgccacctaggacattgggaaaagtaccgttgatgcgtcacttccacctcattttagaccccaactgtcctaatgtctatttttttttctttgagtcgtagccttatttatttacaagcactggatgagtccctggccaccccccaggacagagcaaccctacgcagccccagcgcagttaaatacagttgggagctaggggactggagggaggaattaagggaaatacaggactagggacaaatactctgttaagtggtcacatacgggccagatcctgtagtctgcagagccacggctgtcaccacccccacaccaggacatgaaaggtagggagaagagcctgagggagccgaggcaggcccaggggtgcccacccgtcgtgccatagaacgtggaagggacaggaatggctctcagggagtgtatgggaaggacgaggccagaactgtcttcttacgggacccagttttaggaagaacacctggtttgcttttctgtaaacacagcggccttgagggagcggctgcccagcagaggctctgcctaccccagacccgagcacagcctagctccttcccacctctacccagaaaggatggcagctgctggctcccagctcccttgaagggaccaggcacagtctgtgagtcctcatggggctcaggagaagctctggacagggtggctgaccttcaggcaggcccgaaagagggcctggcccaaacacagcacagccagcaagatgacagacaccaggctgcatggaggcctccatgtcgccccgcatgcttccctgagccaaagcaggtagcagatatgtcacttccacggatatctgcacccatagatgacactttccaacagtgagggtgacatgtgaactctgtccatggaagagtattcctgcagtgcccacggatggccctgacacccacctgaggttctggaccccacagtgatgattcctttgcagtagggccgagggcaggtaacccgctgggaagtcactttgcagatgagacagctatgaggacttcagacatctttctccctcgggtgcattctggattggagcagctttgttgcaggtactgcattgactacaagctgatgagttctgccttccaccttgatgagcagtgggcactctcactccccaggctggtcagggtgagtagggggctgggtgtacctcatagaagggggtatgcctggggtggggcaggtttactggcttcactcaatggtacaaagggggtcagcatctctgggcccagccccactcccatcccaccctactaaatcattgccaagggaagcctctccatctgcggccaccactagcaggtcaccagcctagtaatatcctttttactttttttaagacaaggtctcactgtgtcgcccaggctggagtacagtggtacaaacatggctagctgcagccttgacctcctggctcaagtgatccacccacgtcagcttcctgagtagctgggaccacagctgcatgctatcatgtctggctaatttttttgcaaagacagggtcttgctatgttgcccaggctggtctcaaaattcctgggctcaagcaattctcctgcctcagcttcccgaagtgctgggattgcagtactagccacacccagccgatagtaggttttagcaaaaggattcagttcaggcaactgcacccattgcagttctggccatgagccaccacacccaaccagaattatttcaaaagattttaagatagaatattttgacctcacatccctagtaggatatctatttaaaaatttttaaattaacataatgaaatcttaaacacatttaatagtcttattgttagtaataataatgatgatattggctgggcatggtgactcgtgcatgtaatcacagcactttgggaggccgaggcaggaggattgcttgaggctaggagctggagaccagcctgggcaacattgcgagatccccatctctacaaaaaatttaaaaatcagccaggcatggtggcatgcacctgcagtcccagctactcaggaggttgaggcaggaggagttggagactgcagtgttctaggatcatgcattgcactccaggctggacgacagagcaagaccctgtctcagaaaaaaaccaaaaaatacaaagaaaagaaaactgaagctgtgtaacaggtacaatgggattcattattccattctatctacttttgagtatgtttgaaaatttccattatagaactttgtttaaaaagagagaacaagaacatgttggcttagcaacagaaaagcatacatatgttcagctaaagacatgaacaagaatgttcttaacagcactatttataacagccccaaactggaaacaacccaaatgtccattaacagaagaatgaataaatagccgggcatggttcttagtgcctgtaatcccagctactggggaggctaaggatcccttgaggccaggagttcaagaccagcctggtgacatagtgagacccacctctaaaaatattttttaaatttagctgggtgtggtggctcatgcctgtatctgtagtcccagctacccgggaggctgaggcaaaggattgcttgagcctgggaatttgaggctgcagtgagctatcctcacacttgtgaatggccactgcaccccagcctgggtgacagagtgagactctgtctctaaaaaaaaaatcaacaaagggtagacattcatataaccgaatgagtaacatggatgaacctcatggacatgaaattatacatactgtttgcttccatttaatacaaaatctggaaaaattcttttattctattagaagcagtatagaaggctgggtgcggtcactcatgcctgtaattccaacacttttggaggccaaggtgggaggattgcttgaagccaggagttctagagcagtctgggtaacaaagcaagaccctgtctctacaaaaaaattttaaaaattacctgggcatggtggtgtgtgccaatagtcccagctactcaggaggctgaggcacaagaatcactttaacctgggaggtggaggttgcagtgagccgagatggtgccattgcactccagcctgggtgactgagtgaggctctgtcaaaaaaaaaagcatcgttttaaataatgacataaatataaaaaatggccagcatggctgggcgcaatgtctcacgcctgtaatcccagcactttgggaggctgaggcgggcggatcccgaggtcaggacatcgagaccatcctggctaacacagtgaaaacccatccctactaaaactacaaaaaattagccgggtgtggtggcgggtgcctgtagtcccagctactcgggaggctgaggcaggagaatgccgtgaacccgggaggtggagcttgcagtgagccgagatcgcgccactgcactccagcctgggcgacagagcgagactccgtctccaaaagaaaaaaaaaaaaaaaaaaaaggccagcatgagaatgagtgaaagttcataaactcttcctatggtgactcacatatggcataaggaactagctcactggttttgccttctccttcctctcttctgtaaggttcttcatttcccaggcctgtaacttgctgtcttcccactacggtgccttctaataaagagcttccaaaactaaaaacaacgtaaatctttgctgcggttattttttgacgcatcaaaaaaggcaccaagcctagatgtttttaaagcttcaaaagtttattgaccggcaccatggctcacacctttaatcccagcacttttggaggccaaggtgggcggatcacctgaggtcaggagttcaagaccagcctggccaacatggcgaaaccctgtctctactaaaaatacaaaaattagccgggaatggtggcaggtacctgtaatcctagttactcaggaggctgaggcaggagaattgcttggggcctgggaggcggaggctacagtgaactgagatggtgccattgtattccagcctgggtgacagagtgagactccgtcaaaaaaaaaaaaaaaaggttattatctaaaggctttacctttagataatagatcattcaaatgctatttaaactactccagatcagagaaaaagatggtaagcgctcttaacatattttatgatattaataaaatactgatagccaaatcttctcattgtttctgaagtttgttttctagaagttccttctgtctgctggtgataaactcctatattctgttggtctgaatgtcttcaccatggtgtagggaggagacagccgtcgtggcccccagggctgtggtgagaatcaaagctgtcctgccttgggcatgtctccaaagcccaaacacactgggaagacggagttggccccactcagggtctccactcagatcaggctgggtcccacttccctctccctgagccccggacacatcgatgctgtcattgcatgctgattctccgagtccctgagccccgtaccccccggccttaaggagccttgccagtgtcctccccacctcgcccctgcccaacagacacagcacgccacctgctctgccttgggtcccaggcctttccctcctcaggcacctgttcaggggcagtgagagaagcaaaacagcccttctgtgccaatgcacaccccacctggggaaggaggcagacaggagggctcctcagaaacggctgatttgtcagccctggacaaagtgaaagggagaagcaagaagcaggacagatgggcaggtctcctgcggcccacccccccaaaaaaggaatgtgtgggccgggcgcagtgtctcacgcctgtaatcccagcactttgggaggctgaggcgggtggatcacctgaggtcaggagttcaagaccagcctgaccaacatggagaaaccccgtctctactaaaaatacaaaaaattaggcaggcgtggtggcaggtgcctgtaatcccggctactcaggaggctggggcaggagaatctcttgaacccaggagccagaggttccagtgagccgagatcacgaagcaaggaaggaagggagggcgcgaggaaggaaagatgtggccatagatcgtgagtaggatcgataagacagaactccattgtcgaaagctaaattatggcagacacaaagcggatgggagacccacatgaaagaaggcacttggagccttcagagaagaacgcagggaggcaaaacccccaaaggcctgaaagcttcagcagtcactagaaggggagctgaatacatgtgctgaggggccctggggagacgacccttccagaggctgcagttcttaggtcttaccagcccctccttgctgcccatctaccaggtccaaggctccctgaatcctcagacattaactacaggggtacctcatccttgtccagagcagggtttctgggggacacagccacagacacctccatgtgagtcctcctgcacctcaatttgggtgctttctaactgaaagaccagggcggccaggcgcggtggttcacgcctgtaatcccaaaactttgggaggccaaggcgggcagatcgcctgaggtcgggagttcaagaccagcctgaccaacatggagaaaccccatctctactaaaaatacaaaattagccaggcgtggtggtgcgtgcctgtaatcccagctacttgggaggctgaggcaggagaatcgcttgaatccagtaggcggaggttgcggtgagccaagatcgcgccagtgcactccagcctgggcaagaaaagtgaaactgggtcccccaaaaaacaaaaaaaccagggcagttccccaccaccctccaagcactgtactccagcttgtaaatgctgctggggaggaaggccacttctgatcatgccttggtgagtgaatccatctctgggggagtggaacttgtgttcgcagtggtctaccagcatcctaactgctgttggggcatgtggaccctttgattggaccaagaatgcagttcccttatgagactgtaactaggttagatgctttcgggttctgtagcccaaggcaaggtgctgacttgctggttttacgtgcttagggtgacctctgctggtggcttctctaaatgttggcagaatacacagccaggaactgccggtaccgtctcacatcagccagtagttggagccacattgctatcagaaggaaaagagtgctcttctcatacaagaattattaaaacaaagtgatgcccaatgctgttcaagaatgaacagcctggtctggttagtaacaaaggattctggtacttggcaactcattgtggattagcaagggttaaataacaaagtgggtattttagcgtcatgagaatctatcacaataactggaagaattgctgccagtactggcacctggtgtacagccctgggcactgctagttctttttttttttttttttggttggagtcttgctcttgcccaggccggagtacagtggcgccatctcggctcactgcaacctctgcctcccctcctgggttcaagcgattctcctatctcagcctcccaagtagctgggatgacaggcgtgcaccaccacacccagctaatttttgtatttttttagtagagacagggtttcaccagttggccgggctggtctcgaactcctgatctcaggtgatccacctgccttggcctcccaaagtgctgggattacaagcgtgagctaccgcgcccagcctgtactgctaattcttcattcctcagtgtcaccagatgaggcatacggcatgcctccacacctcccacaggggcttttggattctcttgcaaatgtcaccagtggatcaaacacacgcacagcatgaactgctggtggtgtccgtggtgtcctgacttcttgcttcatcagtgattttctgagggcggctcccactgaggaaactgcccacacttctctgtgtgcttctcagacacaggtcagtagagatgtttgggccttgaatgaagacaaaacccacggttctgtggcccaagtcactttcctgggagacaactgggcaactactaaagacgaagcaccaggccgggcacggtggctcaccacctgtcatcccagcactgtgggaggccaaggcgggtggatcacctgagggcaggagttcgagaccagcctggccaacatggtgaaatcccatctctactaaaaatacaaaaaaaattagctgggtgtggtggtgcaggcctgtaatcccagctactcgggaggctgaggcaggagaattgcttgaaccctggatgcggaggttgcagtgggctgagatcgtacaattgcactccagcctgggcgacaagagcgagactccatctcaaaaagtaagtaagtaagtaaataaataaataaataaaaataaataaaaataaagcaaaccatgtaaaaagaaaaaaagtgcacatggaattcggacaatggttgccttgggtgggacagcagagaatgggctggtcagggtaggatgggaggtggagtatgttacttgggttattgttaaagtcctagcctttattttatggtggtgggtttgaagctgctcacattattaaaaataaccaaccaaatatttaattattcttgacttttaattttttattgaaagggagtctcactatgtcacccaggctggcctcaaactcctcaagggcttaagcaatcctttcccttcagcctttcaagtagctgggattacaggcatgtgccaccatgcccagccaaaatgtttaaatataggccagactcagtggcttacgcctgtaatcccagcattttgggaggccgaggcgggtggatcacctgaggtcaggagttcgagaccagcctggtcaacatgctgaaaccccgtctctactaaaatataaaaattagccaggcgtggtggtgggcgcctgtaatcccagctactcaggaggctgaggcagaagaatggcttgaacctgtgaggcacaggttgcagtgagctgagattgcaccactgcactccagcctgggtgacagagcaagactccatctcagaaacaaaacaaaacaaaacaaaacaaagaaaggaaaaagaaaaagaactacaggataaacccagagggattggtttgtttcccattggttatgagaaaaaaacaaaaacaaacaaaaacaaagggagtataagtgggaaatacggtaagagcagcaattaatgaaataccaatacaaagaatgacaacaaaaagctggtgcttagaaaagactaataatgaccttctgccaagattgaccagctataacagagagaaggcacaaataaacaatattacatgtaaaaagggggacataactttggatacagccaagattacaaacataaggcaatcatacaaataactttgcgccagtaagtttgaagccatagcaaacatgagaaaatatgggggctgggtgtggtggctcacgcctgtaaccccagcaatttgggaggctgcggtgggcagatcacctgagatcgggagtttgagaccagcctggccaacatggtgaaaccccatctctactaaaaatacaaaaattagccggccatggtggcacatacctgtaatcccagctattcgggaggctgaggcaggagaatcacttgaacccgggaggcggaggttgcagtgagccgagatggggccactgcactccagcctgggcgacagagcaagatcctgtctcaaaaataaataaataaataaataacatgaaaatatttttccttgaaaatatgactgaagaacagaacacctgagtaatctattaccactgacaatctaattccaaacctacctacccacccacccaaaaaatcgccaggcatggttggttttacagcaagctttaccaaaaattgtagaaatgcaaaattccaatcttatacaaactctcgtaatgaaaataaagggaaaacactttccaacttatttatatgaagctggtataaccttgatacaaaacaaagggtgggggcagtacggaaaaggaaaaccttaaaccatttcacctatacacctggatgccaaaataccagagaaccaaatccggcagtataataacaaatccattgtgactgtcttcttccaggaatgcaaggatatcttaacgtgagagaatgttatgatactccaccacatttacagattagaagaggaaaaccatgtggtgagctcagactgccatctgtgctccctggcacacacacaggggtggctgggtggcaaggggggaaagcgcactgggccacacggggaagccctggtggaaatgacctggctgtagaggttagtcctgaagtgacagaggtacagattctgaagggccacaaagtctcaagcataactgcaagagaagccagtaagtactattaggcagccagtcacagggactggccatgacatcgggacaaggggctcttacatcagatctcagctcactcagggagatctattcatacatggttggatcccaccattcagttggaagaacagaggtggaatccagcttcagagaatgacataggaaagtagcatgcagaatacaaggaccctacctccatcagtacccttagctacagcccacagaagctgaatggctggtaagagatgaagaagtggaaacgaaaaggttttagggggaaaaaaagatgttactaggtggatcacagtatcactgagagaatggagaagaacataagaccaagtttacagataaaacgccaaaacacacacacacaaagtggggaacagtcaaaggactatttagaagaaaacatatagccctgaatatattagaaaacaaattgaaattaaattagctaagcacacatctcaagaacccagaatgagcaaataaacccaaagaaacgaaggaaaagtccagtaaggaagacctcttgcaaagctagccaaataaaatacacaaaatataaacatattttgttgatttcacctgccctcaccccttgccccactttttctggtaatagaacctctctattccatgggaaacatataaaaattacttgtggctcatcctgccccaccccagtcctccacaccctcccaccccccggccctggccacagtgactgctcaagcacagcaagtgacctgaggaagatcaatcgcccttcacggaaatacagggatcctcaagagccccaaggggctctgtctacaaggactgtgtataaacttgagcgtcctggctgggcgcagtggctcatgcctgtaatcccagcactctgggaggccgacgcaggcggatcacgaggtcaggagatcgagaccatcctggctaacacggtgaaaccctgtctctactaaaaatacaaaaaattagccgggcgtggtggcgggcgcctgtagtcccagctactcaggaggctgaggcaagagaatggcgtgaaccccggggggcggagcctgcagtgagccgagatcgcgccattgcactccagcctgggcaacagcgagactccgtctcaaaaaaaaaaaaaaaaaaaaaacttgagctttctacagaaaacatctgtaggagggaaagaaattaatcagccgggagcagagatgacagagataaatgagagagcctgaggaattcatgctgctggcattggttcatccctgcccgatgcgcaccactcagagacctcaggtcaatgagccttgcttacttctcctaatttgagttcaattttgtcatttataagaaagtcccgcatacgccaggatggtggctctcacctgtaatcccagtactttgagaggccagggcaggagcatcacttgagcctgggagttcgagactagcctgggcaacatagggagagcctgtctctactaaaaataaaaaaaattagccaggtgtggtggcgcgcacatgtggttccagctactcaggaggctgaggtgggagaatcacttgggcctgggaggtcaaggctgcagtggcgccatgatggcctgggcaacagagtgagaggctgtctcaaaaaaaaaaaaaaaattactgggtgcagtggctcacccttgtaatcccagcactttgtgaggctgaggggggccaatcacctgaggtcaggactttgagaccagcctggtcaacatggcaaaaccccatctctactaaaaatacaaaaattagctgggtgtggtggcgggtgcctgtaattccagctacttgggaggctgaggcaggagaatcacttgaacccgggaggtggaggttacagtgagccgatactgcaccactgcactcaagcctgggcgacacagtgaaactctgcctcaaaaacaaaacaaaaacaaacaaacaaaaaaagaaagttccaaataatacaaatattatgcatgaacttttgcccaaaaagcttaaatatatatgaaatatgatcctggaatgatacaaatgatcaaaattgactcaaggatagaaaactttagacagaacacaactgaataaactaaaaggcagtgaaagatccacccctgaaaaaggtacccagcacagatgtttttgtaaacaagttcacaacgttgaagaaacaaatgcctggcctataaagtattcaagcctgaagaaaaagacgtctccaaacccatttgcaaggctagcataaagctaatctcgaaatagaacaggaaggtcattttttaaaaagagggaggggattggcccagggagagagataaaactcctaagtaaatacataatatactgtaaaactaagcaaggtttatatcagaaagtaaggtgtgtccaacattaggaaacctattactgtaactcagtacaatcatacaataaaatcttttgattttctccatagatgtcaacattcatcactgttaaacaaaagcgaaggagaaaaaaaaaacagtaagatggaacaaagaaaacatcttcagtctaatgaagatcatctaccggaagcccagagcaagcgtcctacctcaggacgcaacgtgagaaccattcccactgagaaaacatcaatcaagggtgccatgcaaccacggtggaggtcctggcctctgagattcacaagaaatagacatgagtgtaaaggaggagataaaactgtcattagtgggatacgatttggctatctataaagccacaagatcaactgaagaactgcgcattcgacaaggtgggcaacacaaagatggacacacaggtggatgccagggatggggaaaggtgatttccacagatccttcactaccagtaactaggactttcataaaactcctaagactaaaccaaattggaagtaaaggcccatttgaagaccacaccaccttaccaaagaacatacctcatttctggacaggaagatgaaaaactgttaatttttctacaatatttatttaaacaaaactaaaaataaactgttaagataccacttcttgggtggacatagtggctcacgcctggaatcccagccctctgggaggctgaggcgggaggatggcttgcccaggagtttgagaccagcctgggcaacataataagactggctctacaaaaaaaaaaaaaaaaaaaaatagaaaaagaaaaattagcccgatgtggtggtgcacacctgtggtcccagctacgcagtaggctgaggtagaaggatcgcttgagcccaggaggtggaggctgcaatgagccatgattgcatcactgtgttccagcctgggtgacaggagtgaaaccctgtctcaaaaaaataaaagttgaaactccgtctctactaaaaatacaaaaattagccgggtgtagtggcaagtgtctgtagtcccagctatggagaggctgaggcaggagaatcgcttgaacctgggaggcggaggttacagcgagctgagatcacgccactgcactccagcctgggtgacaaagcaagactgtctcaaaaaaaaaaaaaatgcagtatgggcacacggatcaataggacagattagaaattccaaaaaagatccatatatatgcaggaatttatgttttaaaagatatttctggccaggcgtggtggctcatgcctgtaatcccagcactttgggagaccaaggcaggcagatcacgaggtcaggagactgagaccatcctggctaacaacggtgaaaccccatctctactaaaaatacaaaaaattagccgggcgtggtggtgggtgcctgtagtcccagctactcaggaggctgaggcaggagaatggcgtgaacccgggaggcagagcttgcagtgagccgagatggcgccactgcactccagcctgggcaacagagcgagactccgtctcaaaaaaaaaaaaaaagaaatatttccagtgagcaaagaatgaacctttcaagaaatagtacagggacaagtgactttccctttagggaaagtttgctacctctcagaaaaaacaaacttcagatgaattaaagatagatacacacacatacatatctttaacccatctcgtttattttttgtatatacatctacatacattttatacattatattcatatatacatatatacaaatgtatatatgtttaaagccacgctataagagaaagtaaatgagaaacagacaaatgaagtggtagctggaggacgtgggaatcagtacaggttttcacgcctgtttcagaaatgggagattctacagcacgctcgacactaacacatcacatccataacatatcacatccaatagacaggacagccaaaaacacaaaacaaaaaaagaatcaaatacccacacccagacacaatactcaacaacacaaatacccgaccaaagtctttaagaaagcaaaagaggccgggcacagtggctcacacctgtaatcccagcactctaggaggccaaggtgggtggaccacttgaggtcaggagttcgagaccagcctggccaacatggcaaaacctcgtctctactgaaaatataaaaattagccaggcatggtggcacacgcctgtaatcccagcagtttgggaggctgaggcaggaggctcatttaaggtcaggagttcgagaccagcccgggcaacatggcaaaaccccgtctctactaaaaatacaaaaagttagccaggtgtggtggtgcacgcctgtagtccaagctactcgggaggctgaggcaggagagttacttgaacccagtaggtgaaggttacagtgagccgagatcacaccactgcactccagcctgagcaacacagggagacactctctcaaaaaaaaaaaaaaaaaaaaaaagatagtctccaaaacacaagaggtaaggtttaagtcccattggcttacgacaggaagatatgtgcacatctgcagagctggtaacagggaggcaggcattccctctgatggttgctgtttcttaatgaggcatgtgttgtggtaactaccacaagggggaattgatagataagacagaagttttgaaacagacatcccagagtagatctgctgggcagtgcttagtgtccatctgaggtttgtaatgataaacgtaaggtacaactggtggccaggctggctgttttctcacctaatgatggtgacttgggtttgggcacagaggtgaatgattgggtttacccagggttagggttttactagcggaacagaatggagggagacagaggggtgtagggtggactacggaattgatgctacacaagagggaagtgaaggcagaaggttactcatgagaatgtcagggctggttagaagaatgaagggtgagggtggaaaagcagcctctatttaaaaggttataagacaatcaatgtcctcagggaataatcaggtttcaaataaagtcaggagatggatggaccattcaaaacaaagttaaggatagagagatttgccagccaccttctggaagtgatagatggtgcagagtgggagagatgaggtcgtatgtggggatggacacagtagctggaggtgagcactcccgtacacagggtgactagaaaggcggggagaacagcacgaggcaccatgggctcctgagcgtctcttagaggcaggtgggtgttaggtcctagggctgtcatcctgaatgcttaaattggtatgaactgcaagcaggcaaggaagcaggagtgctcccagctgttaaacacatgcaagaaggcccagagcacggcctggcactttctaagtgcccaataagaaagaacaaaccacctgggaaagactccagccatttcccatttcctccccattcagcccacccacccacaaggtctctaataaatagggagcagtttttcacttcatcacaatctccctcccccgagagagccactcagacaccagaacaagtcaccaacccaccaggggtttaattctctgaatcaaaagatcagttcagagaggagccctgctttgtcctcatgcaggggtgaagatgtgcagagcaccctgggaatgtccaagcccagaagagccaggggccagtccctgagcaagtggagaattgggtcctggagtctcaggctgcctcctcctcttcactctcctcctcactctcatgatactgtctgcggtttgtgttaacaaacaggtcagaatcatcttctgagctggactcctctcctgataactgtggctcagctgggagttctggttgagtttgtctgcacgaagggaagagagcagggttagcccagcgccttctgggaaaataatatctacaatcaaggagttccaaaaaaaggaccatccggcccagcagtcagggccctacagcaccctttaaagactcaaacaagggacacaggagagcaaacagtggggaaacgtggccaaagaaacaggctaaagactgaccccactccccaaacgtgtgccacagccatttgttttagttagaaataatgattctacgaccaccaactaacacttaatggacccatatcacataacagatactgcactaagcaattttacaagccatccacttctttaatcctcacaaagctcccattttacatataagaaaatagagtttgaaggaattaaataacgtgcttaaagtcattcagctttaagtggcaaagccaagattttaacccagagcatctgaccttcaaaccccattcataaccatgttataccacatgcttaggagctctcaacagataccctatgtaaggaggaaagaaggctctatttttccctcaaggcaccaaagcatgaaccccttattttccatgtaccccaccccaaggcttgttcctcacctgttcctgttgttgtgtttctcagccacttcagagaaggcctcaggcctatgccaagagatgagccaaagtcagaaaggacaaataaatttctcacaaaagagctgcttccagctgtgtctgcctgggatgccatgaccttccctcccctaattcccaagctaggaaggcaatgcctccagaagccagacagccaatgatcaaggggaccacctaccaaaacccctccttctgcagagagcgcacgtggtccttgcagagcacaaacgagatttcagccttcaccttttctccctcttcaatggggtcaacaatgagaaagtcccctgtagataagaagagaaaaggcaaagtcaggcctgcttgcaataaggaaagccaaagccataggaaggggttctatctcctagagagggctgcctctctcacctctctcttttttcttttttttgagacagggtcttgctctgttgcccaggctggcaagcaatagcatgatcatagctgactgcagcctccacctcccaggctcaagtgattctcaggcctcagcctcctgagtagctgggatcacaggcacgtgcccaactaatttttttctttttgtagagacaaggtctcattatgctgcccaggctggtctcaagcgatcctcccatctcagcctctcaaagtgccaggattacaggagtaatcctctcacctctcttgatccagatgttcttgcggtatttggagggcatgctcaccaggaagcgctgcccttgggctgtctccacctcatgcagattgttccctggggtcctgagtacctggttcaggagagaccaagaatcagtctcatcagtcagatcaaacaccctctcagacacgctgcaccctacccccaccccaggggccctccagggctgcaggggtggggagcagaacagcttgtgccccacgccactcaccctgacaatctgctgctggtcggagggcactatgtgctcccctagcacctccttcaccacatgcttcctcttggtggcctgagacatgctgaagtcgtcccacactggttaggaacgaagagactgtcaactcctcctcctgagttccttggatggcaggctcagaacccaggactgttctgaagatggggaggggccttttactgaggggtgacacggtgtcttggttaagaacatgggttctgaagtctaactgcctggattcaaatcctaccttggtttatttcctaactattcaacttctctaggtcccagaaaaataacagctaactcagcactgttacagtatggtatgaggccaccacttctcctgttggccttcttagtttctctccaacctccccttttccctagtttataagacaggagaaaagggagaaagcaaaaagttggaaagaaacagaagtaagataaatagctagacgaccttggcaccaccacctggccctggtggctaaaataataataatattattaacccctgaccaaaactactggtgttatctgtaaattctagacattgtatgagaaagcactgtaaaactttttgttctgttagctgatgtatgtagcccccagtcacgtttctcacgcttacttgatctattatgactttttcacgtagaccccttagagttgtaagcccttaaaagggctaggaatttctttttcggggagctcggctcttaagacacgagtctgccgacgctcccggccgaataaaaaaacctcttccttctttaatctggtgtctgaggagttctgtctgcgactcgtcctgctacaacagaatgggacaatacaatgcatgtcatgtaaaagtaactccggccgggcgcggtggctcacgcctgtaatcccagcactttgggaggccgaggtgggcggatcacgatgtcaggagatcgagaccatcctggctaatacggtgaaaccctctctctacaaaaatacaaaaaattagccgggcgtgatgacgagcgcctgtagtcccagctacccgggaggctgaggcaggagaatggcgtgaacccgggaggcggagcttgcagtgagccgagatcgcgccactgcactccagcctgggcgacagagcaagactccgtctcaaaaaaaaaaaaaaaaaaaaagtaactcctataatcttaagtactagtgtaatataaaactatacgcatgctccagagaagtcatcctggcaacctctctggaaggagtttgaaataaaccgtatctttctcaacacgcttgtacaccccaagtctagcatagtcacacaacagagaagttcagtctggcaacacactacagccggagacaaactaggtggccaccgtgatggttcaagccaggaactagttaattaaaggttgaggtgagcaggcttgtctgcgacatttgcatatttctgacttgcgtacttagaagacgaaggccagtacccttaagactgatggtttccgaaagaaacactgtcgtctctagttgctgtcctccttcctcctccctgtctatcccggagaaaagaccctcagagaaacacccacacttagtctctggccctcggctcccaggaacgctgccggagcaacaccgccgtctaggctggacgctgagagaggatcgtccacgactcacttcaaggctgaaccaagaaaacacagtaaaggaacttgccggcggccgcgacggtagcgtcagttagaaatcaggtctccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcgggtgagcgccagccgcggagcagggccctgattggaggccagaggggttgcggggagaaggggaggagaggggtcgcaggcgctgtggcgggccctgggggagagcttggccgcgctgcggggagggggcggggtgcagcgcgtgggagccgggccgcgggaaggggcgggccgcagcggcgcgcggtgggggcggagctggggcgcggcgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagtagggaagagtctccctggaactgttttctcctttcaggatgagggggatcgagcaagccactgtaacccctggcttggcttcctcttactatgagattgctcgtgggcccttagaagttccaggtcttcagccctaatctgccttttttttgggattcctagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggtgtggggtggctgcgtgtacctagtgcaagcggggggtggaagggaagtgattccatctgctgggggatggacagtaaggtataatctgaagaggctgccagagcctgggcacctggtggagaggagaggggggcaaaacccgcgctgcttcctgggcttgtgtgctctgaatggcacaggaatggctgtcttgctcttatctctcactgagcactgagcagcacgctccttccttttccctgttttgcaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcatgactgggctttgtgcactgaaaagcaagtgggctgggagttgcctctccttcagggactgaccatgtttccctcactccttatcagtagagaccgaaactggcagcttcccttccactcccagagggcagccaccctagccatgtaggcctcaggcaggtgacttttgtctcaatccccgagtgatgtgggagagggtgtgggtggatcttttcctgggagccagatggactgtgctccagatgtcagttaagtcaacagctgggctaggcagcacctggtggaaaagtcagtgggagtcagaggtaccagacagggtgggccggatgtgggtgagagttcacctgccagtcatcatctgctctcccggcctctgtaagggtgggcagggtgcttgccatcttccatgatctcttagggaggagaaggagcacaggcatcacagctggaaggatgtgaggggagtacacctcagtacattttagtcctgttctttttgtttactttttaacttaatagggacagggccctgctctgttgcccatgctggccttaagcgatccttaagcctcccaaagcgctgtgactataggtgtgagccaccatacccggccagccctattatttcttgaacacttagtatgaaccaggcttgaagctaaaatctttgcaaacatttttttctttcacagtaataaatattttctcctttacaggtgaggaaatttgaggctcagagaggctaatttgcccatggacttgctcctgggaagtagccagactggaactcaaactagcttggaaacccagggacccggccatgtgttccttggtcatgtggcttagcctctctgagcctcagtttctccacttggaaaatgaggtggttgtagggaaaggatatttgcagcagtataaacaacaaaggactatttccatagcacatacagaattgcaatcaagaaaaaagcggactggctgggcgcaatggctcacgtttgtaatcccagcactttcagaggccgaggtgggtggatcacctgaggtcaggagttcaagaccagcctggccaacatggtgagaccccatctctaccaaaaatacaaaaattagccgggtgtggtggtgcacgcctataatcccagctactcaggagactaaggcaggagaatcgaacttgggaggcagaggttgcagtgagccgagatcacggccattgcactccagccagggtgaccagaatgaaactttgtctcaaaaaaaaaaaaaaacaacagaaaaatgggtaaaagatctaagacggccacagaagagggttccctcccagtaaataagcacaggaaaggtgctccatattgctagtaataagacatcacatgccattaacacccacctgactggcaaacacttttaagttggacaataccaagtattgatgagataatgaagcaacaggaactgatacctagctggtgggagtataaattggtctaaacaatttgggaagacagttgggtgttatttagtaaaactgacacgccctgtgaccaagcagttccactctcaggactgtgccttgaagaaagtcccgaacacctgcagcaggacctagatgagtttgcagctgcattgttgggagcaacgctagcggctgtcaatactagagtagataaataggcactcatgccaccggacactggacggaggtaaaaatgaacaaatgatagttgtgtacaacacgaatctcaatagcaaatgaagacaaacaaattcttaggaattcctacatagatggtaaaactagaaggaaaacaaaggaaatgattatggtaaatagtaaaggaaaaagtctacagggattatctttgggggagggtgtggaagggcttaagggtaggcttggcctaccctgacctgtgtttctgacctatggggtggtggtacaggcattgaccaaaagtgtatgttctgcgcccttttcagtgtattcgctacatctcaacaatagaaagataacaggaaaaccaaaaataaagacctgaggctggaacgattgagtgaaaggtcagaaactaaattgttatttgtagggatgagagttctgtgcaaggctgggactggaaagtgcgagtggcccagcttgaaagggacaccaggtgactgcagcagggcccagcttgtgcttcaagccgcttcctgggaggctgctggtctgagtcccggctgaggtggtcacgagggctctctcttgagtttcagactgtttctgatgtcttcccggctaagtcccctcagccttgaccctcatgctatgatgctgtcgcaggccttgtgtgcttaggtgggggctttgcagggctccggcctcaccacacctcagtcctgatgctgccagcttgttgctggtgctctgtgaggtcatggagactcctcctccatgaagcccttccctgggctcctgcccacgctggcctcctggtttggcctcgcctggtggcactgggaccctgctggaagcctgcggctcatgctgtctgctttatttccttgttgtctgcctttcccggctcacccacaggctttgccatagaagggactggaacctgccttctcacctctcccttggggcacaggcagtgcatataccaggtggcaggccacaaaccctttatcaggactccatattgcatcccacacaagttcttggctctgtcctgggacagcagtagacaaagggcatctagaatgtaccttgtgacagtgtggcctctcagatccagcccgactcagccagcaggacaaagggaccacggcttggaatgctggcgcagaaagcagacctggctggtgaggggtatgagtcaggttgtctcagtgtcagcccgtggtgtccaagaggacatgcctggccacccactagcctgggacataggtgggcccagaaatcagcaaatactgaccccatccccccatcacacccagccagagcttgaccccctcagctggtctagtcatgagtgctcagagccagcctagaacttcgtgtgaacccagcccatgcactctggggtgctgaagggctcctgctgcccccagaaaggaagtagggggaggctacctggaccaccacaagccctgcccccggcagcctgctgagcatggaaggctcccagcaggtgcttgtgactgttgatccctttccaggctggcccctccctgtggggaccagggctctttcctgtcactcccaaccttgactggtggcagccttgaagagccagccaggcccgattctggggctttgctccccatgcgatctggagcaagttgcttcactcccctgagctacagcctcctctgccagctgataacagggttgtgaagattcaaccagtgaatcagcagcgcttaggagcgctcctccccagaggggagctttaatccctgttggattacaggtttccttgctgaaagatctcctttccaggatatggggctacagagccctggggggagggcaatatcctctgcccaactgaaggttcaaggaagagggttctgggggaagcatcgaagccttggagagcctgatcccagagggaaggagatgtcaagaacctgccctggtcatctccacccatcaggccaggggcaagagaggggtgctgtggacaacctggggtgggatgtctgggccactgcaaaactggaggctctgccctgtggccagtacatttgaccgacctcaagctcacgcttggcgcaaacctcctggaagccagagtggtccagacgggatggagtcaggccctgggaaagtctgctcagggacaccccatctgcaagaaacaacccctacaccatgcacagcagacctcaaacccctgtggagcagcccaggactcatgcaccgggacccaccactaacctttcccctttgatctcccatttcctccttgtaggaagagataatagtcattgtctgtgcagagctgctatgggaatgaaagaacatatattgaatccctggcgcaaggcctggcacacagcaagagttcttaccattgttaatcctccccaccttttcttaccaagataccacttctagctgtgtgaccttagacaagtgtcccgacctctctgattaacttcttcatctgcaaagtgaggataatgtgtactccctcagggtgcttgtgagaatcagtgggtgaaaagtgctcagaaattgctaggttgtactgcaaaaaaagtcctttgcatcagcacaaagcagaggcaggtggagtgggtgcccttggtgagtggcagacaggccttggctagtttttgagagagctgttggaggtacctgtggccatggctaagctccaagtgatgacacagcaggcccaggggagctgcctctcccacctcgcccctgtggcacgatcctggtactcttcctctacccctcccaggctttcagctcagagtcctggccaggcgtcatcctcctgatcaactcaagctcggccagcacttccacaaactggagtctgtccctttaagccagacacctgaggccgccaggaacttgtgacggttccttggaatcccaggaagatggcagagttggttttccacagctgggctgaggaagtgaggtgggtagcaggctggcagctgccctgggcagtgagtgaccgctgtggtctaggtctctgtgtgggaaatcacttccttttgtggtcctgggattctaaggcccagaatcaggaagggagggtgacacgctggatgcctacatacaatatccatcacagtgacagttgccagctgctctttacgtactgtgacctagcacctcttccaagccccagtgaagcccctggaggctctaagcactgcaagatcttagtgccccagggacaataagccccgccccccagcaacatggaattacaaatacaaactacactgaactctaaaatgcagacaaataattccaaggcctgcctgtaatcccagcattttgggaagctgaggtgggaggatctcgtgatctcttgaggccaggcattcgagacccacctggcactactgtgagaccccatctctacaaaaaaatataagaattagccaggtgtggaaaaaaattaaccaggcatgggggcatgcgcctgtggtcccagctacttgggaggctgagatgggaggatagcttgaagccaggaagtcgagttatagtgagctatgatagcgccactgcactctagcctggctgacagagcgctgtcacaaaaaaaaaaaaaaattcaacaaaatccagacttttcttgcgttgactacttcaacactgcttttcatctgttcctttttttttttgagacagagtcttgctctgtcacccaggtggagtgcagtggcaccatcactgctcactgcagcctcgacctcccagactctagtaatcctcccacctcagcctcccgagtagctgggaccacaggcgtgcaccaccatgcacagctaatttattttagattttttggtagagacggctcactatgttgcccaggctggtctcaaactcctggcctcaagtgatcctcctgcttccgactcccaaagtcctgggattacaggtgtgagctaccgtgtgattaatagatcaccacctattaataataatcaattaattattggagtcttttttttttgagatagagtcttgctctgtcacccaggctggagtgcagtgggtgccgtctcagctcactgcaacctctgcctcccaggttcaagtgattcacccacctcagcctcccaagtagctgagactacaggtgtgcaccaccacacccagctaatttttgtatttttagtagagatggggtgttgggagccgaaagggccaaagggattgtgaccaactcagcattccactgaaggctatatgatcaaacagccacctgtttatcacgaatgcaggatgtgggcaaactcccactgccctgccaccaaaaggtttgctgagggccttactccttggcactggggtccctgaagttatctactgagaaaattagcacctattgttcaaaggatgcagtctcacaagcctgctgtgaaccaaagtgctgaccgacaattacctgacatacccgacaatcaccctccccctttctcgctatctcttttgcctactacatacagagggctgtgtaaagctcagggcccttgtccactagaggcaaggtgccccctgaccccttcttccaaatatactcttttgtctcttgtcttttattcccacgtttgcccggctttgttcagtccccctaggtccgtgcgggctatgatggggtttcaccatgttggccaggctggtctcgaactcctggcctcaagtgatctgcccacctcggcctcccaaagtgctgggattacaggcgtgagccaccacacctggcaattattggagtctttaaaaacacagtcatgggccttgtttgctggtacctccagcacatgctcactgtatccacgggacagccagattcgaaacatcaatatcagaacaaacttaggagataaggtgtctttcagacgagggcacggaggctctgtgtgggaggttgagggacttgcccaaagccatgccgtcagtaagatggcagagctgacatgactgacaccccctccttctgggcagtttgtgtcctgtgggctcagtctggtttaagaccacagatttgacttagactgtcagcacacacaagccagtgtcaccatttatttcctgccggtgtctttgggcaaatccattttcccttctctgtaaagtggaaactattttttttcttttttcttttttttttttgtgagacagagtctctctctgtcacccaggctagagcgcagtggtgccattttggctcactgcaacctctgcctcccaggttcaagcaattcccctgcctcagccttctgagtagctgggaattcaggtgtgtgccaccacgcctggctaatttttgtatttttggtagagacggggtttcaccatgttggccaggctggtcttgaactcctgacctcaagtgatctgcctgcctcggcctcccaaagtgctgggattacaagtgtgagccctcatgcccggccttcttttttttttttttttttttttttttttttgagtcagcgtctagctctgtcgcccaggctggaatgctgcagtggtgagatcacgattcactgacttgaactccttggctcaagtggtcctcccaccttggcctctcaaagtgctggaattacaagcatgcctaggtgcctggccaggtagaaacattagtcactcgcgctccaggaaggttgtcaggcagcgctgagcagtaatgtgtcctactcacctgctgtttatccagcaccagacctcttctaagaactttacctgtttcagctcactgaatcctcacaacacccattgtacagaagaggaaactgaggcagcgagtggttaagtgacttctccgaggttacacagctaggaaatggtggcaacagtaagagcccacgaagagctgcggttggtagttcattctggacagccctcccgtgaaccgtccctgtactggcacttgttgctggggactgtcgctgtcctctccctccccgggccaggtgtgtcctggagggcagggaagcgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcaggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccaggtgcggcgggcggggtgctgggaggggacacccggcccagatgggggaggccacaggcgctgccccagcgtgcatgaagggggcctaaaagcgcaatcgggatattttcatgcaatattttaaaaatcgaattaatgctaaaactccacgatggacaaccatctaaatttcaaggaaagacataattaaaccctgtattgcactacctgccttcctggcttgcctggtcctagtctctgccctgatggggtggatcggggaggagggaaggcaggtggggacagtgggcagctccctagatggggcatgtctgatgtctgccaaggctgctggtggggctcagcctccaggcctctccaccctccatccccaccagaactcccccccccacccccccccacccccccccaccccgtctgaatcatcccctctccctctctccccacctgagtgcctgggggcaacaggagaatatatcaagaggtgagaagtgaggatcaagggtcaagacccctgacctgcccctaccctatgcccccagctggtggccggcatcaagtacttcctgacgatggagatggggagcacagactgccgcaagaccagggtcactggagaccacgtcgacctcaccacttgccccctggcagcaggggcgcagcaggaggtaacagctgggctcctccagccccagccctccccagagcctcaggcactcaggttgtccatcctgaactggtttggctggacacgtagatgtctagatgtctggctgaacctgtcgtccttctggatgagtcagcctctgggccaagatggggtgcagaaaggaagctggggcttccctcgggaatggggaagttggctaccaagatctggagtctagccccagacatgcggcttgacatccgttgggtcagtgattgtccctctcttggcctggagcagcctggcaggcagagggctggctgttgggaggagacaggtcgaggctgggctcacccctccttctcccccatattccctccacagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgcattggtttcttccaagtgcttcgcttctgcccccatcccccactcccacttctggcagctcccagctccccagcccaagctgagaggtcaccctgccacctgcagcagagctgctgctgtcccagcccagacagtgctgaaggtgcagggctgagcctccaaatgtggagcccccaaacaccccagcatcacaggcatagaggaacaaaccttagagcccccacacacagccagagactcccaatattctcagaggtcaggggtggcggcagactcacagaggaggggcgatggcctgagataagaacagggccggctgcctgggagcactctgaggaggagtctgtgctgtgctcccactcagccccaggaggagctcatgggtggcatggggggcttcaatcaggcagtgtcctcacccaggacactgagctcccagcctataaagattcctccacctgcatgtggcccaacgatggcagagtccctgcaggccaagagaccatgaaggctaggacagtgcctctcagtccacactgtgggctccacgccacaaggacgcctctcttgccttgccctgggcaagacgcctgaaaggggctagactaggagccgcagagggacagagattgtctagcgcccacaggaggggtgaggggacagattcaatgtaatgtcatttaaagaaaacagcattgcagccggcctcacacctgtaatcccagcactttggtaggctgaggtggatggatcacctgaggtcaggggttcaagaccagcctggtggccgggcgcggtgactcacgcctgtaatcccagcactttgggaggccgaggcgggcagatcacgaggtcagcagatcgagaccatcctgggtaacacggtgaaaccccgtctctactaaaaatacaaaaaattagctgggtgtagtggcgggcgcctgtagtcccagctactcgggaggctgaggcaggagaatggcgtgaacccgggaggtggagcttgcagtgagccgagatggcgccactgcactccagcctgggcgccagagccagactccatctcaaaaaaaaaaaaaaaaaaaaaaaaaccagcctggccaacatggtgaaatcccatctcaaccaagaatacaaaaattatctgggtgtggtggcaggtgcctgtaatctcagctactcaggaagctgaggtaggagaatcgcttgaatccaggaggcagaggttgcagtgagccgagattgcgccactgcactccagtctgggagacagagcgagactccatctcaaaaaaattaaaaataaaaaaagaagaagaaaacagcattgcaacatttgcacatctgaatttgtggctgcaattcatacccccccatacatatacacacgcacacacccaaagcacaacacaccagacatacacacacagacacccagagcacacactcagatgctggcagatatcacatgcatacccagagaaacacagcctagcaactcatgagcacagaagcaacacaccctagagaaacaacctggagatgtacacacaaaactcaaacacaacccaaggacccacatgccacacccagaggttcctcagatgcacaagcacacacccacacttgggatatgggccttgggggtgctaggtataggcaccatcaggcccaggcaggcagcactgcagtggctgcggagagcatcccacggtccttcctttctgacaaggcctcacaccctgcttgtgcctgcctggtcccctgcccaaggctggggcctaataagcagcagccccagctcccaggccctgctgtcggcctttggaggccagattggggtagagacggggaaacgggaagtagaccctgggtcccacctgggagtgagaagctgaggggtggcatttgacaggagctggggacccaggagacaacatccagccctgcttctgctcaagcttgtcagatgtggcagctcagacagcccagggtgtgtgcggggcctgctgcttggaagggctcccatgtgccaccaagcagggactcccagcatggggcaggcacagggtgggtggcaggaaatgcctgttgaatgaatgtgtgaggtggtggagagaagcaaggcccagagacgcctgcccggtgacctctccgcccctggaatctgtgcccaaatcccagatggcatttcctccgcatagtctattcctgggccctgggccctgggccagccagtgccttccgccagaccagggaggggaggtgcttcttctgtcctgggaccctggaagctccagcactgactggtctggtccagagatgggagggttggcaaaaaactattgcccttcagctcccgctcctgactccctccggcctgaactgcaccctggattcgcctctactagaggtgagatggctgttgtagataatggaaaaccctccacttaaggagagacccctggggccagggcgaggcttgaacttgactcagtgctaggtctccagcacccagcataggccagtgtcccactgtcacccccagccatggggacaggggctctggacatccagcctaggctcaggctatcagtcggggaggtcatctaagtcctagagcaggcaatggggcgcagccttcagcctcattccctgcttccctctcccagcagcagggtcctccacacatccctgcccgccccttgccctgaggccagaaggacttgagcagccccgactccacctcccctcagtggggctctagagtctgaccccagaaagggcaggatatggcaatgacctccgacctctgggttcatgatatccccatccggttggtgctcttctactggagctgagggtcctggtaggattgagttcctgggctctgagtccccattcctagagcctattgggcccccaggccctggtaaccctggggtgttcaggcctattctttttctcctgactcttgggccagatgggccttcctccccaaagcagggttactgcctcctcggccctcccggcaccgccggcacctgagctcagcccacgttctgcttcatccctccagctgctgctaatgccctgctgggctgagctagcatgcgggcgctggtagggctggaggggatccaagagcagctcctttcacatgcaacacgggcacacactcgttcgtgtgtgtgcaccaattcccttccctgcgccttggcctagtcagtgaggacatggagcctcctggggtttaaaaactctgttggggcccctgctctgcagggcccggacaatcattccagcagatctggggacccgtcccagtgcacccaggtgggcagactgccaggggctgaagtctgtatctggtgtcctcctggggtcaattcctgaagtcctcttctccagcctgcaggggtgagtggggcactggtgggtgaatgagccagactttgccttccccgatccccatgggagttacttggagccatttctggctacaagcccctggggttcccctcgccggccccttcccgctcctgcctggttcacctcaaatgtggtgtccacaatctcatcgatgacggctgcctgggagcggaacttctgctgctcctgctccacgcttgccaccagctgcaggtaatggaacaggagctcctgctgcctgcgggtgggcgggggggtcgcagagacaggggctgggctgacctgctggctgggcctactgcaccccagaaccacccagaggctcttcttgcctgcctcctccccacaaaatttatatgactgcagacctgcatttccaggaggtctccttttccagatatgagaaagagcccaagtctgcctgtagcgcagaggcttctggctttgtttatcttcctaaccacccatccctccacccacccatttgtcagccccattcctccccatacgcccactcgaccatccacccatccatccacccacctccttatccagtcactcacccatctggccctccagccactcacaactcacctccccctccacccacctgctcttccctgtagccaccccccacccacccattgacaccttcatcatgctgtgtagtcagtcacccacctgtccctccacccactcatctgcccaccacattacccattgtcccattcacaccctccccgccatcttgtcaacccattcatcaaagaacactggaaacaatgaacacagcaaggtactccgaggagatggagatgaatgagagacagcttgccctcagagccagacagctgctgacactttgaggcatgaaattgggttctgaggggcccagaggagggaaacctcgcctgatgctggcgacctggaaagacttctggaggcagcgtcaatgagctgagtttgaaagataagtgagagcccaggcgcggtggctcatgcctgtaatcccaacactttgggaggtcaaggcaggtggatcatttgaggtcaggagttccagaccagtctggccaacatggtgaaaccctgtctctactaaaaaaatatacacacacacaaatagctgggtgtggtgacatgcacctgtaatcccagctactcgggagggtgaggtgggagaatcgcttgaacccaggaggcggaggttgcagtgagcctagattgtgccactgcactccagcctgggtgacagagtgagaccctgtctcaaaaaaaaaaaaaaaagaaaaaagaaaaaaagagaaagatacatgagggtttaccaggcttgggcagggctcctggtgctcccaggcctggctccccagagatccttctcatggggacagcatgagtccccagatgtcctggcccagctggccactcaagtggacaggaatggaggttgagcatcggacctccaggccttgatctaagctgttcctccaaccgcctcattatccctccacttggctgaagtctactcattctccatggcccaacacaggtctttagaggtggggtcctcatgggcaggggctgaatctgtgtcctctttgggtccctggagccctcacagggcccagacttgacaaaggttggggatggttctggggtgaaggaatgggtggcacccctgctgctgggattagccaggtggcacacacacctctggatgtgcagaagccacccagggtctcctcgttgcacccacaggctcatccacaagcctcagcgctccatccccttctagaggggcaggcaatgtccctttccctccagccctccagccaggcccccaggcctcaccctcagaccccaggcctcgctcccttcctgtctcctcacttctcagtcatggtcccaaactttttctcgatgagccgcttcagcatggtgccttcactcgccacctctttgggctctggatgtagagaaagaagggtgaggtcaaggcctggatttggagaggaggcagaggaaccccatgtgtcaggaagataagggctaatggagtttctggccaggctgctccaggaggttgcttctccgggcatgcagcacgatgcagttccctttgtttgcccgtctagcacccaccccacttctggaagaagtgccccaattgtcttgaggaacaaatcacttctaccccctttcagtccatgtcctttggctgaggttagccccacctccagcttcagggataccccctttcagtccatgtcctctggctgaagttagccccaccccccagcttcaaggacaggtaacttaggcctggccaattagaacttttttttttcttttttttttgagacggaatctcactctgccgcccaggctggagtgcagtggcacaaccttggctcactgcaacctctgcctcccgggttcaagtgattctcccgcctcaacctcccgagtagctgtgattactggtgcccaccaccatgcccagctaatttttgtatttttagtagagacagggtttcaccatgttggccagactggtcttgaactgctgacctcaggtgatccgcccgtctcagcctcccaaagtgctgggattacaggtgtaagccaccatgcccggccccaggtaggtcttttaagatttgacaagcacagtcaggtgttgtggctcacacctgcaatctcagcactttgggaggctgaggtgggaggatcatctgaggtcaggagttccagtttgaaaccagcctggccaacctggtgtaaccccatttctactaaaaaatacacacacacacaaaaaaacaacaacattaggcgagtgtgctggcgcatgcctgcagtctcagctactcaggaggctgagatggaaggattgcttgagcctgggaagcataggttgcagtgagcagagattgcagcaccgcactccagcctgtgcgacagagcacaagactccatctcaaaaaaaaaaaaaaaaaaaaaaaaaagacttgacaagcagtttaactggctttgggaggattgttctagggtcctctggactaaagtcctcctgagtctcaaattctaaaactctaaaactgagtctggaattctgtgactgtggaaggaggttagggggatggagagactggcccccactgcggacgggcaggtggggccagggcgggccaggcccatacctgcagctctgagctccgtcagtgagtcttccagcagcttctcttggatccgggcggccctctgggaagaagaggcctcagatctgccagagtcccaggcctgctcaaccctggaggcccctggcctcactcctccagcttcctgatctggtccacctgtcccaccccactcggtacctcctgcttcgctttctcaaggcctttgaacagcgccgtctggaagctatccaccaggacagtaatcaccaggctggggagagggacaggggtgtgccctcagcgaggaggccagaggagaggggcacccggtacttcttgtgggttcagcgtggcatgaccagggtgagagggctggggtaagggtcccaggggagaggaggaagtgtgggtggtgctgggcagcagagcaggggtgagtcctcacttgaggaagatgaagtactggatgatgatgtaaattacgaggatgggaatgatgtaccaggcgcctagggggagcaggccagagggcacagtcaggctgtgctcgccacccccaaccacgacctgctcccttcccatacccggacatgcaggcatcagaagccccactttgccgatggggtcactgagccctggccggtccaccccgccaatccccggccctccctgcagcctggggcctgccctaccctgggcacggctgtccatgtagatgagggaccagtcatccagcgtgagcaaggtgaagagggtgaagatggtggtgaagatgttctggaagcgcttggggtcagatttgcggaacagtgcccggaggaccgcggagaagaggactggctgttcagggccaaactcagctctccagtgctatccccaccccagcgcccctcgtcctgccccatccctgctccccgcacccctttcaccgcagcccctcaggcccccaccccagcccctgcagcaccaggatacagaggcaggtaaacatgaggatgaggatggctgcgatggacggcaaggactggcccagggtccctgtcacttcctggacgctggtcaggaagctgtgggcagaaggagtggggactgagtcatcggtgaggggcgggggtgtgtgtctctgcccagcagccacagctggcgctgaaggcaggaggctcctgacttgttggtgacttgggtgagtcctggcccctctctggaaaaatgaaggggctgattccagtgcatgacagaaggcagaagcaggctggggtcagcagcctcctgcgcccccatcccttgagcaggtcacagtggatttctttggggccctggtctgtgtcccctcttcctttggagtccccaccccaggtgggagccgtggccactgacctgagcctccgcaggacccggattgccctcagggcccgcaggctcttgaagaccttgaggatccggaagaggctttggtggtagatggcgaaggagtgggtctgcatcagcaagaagtccagcacggccatggccataatgaagaagtctgagggcacggggtgcctgagcctggcgggctcccaacgccagcgcccccttccccatccttctctcgtcccgagcctcccccagactaaacacacgcagcctggccccggccgcacccacccaaattgttccagaagtcaaagaagtacgagaggcccagggcgatgatcttgagcagggcttccaccacgtagatgcagaagaatatggagtccaaggccatgaagtaccactctgcaggaacacaggggtgcactcagagctgtccccagcacccagtgccctctctctcctcagcattagcctcacacaagcccagattcccaggctctccccggctctgcgtaagcagctgcgcgacttcactactgctgtgtctcagttttcttgtctttaaaatggggataattgtgtccaggagcagtggctcacacctgtaatcccagcacattgggaggttgaggcgggcgcatcactggaggtcaggagttcgagaccagcctggccaacatggtgaaaccctgtttctaccaaaaatacaaaaattagctgggcatggtggtgggcacctgtagtcccagctacttgggaggctgaggcaggagaatcacttgaacccgggaggcggaggttgcagtgagatcgcgccactgcactccagcctgggtgacagagccagactccgtctaaaataaaataaaataaaatggggataattgaagtccacttgatagagttgtgagcgttaaatgcatgaacacaagcgaagtgcttagaatggagcctgagacagcgagccgggcagctcctgtccttcaccctgctccacggcgttggagggcccagccttccccgaccttacatcctcgcccctccagggccttctcgggctcccggcccttccgcgaagctcgggctccaggcgcccgcccgccctcagccgcacatttggagcagatgcgctccctagtggctgcggcgcgaacagcaccgcctcccgcctagcgggtccttctgtctcgggccggcctcagcggggtctttctgagacgctctctaatactgggtaaggccatctacttcccaggggtgaggatcaagtgagctgagtcctataaaccgcccggcactggatcaggcccacggaggtcctggaagagcatcggtggcttctccatgggaacaggactccctggctcttaccgccccggatctcgacttcagcgaaggtctgggccaccagcatgacggtgttgaggcagacaacgaagaagatgaaagtttcaaaggccaaggattgggtcaggttccggatcatttcccggaagccctgaatgaggaaggttagcttttcccacagccactggaagagattggtagagtgtcccttcttgcgggtccgctggagccggccggctgaaaggaacagggccagaaagtcaagtgtgtgcaagaggggacacgaggtcccaggcaccccccagcctggctcagcgtccatggtcactcctgcctgcttgctggccctctgcctcccgggttcaagcaactcttgtgcctcagcctcccaagtagctgggactgcaggtgcctgccaccacgcccggctaatttttgtatttttggtagaaacagggtttcaacatgttggccaggctggtctcgaactcctggcctccagggcttccaccacgtagatgcagaagaatatggagtccaaggccatgaagtaccactctgcagggacacaggggtgcgctcagggctgtccccagcacccagtgccctctctctcctcagcatgagcctcacacaagcccggattcccaggctctctccagctctgggtaagcagctgcgcgacttcactactgctctatgtctcagttttgttgtctttaaaatgggcataattgtggccagaagcaatggctcacacctgtaatcccagcactttgggaggttgaggcaggcggatcactggaggccaggagtttgagaccagcctggccagcaaatccccaacaggctggtcctgtgccttctgtggcaggggccagcctgttggggatttggagttggcttctggggatcctgagggctcccactcctatgcctccatgcctttctttgctcacgtggcaacttacatatggaaaacccaccctcctcatcatcccatcctcttggtaaacttatcctctccctttcaggtcctgatgaaatgttccctcctctgggctgcctttcctgtccccatttaataacacacttgcccctctctgcttgttcctgagactgttgtcatattttgtttgttgttgttgttgttttctgagatggagtctcgctctgttgcccaggctggagtgcagtatcgtgatctcggctcactacaacctccgcctcccagcttcaagagattctcctgcctcaccctcctgtgtagccaggattacaggcacgcaccaccacacccggctaatttttgtatttttttggtagagacagggttttgccatattggccaggctggtctccaactcctgacctcaagcaatctacctaccttggactcccaaaatgttaggattacagatgtgagccatcgcacccagcctatttgttttttttttttttttttttttttcctacggagtcttgcactgtcaccccggccggagtgcagtggcacgatctcggctcactgcaacctctgcctcctgggttcaagcgattctcctgcctcagcctcccaagtagctgggattacaggggtgcaccaccacgcccagctaatttttgtatttttttggtaaagacgggatctcgccatgttggccaggctggtcttgaactcctgacctcaagcgatccacccacctcggcctcccaaagtgctgagattacaggcgtgagtcaccgcgcctggcctgttgtcatgtttattgaactactaggaagaaagtttggtggcgtatgagctaaaggccatggtccctccttgccctccaataaggccctcattcaggcattagttcctaatctctgttctcaagcagctcacaggtgagtgggagaaatctggacagatagaatccaccatggtaaatgttctgagggcaggccccgagcacaggatgatctgtggtcagctaagtgaccactcctagttttgggcccctcgagggcagcgactgtgttgaatttttccccatgctgccatggcccaggcaggccacacacccacattggatgagtatcaatgtttgactggtagacatatgaataaataaggcagtgactgaatgaacaaacacctcatggcctaaagaggtacataattcaaggaataaaagatgggaccatgaacagtcaggagagtgaatagccagtgggggacctgtgcaggagggtcgggccttacgatctgcggaaggacagtgcggggccgagatcaggtctggatcctgcgccaggcagcaggagttggcatggggggcccagcaaagactcacttttgcgtttctgaaattgcccttcttctttgccccagtcttctgaatgtttggtggagatatcctgggtatggacttttttggacatctgggtgacacgtgagcggattgtgctggaggaccgagtcatgctgtgagccgagccccgtgggtgtgctacgtgataggggaagactcctgtacgagaagcagcagggccgggggcatcgtgaatcaggctccgggatgtgtgtgggatagagagttgggaagtgctctggacgtagtcgccatggaggtaactggaatgatacgcgccgtggtggtcttggtgctgatggtagtctcggtgccggtgggtctggtggtagtggtgctgtgtgtggtggggatggtcgccatggtggtactcactggggtggtgatcaccttggtggtactcgctgtgatagtcagatatcccacgctggtaggaccccacagaggaatgaggggaaatggtctctccgtgatgaggagactttccatgctggtgggcttcatgatgacgggacctgccatggtggtggacttggtgatggtggggccagccacggtgggggacttggtgatgctgggactcatcgtgttggagcccgctaaggtgggaagcctcgctgtggtggaaggactcactgtagggattgggtccatgggggaggtaggacccaccatggtgggaagcctcaccgtggtggggcacgccagaggaatagtgggataaattctcaccgagatattggggtctgccatggtgagaccccctatggtaatgggagtcactctgctgatggaacccaccgtattgggacccatcatgatgcctcctgccatcacgttggagctcatcatggtagtcctcaccgtaggaacggtgggaggggacggcgccttgagagggagccagaccaaagcctgtggggccatgggctctgccgtgattccgtgcctcgctgtggtggtgagattggtggacatgggaggacaaggcttggtcgtggaagtcttggaactccggagggtggtgagattcaccacgttggtggggcacgccgtgatggtgcaactcgtaatggtggagagctctgctgtggcctggcctgtggtgtgggggtgatgagtgagagcgaaagaacctatctgcgttattggtgtctgcctcattctgagccttttcaggcactgagttttgatccatgactgtgctgggaactctggagccaaaagagctcaagacctgggcccaacaggccccgcctggatttcccttctttcctgagccaagctcaatgcagactgtggcactgggcttccagaaaggcctgactattctcgtggaactctcccctctatgatgtcaccagcaggccagggcctcattcccaaatgcctcttcctgggctatagttcggaatcaagaattattgtgtcaaactccttcattgtaaatgaggaaaccgaggtcaagaaaagggaaggactagaccaaggtgacctcacaggtcactggcaaagctggacaaagaagtccatgggggcgccatggcttcatcagctactttagccctgttgttggaaagaaaatggtccaagtggtccagtcttcagtcccatctagagatcagctggctctggggtgaagactgcctgactccctcataagtaggtgtgtgaccttgggcttgttgctgaactttcccgtgcctcagtttcttcctctgtaaaatgggaataataatacctagcccacaggatcaaaaaagttaagatatgtaagccttatattaacagcataatacatggtttttgttgttgttgttgttgtttgtttctttgtttgtttttgagatggagtctcgctctgtcgcccaggctggagtgcagtggcacgatcttgactcactgcaacctccacctcccagcttcatgccattttcctgcctcagcctcccaagtagctgggactacaggcgcccaccaccacgcccggctaactttttctatttttagtagagacggggtttcaccatgttagccagaatggtcttgatctcctgacctcgtgatccgcctgccttgcccttccaaagtgttgggattacaggtgtgagccactgcgcccagcccatgtttttttgtttttgtttttgttttttgagacagtctcactgtcacccaggctggagtgcagcggcatgatctccactcatggcaatctctgcctcccaggttcaagtgagcctcctgccttagccccctgagtagctgggattacagccacccaccaccataccccaccccggctaatttttttttttttttttttgagacagagtcttactctgtcactaggctggagtgccggggtgcaatcttggctcactgcaatctctgcctcctgggttcaggcaattctcctgcctcagctttcctagtagctgcgactacaggtgcacaccacacccagctaatttttgtatttttagtagagacggggtttcaccatgttgacgaggctgctcttgaactcctgacctcaaatgatccacccacctcgcactccctaagtgctgggatttcaggtgtgagccaccatgcctggccaatacatgttaattggcattattattctcttcttgatcttggaacccccctttagggttattaccaaaattaaactatcagccatcatttattgaggattgcttcatacacattttgttttctttctttctttttttttttttgagacacagtcttgctctgtcacctagggtggagtgcagtggcatggtctcagctcacagcaacctccacctcctgaattcaagcaattctcctgcctcagtctcccaagtagctgaaagtacaggcgtgcaccactacgcccagctaacttcttttgtattttagtagagatggggtttcaccctgttggtcaggctggtctcgaactcctgatctcaaacgatctgcccgcctcgacaacccaaagtgctgggattacaggcatgcgccaccgtgcccggcccatacacattaaatttaatcctcacaatagccccacatggtagatattgtttatccccatttgacagacaaaggtgctatggctcagagaatataaatgagttgcttgatgaatgaaaacttaccgtcagtgctatctcactccaagtctgtatctgtaaccttcatgctgtcctgtcttcctcctggaatccactgcagagcttgccctgtatgctgaattcatatgtgcacagcgcagctcttctggaagcttatgggtctcagcttcttgagtgcttggtcagagccatgtccatagtggctgctgggttcccagtgatgaaagagacacggctcctgttttaaggagctcactatctgttgccagcagcagacaaagaaacaatttgtgtgggctgggcatggtggctcacacctgtaatcccagcactttgggaggccaaggcgggtggatcgcctgagctcaggagtttgagaccagcctgggcaacatggtgaaaccctgtctctactaaaatacaaaaaattagctggatgtggtggtgtgcgcctgtagtcccagctgcttgggaacttgggaggctgaggcatgagaattgcttgagcccaggaggcggaggttgcagtgagctgagatcacaccattccaacaagagcgaaactccatctcaaaaaaaaaaaagaaagaaagaaagaaaaagagaagactctaccctgagagagaacaacaacctcacatgttgatgacatgatctctgatactgaacaggttttcgtttttgttttcttgataataaactgaaaaacaacttgcttttttttttttttttttttgagacagagtctccctctgtcgcccaggctggagtgcagtggcgcgatcttggctcactgcaatgccgcctcctgggttcacgccattctcctgcctcagcctcccgagtagctgggactacagaagcccgccaccacgcccggctaattttttgtatatttagtagagatggggtttcaccatgttagccaggatggtcttgatctcctgacctcgtgatccgcccgcctcagcctcccaaagtgctgggattacaggcgtgagccaccacacccggccacaacataatctttatcctggctgatgagtcaacttatttcaccaataaaatggtgaatgcttaccacgccatagcactagtaagatctgtaaatggtcagcatgatcatcgagaaaatgtttcagcttttccaaacaaacaaaaagccaagatagatttaatgtcatttcatatcaggaatcatcaaaaagtctgtcttggaagaactaccttggcatttatactgatggttcaaatcagtggttagctccataagaatttttactgttcttggaaagaaacaaaaccacaaacaaaaacttgatgttgtcacaacacactgctttcttcacagagaggcactggtgtcagaaactcttggagatgaaaagtaatgatggagcaaaacgtttgcctttattcaacaaagactcactcacttgaaaatgttttaaaaactggccaggcaggctgggcgcagtggctcatgcctgtaatcctagcactttgggaggccgaggtgggtggatcaggaggtcaggagatcaagaccatcctggctaacacagtgaaaccccatctctactaaaaatgcaaaaaattagccgggcgtggtggcgggcgcctgtagtcccagttacttgggaggctgaggcaggagaatggcgtgaacccgggaggcggagcttgcagtgagccgagatggcgccactgcactccagcctgggtaacagagcgagactccgtctcaaaaaaatatataaaataaaatttaaaaaatgtggccaggcaggctgggcgtggtggctcacgactgtaatcccagaactttgggaggctgaggcaggaggatcacctgaggtcaggagttcgagaccagtctggccaacatggtgaaaccctgtctctactaaaaatacaaaaattagctgggtgtggtggcgggtgcctctaatcccagctacttgggaggccaaggtgggagaatcgcttgatcctgggaggcggaggttgcagtgagccgacatggtgccactgcactccagcctgggcaacagtgctgggattacaggcgtgagccaccaagactggcaatatatttgtttttaattttaaaaactaaaagaaaagccggcatggtggctcatgcctataatcctagaactttgggaggccgaggcaggtgaatcacttgaggctagtaatccgagaccagcccggccaatatagcaaaaccctagctctactaaaaatacaaaaacaaaaacaaaatgcagctgggcatgatggtgggagcctgtagtcccagctattcaggaggctgagacctgagaactgcttgatcccagaaggtggaggttatagtaagccaagatcgtgccactgcactccagcctgggtgacagagcaagactctgtctcggaaaaaaaaaaaaaaaaacttagaaaaactgaaatgaattaaaagcactgtataaaaacatagacaaggcattcttttttttttttcctttttgagatagagtttcacttttgttgcccaggctggaatgcaatgatgcgatcttggctcactgcaacctctgcctcccaggttcaagttctcctgcctcagcctcccgagtagctgggattataggcatgagctactgcgcctggcctgagcacagccattttcttttcttttctttctttctttttttttttttttgagacggagtttcgttctgtcgcccaggctagagtgcagtgacacgatctcggctcacctcaacctccacctcccaggttcaagggattctcctgcctcagcctcccgagtagctgggactacaggcgcccgccactaggcctagctaatttttttgtatttttttggtagagacaggatttcaccgtgttagccaagatggtctccatctcctgacctcaagtgatccgtctgcctcggcctcccaaagtgctgggattacaggtgtgagccaccgcgcccggccaattgagcacagccattttctagcacacgcagacatctggtggtggagcactctgtatgggaccattgagaaagcctgggtctggccaggtaaagaggctgacacaatctacagcatgagtcatcccatctcatcaccgagggctgctgcaccgatggctctctgatgggcacttcatatgggaatcttcccaccctgtgactattttgagaagctggccacagtcctgtctcctaggccatcagattgccagttgtgctctttcaaagtctctgcagctggccagcctatcagatgctgctcaccagtccatgtaaatctgtaccttaggccacctttcctccacagaaagcatccacagatgtattgccccaaagttccacccactgggagaattttccttcaccactgtctgtaacctcaaactcctgagctcaagcaattctccctccccctttagcctcccaagtagctggtactacaggtatgcaccatcacacctggctaatttttaaaccttgtttttgtaaagactgggtctcactatgttgaccaggctggtgtgaaactcctgggctcaagtgatcctctcatctcagcctcctagaatgctgggattacaggcataaatcaccatgcttggcgctcttgtcttgtctgtctgtccctcccttccttccttccttccttccctccttttctttttgctttttttttttttttttttgacggagttttgctcttgttacccaggctggagtacaatgatgcagtctcggcttgctgcaacctccacctcccgggttcaagcaattctcctgcctcagcctcccaagtagctgggattacaggtgcccaccaccacgacccgctaattcttgtatttgtagtagagtcgaggtttcgccatgttggctgggctggtcttgaactcctgacctcaggtgatccacccgccttgtgctcccaaagtgctgagattacaggcgtgaaccaccaagcccagcctcttttctttttttaaaaaaactgagtttcggccgggcacggtggctcacgcctgtaatcccagcactttgggaggccaaggtgggtggatcacgaggtcaggagatcgagaccatcctggctaacacggcgaaaccccgtctctactaaaaatacaaaaaaaatagctgggcgtgatggcaggcgcctgtagtcccagctacgcgggaggctgaggcaggagaatggcgtgaacccgggaggcggagcttgcagtgagccaagattgcgccactgcactcccacctgggtgacagagcgagactccgtctcaaaaaaaaaacaaaaacaaaaactgagtttcactgtgttgcacaggctagagtgcagtggcgcaatcttggctcgctgcaacctctgcctcccaggttcaagcaattctcctgcctcagcctcccaagtagctgggattacaggcacctgccctgacgcccagcaaatctgacgcccagcaaatctttgtatttttagtagagacaggatttcaccatgttggccaggctggtctcgaactcctgacctcaagtaatctgcctgccttggcctcccaaagtgctgggattacaggcatgagccaccgtgcctggcccctccagtgttttcttaaatccaggctagaggtcagcaaactccttccacgaagtggtaaatgtcttaggctttggatgccatatgatcttattgcagttacccaactctgccagtgtagagcataaacagcattagacaagaagtaaatgcatgaatgtggctgtgttccaataaaactttatttacaaaaacaggtggtaagccagatttgcttgtagtttgctcatccctggtctagacagtcaacaaatcaataaaacctctgatgtataatgtttgttgatttgtagtgtaaatactctcacgatggctgatttcaggctatcaatgtaacaccaccaagtgctgtcctggaagagataggcagtaaataacacactactggctgggcacagtggctcacacctgtaatccagcattttgggaggccaacgcctgcagatcgcttgagctcaggagtttgagactagcctgggtaacatagtaagaccctgtctactaaaaaaaaagatttagcctgacagagtggcaccagggatgccaggctgaggtgggaggatcacctgagcccagggaggtcaagcctgcagtaagccaagatctcaccactgtactcatctgggcaacggaagtgaaaccctgtctcaaaaaaaaaaaaaaaaaaagtaaattgtagtaaactaattagtaagtgatgagttttgagtatttatcgtctttattacttatttattatttttttgagacgcagtctcactctgtcgcccaggctgtagtgcagtggtgcaatcttggctcactgcaacctccacctcccgggttcaagtgattctcctgcctcagcctcctgagtagctggtattataggcgcacgccaccatgcctggctaatttttgtatttttagtagagacggggcttcatcatgttggtcaggctggtctggaactcctgacctcgtgatccgctcgcctcggcctctcaaagtgctgggattacaggtgcgagccactgagcccggcctattgtctttattatttatacaatttatttaattgtaattttatacaatttaatttttttttctttttgcaccagagtcttgctctgtcgcccagcctggcgtgcagtggtatgatcttggctcactgtaacctccacctcccgggttcaagcaattctcctgcctcagcctcctgagtagctgggattacaggcacgtgccaccacgcccaactaagttttctatttttagtagagatgggatttcaccatgttggccaggctagtctcaaactcctgacctcaagtgatccacctgcctcgacctcccaaaatgctgggattacaggcgtgagccaccacgcccaaggaaaatttaatttttaataatggttgtgtccaacaactggcttgcacaattcagctttcttttttttttttttttttttcttttgagacgaaatctcgctctgttgcccaggctggagtgcagtggcgcgatcttggctcactgcaagctctgcctcccaggttcacgtcattctcctgcctcagcctcccaagtaactgggacttcaggcgcccgccaccacgcccggctaattttttgcatttttaatagagatggggtttcaccgtgttagccaggatggtctccatctcctgaccttgtgatccgcccgcctccgcctcccaaagtgctgggattacaggcatgagccaccgtgcccggccacaattcagctttcaagagccaataagaggctgacctgacataccgttgtgttcagggaatggaatgtaatccagtgtggctggaatatgatggcgtagggggcaatgggagatgtaggtggaaggttttggggatcagattaggttggcgtggggagaggtggtttcaaacaggggagtgaaaggatcatattgctttaacaaggatcaccctgaatacagagtgggaagcacgtttggtgtggggaacgtccgaggcaaactgttggattaaggcagatgttgtagggaaagaggtgtgcagagtcacagttattcaggagtcagaatctatagacgtggtgacaggtggcacaaggggaagggggaaggaggcattgggaggtgccaaggtttgggctcaagcatcaacttgagtggggggtttcagtcatggaaactgacagactggagatggagccagtttgggtagaagatgagatgtttggttgtgagaatagtgggtttgatcaagctgggggacacccaggcggggagccctgggctggagacagagttgggatataggagccagggtcctactcctgtggccccagctcatgggggtgtccttattctcagggctctgccctggctctgggccacctctgggagccacattccctctctagttctcagtcttcccatttgtttttgtttgtttgtttgtttgtttgtttgtttttttgctttttgtttttcttattgagatggagtctcactctgttgcccaggctggagtgcactggagtgcagtggcgtgatctcacctcactgcaacctctgcctcccaggttcaaacaatcctgccccagccttgcgaatagctgggattacaggcacgcaccaccatgcccagctaacttttgtatttttagtagcaacagggtttcaccacgttggccaggctggtctcaaactcctgacttgaagtgatccacctgcctcggcctcccaaagttctgggattacaggcgtgagccaccatgcccgggctgagtcttcccatttgtaatggagtatgagagcctgactccttcgccctctgttgcgttgtagcaatcccatgagattgggatgaaggtggaggatgggggtggcagagggtgatcctgtcctgtcctttgcccactggagggcaccagggaaactcttgctggggagaagaggattggctggcagggatcctcagatttctgtagccctgctgggccagaggagctaatctagaatctatgaggttgagagaggggctccccttcctcttctccatgcccttctctggctgggactgactgtctagcccctttcttcaggcacctctgccccacagcccctctgcacgcctctggcccattctgggaagctgcccggttgtgttggcagagcaccagcttctctctctttgcctcacctcaccttgggctcccaaagaacttgggctctctgcctctccctcccactcaaacctgctcccaggaggcttttataatgaggctgtttaataaggagcctgcagggatggctgggagggtgtttcacggggtcgggtaatgtattatggtgggaggacctgggctttggagcctgagcagtctggtttctgtcctagctcagcttctcccggctgtatgagcctgggcacttcaactttttgtatctcagtttcctcttctacaagaggggatatagctgggtgtttagtggtacctgcctataatcccagctactcaggagtctgagggaggattgcttgagcctgggagtttacggctgcagtgagtcacgattgcaccactgccccctccgagtagctgagacttgtgtgacaagtgagaccctgtctctaaaataaataaaagagggagagaagagtaacagctacctcttagggtgttgtaaaaatcaagtaagttggctgggcctggtggctcatgcctgtaatcccagcactttgagggtccaaggcaggtggatcgcttgaggccaggagtttgagaccagcctggccaatatggtgaaaccctgtgtccattaaaaatgcaaaaattagccaggtgtggtggtgggtgcctgtaatcccagctattcgggaggctcaggcaggagaatcacttgaacctgagcggcagaagttgcagtgagccgagatcatgccactgtactccaacctgggcgatagagcgcaactccatctcaaaaaaaaaaaaaaaatcgagtaagttaaaatacataaagtgtagagaagagcacctagcacaggggtccccaacccccaggccatggacgttaccacctgagctctgcctcctgtcagatcaccattagattctcttaggagtgtgaaccccctattgtgaactgcatgtgcgggggatttaggttgtgcactccttatgaaaatctaatgcctgatgatctgaggtggaacagtttcatcccaaaaccatcccccttaacccctcacaccacggacaaattctcttccacaaagccagtccctggtgccaaaaacattggggaccactgacctagcatatagtaagtgatatggtttggctgtgtgtcccccccacccgcccagatctcatgttgaaatgtgatctccagtgctggaggtggggcctggtgggagatgtttggatcatggggtagatccctcattaatggcttggtgccatccccttggtgatcggcgagttcttgctctgagttcacagtgatctggttgtttgaaagtgtgtggcacctcccctcagagggcattgaccttgttcctgcttctggcatgtgatatgcttgcttccacttcacctttcacacaattgtaagcttactgaggcctcctcagaagccgagcagatgtcagcaccatgcctgtacagcctgcagaactgggagccaatcaaaactattttcttttcttttctttttcttttccactttgtagcccaggctggagtgcagtggctgatctcagctcactgcaagctccacctcctgggttcacggcattctcctgcctcagcctcccgagtagctgggactacaggtgcctgccaccatgcctggctaatttttttgtatttttaatagagacggggtttcactgtgttagccaggatggtcttgatctcctgacctcgtgatccacccgcctcagcctcccaaagtgctgggattacaggcatgagccactgtgcccagccccaatcaaacctgttttctttaattacccagactcacgtatttcttcatagcaatgcaaaaacagcctaatagagtaagtgctcagtaaaagttagtagcattgttcttattaacgtgccttctctcagtggcatttgcagcttttatttttggatggagtctctctctgtcacccaggctggagtgcagtggcacaatctcggctgtctgcaacctctgcttcctgggttcaaggcattctcctgccttagcctcctgagtagctgggattacaggcatgcacaaccacacccagctaattttgtattttagtagagatggggtttcaccatgttggccaggctggtctcaaattcctgatttcaagtgatccacccccacttggcctcccaaagtgctgggattacaggcatgagccactgcacctggccatgcagcttgttactaaaggcctttctcctgcttacctcagtggctccccatcaccaaccagagagctgtccttacatgccacggctgcagatggacagagacagtgacttcctcagctctggggacagcctggcctcccctgctggtcatctctggacattccacttatgccagcatcccaggcaaaacaatcccaagttttagaaaaattattttaaaatctcctcctgatttggcccagcaaatgagactgactgacactgtatggccttttgaatcattctcagaggaattcagctgggatcaggagaaatggataaatgttttttgagagaacagatggcatctggggcaagagcgcacccccacccaaagaaaaaaagtgtcttaaatgttcgttgttcctttttttttttttgcctcaaaagtcacatttattcaaagaaaagaatgacaaggctgagtgcagtggctcacacctgtaatcctagcaatttgggaggctgaggcgggaggatcacttgagtccaggagtttgagaccagcctgagcaacatactgagaaccctgtctctacaaaaaagagtaaataattagctgggtatggtggcatgagcctatagtcccagctacttgggaggctgagatgggaggatcacttgagttcgaggctgccgtgagctatgatcatgccactgcactccagcctgggcaacacagtgagaccctgtctcaaaaaaaaaaaaaaaatcaaggctgctcatagcccataccatggctgtggggaaagtagaagaaatcaccccttcctcaaaatgctttcttccatctgctgaaaaactcttgtaatagatgtgtcaaactatagcatctgtaacatgaaaggtgttgaccctggaggagtcctgatgaaaccagagatgccatcttgggagagcctctgtgtgccaggccctgtactaggggcctgcttatttcacaggtgaggaaagtgaggctcaaaggctaagttcaaagtatgtaactggtagatggcagagccagggtttgaactccagagccccagtgtttaatcattaggcaagatcatccccatcgagtcaccgttggccaggtttactgcctccacatcgtctctagaccttagggtaagctcctcaaggcagggaccacttttcactcactgccaaagctctggcactgttcggagtaggcacagaggtaggcagcaccaagtgtttgttggtggaaggagcctctttgcaggagtcctaggggctgaggcctgttcccctggcttgtggctgaagctggagatgttcccaccaaagagttccagagcccctgctcagctttaggatttgcccttgcccctgagtcaaacagagcaccctctcctagtgcctgatgattccatttgcccctgattccagatttttctgaggccagagttgtgctctctgctgaagcagggcaaggtttttaaaggagggcccgcctgcctgagggccagggaggccaggggaggcctattgcagtggtttggctgtttgtcccttaaacctcatgttgacatttgatccccaatgttggaggtgggcctaattgggggaggtgtttggctcatgggtatggattcctcatgaaaagattaatgcccttcctgggggataagtgagttttttcactcttagttccaagagctggttgttaaaaagacctggcacctcctctgacccccttgcttcctctctcaccctgtggtctctgcatacttgggctcccgagcggaagcagcctgagaccctcgccagatacagataccaatcctgaactttctagtcatcaggattgagtcaaataaacctttttctttacccagcctcagtcactcctttatggcaacacataatgaactaggacacttatcaaagtagacttggccgggcatggtggctcacgcctgtaatcccagcactttaggaggccaaggtgggcagatcacctgaggtcaggagtttgagaccagcctgtccaacatggccaatccccgtctctactaaaaatacaaaaattagccaggcgtggtggtagacacctgtaatcccagctacttaggaggctgaggcaggagaatcacttgaacccaggaggtggaggttgcagtgagccgagattgcaccactgcactccagactgggtgacagagtgagactgtctagaaaaaaaaaaagtagacttaaaggcacgtctgaattttccaggccaactgagggcaaggtgaaggattttcctggcagaggtatgaccagaggctagggctgggggtgcagatggagacaatggcaagcaccttattggctgggggccagaggacacctgtttttggatagatcactttgagtctggtacaattctttactgctgcttaatgtcagaaacttaattatgcttttgcatgattctaattattgcctttttcagagctctgctggtaaaaagtggggtgccatacaaacagtcccttttcaagcccagcgtgtcatgcatcctgccaatcaatcactgtaatgtccattgtccaaacaggtcaaccgttgtctccatgaaaaactggataaagagttgctgatagcagtgtcctggttcttccctttacattcttttgggggaaggtgctgggaatcagcctagcttgtggcatgtgaccttttttatttgaatggcactacagacagcacttgtgagcacaaactctgaagccacactgccttggttgagatcctagtggccactttctggctgtgtgaccctgacttaatttcccccaagtttcagttccctcacctggaaaacggcacccatctccaaagttaacatacataaagcccttaaacagtggctggcacaccgtagaccataatagctattgttttttatcacttgtccagatacgtcgatatagctctgaagaaagtaacagaaaaagttccaattctctgctagtcttaagggagatttcacctggaagtgctggctatcttgctgtgttaaaggaaactgcagaaagggactggtcttcatctgagtccaagttgtcttcttgtgaggaaagcaggccattagtgaagtcagtgattcacaggaggaggtcaaattctgagttaggcagctccttatctgaaaatgatcctccttccacccaaagaggtgttgtgctctaacccctccagtccttcctctttgcttacctgtcttgctcctgttccaatgtttccccataagctccatgaaaataaggccctatctatctggttcacctgtatccccaagttacagagatgatgctcagtaaatgtcgcagaattttgtgaaaaagaacgatgtggaaagtgagtggggctaaggtggccagtctgtgttgggggcccagtcggtcaagcggttgaggagggttgtaggcctatgccaggtggcgggggaccttgagtccaggcccccatcctcatgggtccagccacagctcctcctgggcatccgtttcatcctcaaatgtggggaatccggcttctatgactgacatacaactcgcacattttaaagatgttttattaaaaaaaagaaaaaccaaccaaacaaaaatcccaacccaagaactcttggttctgggagactgggagcagcttaggtctgtggggagggtagaacctggaagacagaaaagtatagggagcctcaagccctgggagggagagcaagagcagcctttccctagggctgagcctctctccatggggcctgggcttatccacttggaaaagacaggttgtgggggctcagcccccagaaaaaggcagggtgagcagttctggacagccctcaggcctcttgtcaaaatcaccaaccagctgggaaggagagggtggcccagcgctggatccagcctatcagcgccgtgcccgaaggcaaggttcagcccacgatcgggagcgggggctcagatagggaggcgtaccccaaagttcagcgagggactcaagccccttgaaaagaaagggctctcatgggggcaggacatggaggcagcccctggctggactcctgggagggcagggcaggacccatactcctggaggcctgcggagctcagggaccttgagggccgcgaggcagcactcggatgggccgaggcgggggattgtccaggacgggctcgggccgagcccgcgcaccgccccggcgcttctgcttgcgcaacaggtagttcgagtactggacctcgggcatggccagcttgaggcaggcctcggtggccgggccggcgccgccgccgggcaggtcatagcccataatgtccaccttgcggctgggctgccacggctgcagctgcttggtgcggatctgcgcggcaggccgcagcagtggctcgtccccgaagcagcgccgcagtaggcgctggcgggcctcgcgcagctcgcgcgcctcgcgctccacgcacgcgcggcccgcgcgcgccacgtggcgccagaaggtggcgttgaagtggtcgtagaggccggcgtccagggcgttccaggtgcgcgccgcccgcgccagcgccgcggggatggcggccaggcgcgagctggcggcgcgcgcgttgagcttggcgtagagcacgtcgtccaggtcccaggccagtaggcgccgcagcagcactagcgactcgtcgaagtactcggcgatcatgacgagcgagaaaacctcctccacctggcggatgaggcccgccaggtaggcggcgtcgtcgcgcgggctgcgctcattgtcgccgcccaggtcgtaggccagcgtgttgtgtgcgaacatggcgaagtgctcgccagcgcggtagtatgcctcgggcgcgcgcaggaaggcctcgagcgaggcgttgggtacgcgccggaaggccgggcagtactggttgtagtagctgaagagcgactcgaacatggcggccggctcgcgcaggatggtgacatagacggtgctgggcggcatgaggcgctccagctccgcacggtcgaagcgcaggtggctggccagcacgtgcggcggccgcgtggccgggtgcacgaagtgcgccgagaagttgcgggggtagcagaactggtgctcgcagctcgggtgcggcagggccaccgtcaggttgtggcgctcggcaaagcgaaacaggatgttctgcaccgtcgtgcctgccgtcttgtgagtcttcaggaaggccacagtcatgtgcttggggcgcggcggcgagttccgcagaggagggcagctcaaggggaacagcttggggtacctgccaggcccagggagtgtgcggagaggagggtgtgagggggctgccgcttgacccctgcccttacccaaggactgtgggatgccccacagcgcggccccgcctgggctgcactcatggaaaggtcgagggcggtgcttggtagcctctaagatgccctctatgatccctgctgccctcctggtattcatgcccttgagtattcccctcacctgagttaggctggacttatcattgcatctaaagaagagaagagggcagaaatgatgggatgtcacttcttaaatttcatcatagaaagactgtggctggctagtatcttggtgtctttcactcaatctgggatgacagatgatgggggaagcaagctgccatatagtgggcagccctatagggagctaccactaagtgggaaaagcccacaaggacctaaggccctcagtccaccagccggcttgaagacctgaagcctgtcaaaaccacgtgagtgagcttggaagctgatcccttccaatcaagccttcggatgagactgcatcaccagcaaacaccttggttgcaaccccatgaaagaccttggtccagaagttcccagtaagccacacctggcttcctgacccaaaataacagatgtttgtgttttcagctgctaagctttaagataatttgtttatgtagaaataaataagggacaaagacccctggagatctttgaggaatcccactttgtatatgtagaaactgagggccaaaaggagaacaatcacttacacaaagtctggagacgactcacatggtcactaaatccttttgctctttctcatttttactctttaactggctcctcactttgtagatggttggcactgggctttgcagcaacccattgttatgtttctcttgaggcttctaaagcctcattaattcagtcatcaaatattttttgggtgtccactatgtgccaggttaatgctaggttcaagaaatacagtaatatacaaaaacaatcctagccctcgtgaagctttcatttctgttgcttcattcttaaaacatgggtgtttgggatttcaaaccaaattatctggcaaggggggctgggcgcattcacaccattctcaggggcagacagtgtagaaaatggggacatgaagtctccgagaggtgcagggatttgttgggttcacacagtgagtcaggagtagggttggggttcccatgaatcacatggtatcctgtgtgagggtgactggctgtgtcacacatatcatgtctcactttatagatgagaaaacgggggctcggagaagtgaggggacttggccttgcccagcactacggaagttgtgagaagttgtttccactggggaaatgcttagctgcatgctgtggggagttgagctggattcggatctcagctaactgattctgtaactttgagcaagtcactcagccctttcattgaagagcagtccctgtccagggaggctgtgtggccctaaagggaaagcactttcagaatagaggggaggagcaaagcctagcaggacccttctagcaggtggaagaatggggaggggagctccggcccccctggggccccgcccccttaccagctgagctgcgccccctggtggatgagaaggcttacggtgctgcaccctagcaccagcagcaggattttccggcggctcatcatcttggtggcctgctgcaggcgctggaggatgggtggcatggcggagtacccacccctggaccagccagggcctcactatccaggactcccttcacaggcactcatgggggatcctgcggctctggtagcagggccagtgttcccgagaagcctggcagaagaaggcagacgggtttgcagtgggcagaggagatgggatctggcccccagcaggtctgatgcaaagagctccaacaggtggggtaagcagagaggccagggcagatcggattcctacctcccgttatcaagaccctatctcctcactgctccagataacttagtcttgggtggaattacagggtctggggtgtagccagcccttcaggctgtagccactcccatccctcagccctgtctctgtctctctgcctgctcctaactcgtctttgtctcatggttatttgtacatgtctccccagtggagtggctttagcgccagggcttggctcagaacatagaggtctcaactcaaagtttcctctcctccaggactccttgcccaattgctttagcccagggttggtcctgactccccagagaaaccgagctcctcggaaacactgatcaggccttcacctccttggatcgatatggctttgagtcgatactgcaggcttactctatgtactgtattattacatacttaatcccatttagtcctcaccacagccctgacctaggtattattcccactgtatagataaggaaactgaggctctaagagattatatcacttgtccatagctacacagctggtaacagtagaaatgagattcatacctgctgtttctggctccaaagtccatgcccttagacactgtatatgctatttctgtagagaactggtttccccaaccttgccctagactctggcaattctgcatccttctgagtcctgagcgctcctagctgggctcctgccctgagggcccaagactgagaaattcatgagggaaaggaaggtcttgaaatcctggagccctatctggattccatccccagacacctgaaacccaggcggccccatcagctgactctgcagggaaaagtgcctgaccaaagcaatgagatggcagcctgggcggggtgtgggttgggtaagaggtggctcctgcttgttgccctacggaggatctccaggagaaggtgagcttccatcccaggtaagcccaggagtaagagaggggaggagggcttggtcacacacaagtctcctttccccacaggaatgccttggcttaagggcagcccaatcctgggcagctcccgtggaaagtccacttcagcagtgatgcctgtccccaagctagggtggggcctcagtctccaggttcaagtttagcttcagccctcacacatatccttctccacgggggagggggagcctggaacctgatgggcatgtgcatgtggaactaggacacctgggtcccaggaggggtaaggtaatatgaaaacccttttgatcatcaccttttctgggagccctgggcttggcttccagtctctcttcttgaccctgctcccttaatcctggattacatttaaacctgtttgggtggaaagatgttctgtttatgcctccccttctctctaggccttatcgctgcttccctccacctgcctgcagacagacttaatccggccggagccaagggtaaagggtccagccacagagggtaaccaagggcacagcagaggaagtctaaggccctccctgtctcttcaaggattgctggggcagagaagggctggcctggcctggctggggctgcttgcaggaggaagtgagagcccttggccctctaaggatacacacctttttcctctgtcactcctgctgcttagagaacttggtgattagacagaagtgtcccaagatgggaagaggggagtctacatccacctttgctaaacttgcagaaaccaccctatttctcagaggattcagggtcagccaaggaagtcaagcctagctatgggggacctttcccgagggcagagcttctactggccgcacagagagagtgacaggtgcctggtatccccctctgtcccactcttgggcctttccccacttccctacatggctgagctctggggagctagccaggccccagtctgaggcctgcttagggacaggggacagggcatcctcagtgcaggaattccctggacaccagcccctgaaggcgggcaccagcttctgtatggccactgtcaatgacagggtgttcatcacctcctgatacagcctggtccatttctgagcaacttacagcttgttcaggttctttccgggacagccaggattaccctgccagtggtagcacctgcttcggcctgccccttacacctcccattctgcactcttggtagtgctgccctcctagagcacatagaacatttttctccatgacagaccttcaggtatttggaagcagtaaccctgtctcctctgggtgggcactcggccaggctaaacattccaggtcctgagagagggtgctgctcggacactgtgggaggcctgccttcccttggcaatttgactccaagatgcctgttttggagatggggccaaggcagtgcctctcagggagggggccactgggctgggtttccatcggattttctggctggtgtggggtgcatgatggtgctgctggagctgtgctttagagcagtggccctggctcctgccctcagatgcttcacacgactccccattgtgcctggtgtcttctccatagagagagttctcccagctatcccaggcaggtcaggacgcccaggctcatcagaatgtcagtgctaattttagtcagaacaatctacctcacgctgctgcccagttttgcaaattgctagcttttctccagggaaccaaagaaatagtagagccgaccaaagctttgaaaatgggccggggtgcccaccctcctaaaggagccctttctcctctgtctcctctgagctctagagctgaaaccgatgcacttagaggaaggggtgccctggactggaccacttggacctgactgctggatggcccggagactccatcctgtcctgacttgagggatgggacagcccagtgttgagggacgctgacccagggtgctccagaggaggggcgaagggctgagggggtctgcaaagtactggcctgggagagcaaatctttccacctccctctttttcctcctcccccaccccccagcctgcaccaggtctgcccctggccccccagcctcctctctctctcatccacccccgcatcatccctgccttggaattccctccatcctcctgtctccattactgcccacccgcaccatacctcccactccctcaatttcatcccagcatcccccagggatcctgccagtgggatctgatcaccataggggataggccagattggcccgctcaccctatcttctcccactttccaggggtagagcgcccccctcctcatgctttccaaccactaggcccccaagacactctcccgcccgcctctcggcccccatcccggtctggtccactcccacccctccaaccccatgccggccactgcagtactcacaccgcacgcctgggctctgcctctggcccgggttgggggcggccgccgctatctctggacccttgtctcgaaatccgcacggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcacaccggaggaaggcgaggggcggggccaggccacgagcaagtaggggagaggggagagaggggaaaggaagggggacgggggagggggggtggttccctggcttgcccgctggctgccgtgaacagtctctgggtggcatcttcagatgcagttgtcttactctggcaaccttgcagagttggacactaatgtggccagctcccttctctcactcaggcagggaaactgaggccgggaaggtgtctggatactcctgcattgctgggtattctggggcaccgccggtcatacgtgggcttctgggtgagccagatgctggtacacgtgcaggtactcacatcctctgtcctcctccagtagagaagcagtgctccagccttgtctggtcccatctctgcccacatgcccccttcccttccagcgtgtcccccataccctctgatgtagcttctggctgctcacccatttttcctcactaggactccagacccactcactcctgaccagagctatagtgaggctgggacccctgcctaggcacctgccaccaggcatcaaagaacccaagttcaatcctggtttgctcttaaatcccagagtcaagaggcaactccctaagccctattgcttccagctgtaaaatgggaagctgttctgaggtagcagagataatacacacgaaggctccatgtgaacttcttagtcctcagctcccatcacctgggagctgggcagcagcacctcccaaagccatgccagacatcaagagccctacactgagttctgtggctggcctgcacacctgctttctattttgctctgggcctggtaaagcaaggatcctggagctgggtagccacccaaaggtgggactggaaggggctggatacgcccttctaggcccacataggaaatagtgtgagggtccttgttatggttgaggaggaggaaatagggactctcagagtcagaaggactgctggtggccccagtttggcctcttgggcatgtcaccttctctgcccatcaatcttccgctgtgtacaatatcgtgggggaggaggatcttgagaccttgcctccttcccagggctgttataaaatgagactccaggccgggtgcagtggctcacgcctgtaatcccagcactttgggaggctgaggcgggcggatcacgaggtcaggagatcgagaccatcctggctaacgcggtgaaaccccgtctctactaaaaaaaatacaaataaattagctgggcgtggtggcgggcgcctgtagtcgcagctactcgggaggctgaggcaggagaatggcgtgaacccaggaggcggagcttgcagtgagcgcagatagagccactgcactccagcctgggcaactgagactctgtctcaaaaaaaaaaaaaaataaataaataaataaaaaataaataaataaaatgagactccatcagcctttagtttatcctgcctcagagaccccgcccccttccctagcacctacacatgccttggggccctcagcctcagatgacctgccctgggctctccagttacagggagcagaagagccttcctttgggctagaaaggttctgcctgagtgggctgacaagctggagggaagggcgctgtttttctgtcttcgttactgtcctttccgggtttggcttctcctctgggagtgtggctgcaggagcctcccatagtgatattgatggaaaggggaaaggtcaaggtttgggtaggaggaagaggacttcccacccagtgctaggatgtgagccaacctttctcaacccagtccttttccctgtctctcccaaacctcaccttcccccgacctggtgccccattctttttttttccctgttcccagcttcttctccactgggggcagttggcaaaatggagctggagaaaagatctgaaggggatgtgtagggggaaaatgagaccatttcacttgagtctccccactccctttctcaacacacataaaaaacacacacaggctagctgttggtgagagggcagagctagtggcagaggtggggagagaaactgaattgatggtgtgggacagggagaggtggatgctaggcaggcaagaatccctgccagtctctgcctctgtctccaaaggccaaggggagttggggtggggagtgggaggcaaggtggggcccccagtgcaggtgcggctgagggaaaagggcctgagtttatttttgagactaaaaaagacacaaatgctttcaccagaaacattgttcctttttttccagtaatcatttattgggcgcctcttgaacgccaggcgatgcgagactgaaaatgatcaagtccctgctcacatttttgggatagaggtaggaagaaagggcaagaaagacttaacaaacggtggagattcgaacgtattatgggagctctaagaaaggaaaggaaagcgggaggaggcttagtggagaagacgacatttgagccggcctggaaggtggaaaagggggctttagagtcgcccttcccccaggtcggcagctggagctcagcccgggcaggcctgctgctctcccggcttggatcccctttcagcccattcatccgggcctgggccgggggtgggcgggcagacaatcagacactgttttatcccaggcatcggctccagcctcccgcttggcgcccgcaacgcggggccgccggggaaatgagtctctcgggactccctgggagcgtaagcgttcgaggatctgaccggagggccgggccggaaagcttgagagccttcgctcccgcaggtgaggcgcagaaaacactccctcggggaagtgccagccctcctcgcagccccgccctccggcccgccgccggccttcggggccgtagcggcgcgcagggcccgcagagaccgagacctgcgcactacaactcccaggaggcctcgcgaccagaccgccgaggggccactagagaaaggtgcgtctgcggcgaatcccgtcgcccagcgcacggcagcgggtgtgcctgagtgcgcgtcgcctcccaaccagagaggacgtggcatacggcgccaccggaagttccggcaagtgggccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtgaggaacacaggaagtcgaggggcctttacgggcctgcggagaagcggagcctggttacccgggagactcgggtgcgaggggcggaggcaggccgctggggcctgacctggccgggctggcctgccccattgatcgtgtactttgccctgcaggtaatcgcgaggagctggtggagcggctgcagagctacacccgccaggtaggtgttggcggcgggacgtcaggataggccgagcttctccaggagaccttatataccccatcacggctcggtcttcattctttctttatctcggcacagcaaggcggaggcttgccctttttagcttgttcttgcctttgccagcttagttgtaatttcttgtatccatcttggtcctcttcagtgcccagccagagcgctggcagacaggcactgggtacgttttgttgaatgaattgggagcgaacgtcgtttagtgaaacagctagttttggactgacctagagtcctttctcttttgcagactggcatcgtgctgaatcggccggttttgagaggggaagatggggacaaagccgctccacctcccatgtcggcacaggtagggagattcttctgttttttaagattccatctgctgatccttttgtagttcatgagcatgatgattgggtgttcacgtgcatgtgtgagatgtgacacccttgcacattactcgcctgacctgagtggggaaaaaaaaagattccatatgttcagggtagcccttcctctcacttgcagttgttgggcagggaggtactgccatgacagaattgtgagctcttcagttctctctttgatgctgacacttgcctccttttccactgtctgcttctccaaaagcagcttgtggccgggtgcagtggcgcatgcctgtaatcccaccacttcgggatgcttagatgggacgatcgcttgaagccaggagttcgagaccagcctgggcaacatagtgagactctgttactacaaaaaattttaaaaattagctgggcacggtggcacgcgcctataaagtccctataaagaggctcaaggattgctggagccctggggttggaggctgcagtgagctctggttgcgccactgtactccatgtactccatcctgggtgacagaatgagactttgcttctttaaaaaaaaaaggggggaggtgatgggggaggggctgggagagtgtcagaaaaaatagctaatgcatgccaggcttaatacttaggcagtgggttgataggtgcagcaaaccaccatagcacacatttacctatgtaacaaacctgcgcatactgcacatgtacccgaaaacttacaataaaataaaattaaaccaaaaaataggaaaaaaaaaaaagaggcagggcgtggtggctcatgtctgtaatcccagcactttgagaggccaaggcaggtggatcgcctgcggtcaggagtttgaaactagcctggccaacatggcgaaactctctctactaaaaatacaaaaattagctgggcgtggtagcacatgtctgtaatcccagctacttgggaggctgaggcaggagaatcacttgaaccctggaggtggacggtgcagtgagccaagatcaagcccctgcactccagcctgggcaatagagcgagactgtctcaaaaaaaaaaaaaagaggcagggcatggtggctcatgcctgtaatcccagcactttgggaggctgaggtgggcgatcacttgaggtcacgagttcaagaccaacctggccaacatggtgaaaccttgtctctactaaaaatataaaaattagccgggcatggtggcaggtgcctgtaatcccagctacttgggaggctgaggcacgagaattgcttgaacctggaaagcggaggttgcagtgagctgagattgcgccattgcactccagcctgggtgacagagcgagactcttgtctcaaaaaaaaaaaaaaaatacagcttgaatacaaggaagactgacttgtccttacccagctggaagcaatcacccttttctttgcctgccccaggcacagttcccatgttcttttgtgtgacatcgagggctccctgatttgatttcacaccccttgcgtttagtagtcattggggtttgcattgcccagatacagtggttcctgtttatgtaagtcctctcaatttccatgttccttctgatccaggatttgcctcattttctctaaagcagtggctctgacctggcatctactgatctctgtgtgtaggatgaggagtccctagatggcctcagaggcgtctttgagtctcctagaattgtatgcagaatctatattcaggatatctttttggagagagtggatagcttcctttggttggtgccagaagttaacattctcatatctttatagagctgtggagcattctctcttatggagtggtaactatgtatcatttgacttagaattccagctcctgactcaaagtagatcccccagatatttgcagaatgagtagataaatgcttcctagttttatgatcatattttctccacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcaggtagggcaggtggcagccctggccttggactcattaggtccctgaaggggcagtggagccttagagaaagctgggtcctagaactaaggcttctgggaaggtcgggactaaagattggaacatgggcccttgactggaagaggatctcaagaagcaagagttgtggcagattggcgtgttgggtattggtgctggtatgaacttgttttcttttttaagcagggagatcattcgctgaaggaacatgagctcttggagcagcagaagcgggtaatacccctccccctaacctttgacctcgtggtccagtcagttggctgtcatttatagtgcttagagtgcaccattcaagttttccctggaggctactttgttctcaactaagttctagtatcttccaaagctttcaatttttcttgaagttcaggaattgacaaactatgacctgtggcctgcatgtgtatggcctatgagctaaaaataactttaaaattttttaagggttataagaaaacccaaaccaaaaatatgtaccagagtctgtacagcaacccataaagcctaaaatatttaccttctgacctattataaaaagagcctgctgacctctgctcgccttacatgacatcattctagataggactctgggtaattgagttatttgtattggatttagacagaataggactgtaagtctgggaatgttatataagatgtttggccccagaggtgcattgcatcagtcattacccagtgggttactcaggagtattaaaaagtaagtgttaaaaagcaacaagtatgagctgggtgccgtggctcacacctgtaatcctagcactttgggaggctgaggtgggtggatcgcttgagctcaggagttcgagaccagcctggccaacataatgaaaccctgtctctcagaaatacaaaaattagccaggtgtggcggcgcatgcctgtagtcccagctacttgggaggctgaggtgggaggatggcttgagctggggaggccgaggttgcagtgagctgagatcatgccactgtactccagcctaggcaacagagccagactctgtctcaaaaaaaaaaaaaaaaaaaaaagccacaagtctggacctgtgggtaaagtactgtctttgcccagattgtgctggatcttgaggggtggatataagaaaagagctcaaaagtttcttctgtataatttaatcttttggggaagaaaactctctgaaaagtagaaggcactgtttggctcaatatgaaattctctgctaggaaccagaagtttcctggggttttccttggtgttatttctagggattttccgttgtgatgagagggctcctccgtttggattagtagcctggaagtgtgggggtggaggggatgtcagcacccaagtggttcgtgattgttctccttgggcccattacccggctgaaagaatgcatttgccaggggctgcctgccaaatgcgttttcaggcagtatctactcccacttccctcccgtaggcagctgtgttactggagcaggaacgacagcaggagattgccaagatgggcaccccagtccctcggcccccacaagacatgggccagattggtgtgcgcactcctctgggtcctcgaggtgagaccctggaaccgaggggaagggcaaggaaggtgatttagacatttttaaaaagacttttaaggtatctatcacatttaaaaagggcatatatagtaaatatatagtttaatggttttttacacactgaacacacctgtacaaccagcacctggaccatgatccaaaacattaccagcattccaaaagccacgccacgtgccctcctcccctgcaggtttaccatcaccctttcagcaagagaggtaattttttacgtgagtgttttgcctcttctgacattggatttctttttcccgtctcttagtagctgctccagtgggcccagtgggccccactcctacagttttgcccatgggagcccctgttccccggcctcgtggtcccccaccgccccctggagatgagaacagagaggtgagactgatgatttattcctagggataagagagtggtagtttaggatgggactatttttggatttttagagaaaggttctgtgagaagatggggggacttaaattcctgggggtagtggggagcccttcttatttaaactaagggtatggcagagggactggggagacattactgaggcagagtcttggggtccctctgaggaacactaaaccccactgagcccagttggtgttgcccactctctgctgcttacatcacctgggcagcagcctttctagtccaagaggtggaagttggtggaaaaagggcactgtgggctgggtgcggtggctcacacctgtaatcccagcactttgggaggccgaggcgggcggatcacctgaggtcaggagttctagaccagcctcaacatggagaaaccccatctctactaaaaatacaaaattggccaggtgtggtggtgcatgcctgtaatcccagctactcgggaggctgaggcaggagaattgcttgaacctgggaggcggaggttgtggtgggccgagatcgcgccattgcactccagcctgggcaacaagagcaaaactccgtctcaaaaaaaaaaaaaagaaagaaagaaaaaaaaaagaaaaagggcactgtgatttgccttctctgactgggtgtctctggcagatggatgacccctctgtgggccccaagatcccccaggctttggagaagatcctgcagctgaaggagagccgccaggaagagatgaattctcagcagggtgagtgccaggcgttctgatgctgtagccacagaacctggagaggctgagctgagtcctcatccctctgtccctttccctggctcttggtaaaggcaggttactgtgaacgagtgcagggcagtggcaccgtgaagactcatcaccaccttcttccttacagaggaagaggaaatggaaacagatgctcgctcgtccctgggccagtcagcgtcagagactgaggaggacacagtgtccgtatctaaaaaggaggtagggattggagctgagtgtggaaggaaagccaggagatgggacttgggtacggaaataacacaatttgtaagtgttcagtaagtaatagcttctattttgtgccaatttccgccctcagcatcttatagatatttttcatttaattgctttgagttccaagtactatacgtgcctacattttacagctgaaaaagcagaggttctgagacgcacagtaatttacccaaaggcatacagcttgtgagtggcagaactttggagtctgactccaaggccccttcgcagctacttcatgagatggcctccttgggaaaagcctgactgttgaactgtgggggagaatgggggaggagtttaggggttggggtgctggcacagtgcttggattccctgacccagctggttttcctcctcttgacagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaaggtacaaggagagcacactaggaaggggcagtgccaaacagggaaggggctcagaggtgggtgagaggcagcggtgaacaggcatcttttagtgctggccttaggaactgggaaggggctcagagggcaggggtttcaccttgtctgcctccttagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggtcaggcccagccctcctggtgggaagcagggactctgggcacaggtggctgagatgcatccagagagggaccatggtgaactcttacagagctttggtggcttaaggttggggtgggttgggcagtttcattcacatctgagtcctgcttaaaagggctgattgttctgttctaggaaaagaagccagaagcccccaagctgtccaagaagaagttgcgccgaatgaaccgcttcactgtggctgaactcaagcaggtaagacctgagaggatcctgcaggccctggagcccagctgggagaccacctggggagccagggaggtgaaaaggagttctttgaaggaggtgtgggtgatttgggtttgggtcctttgaggaagaagagcttcagaactgagaagtcggggctctcgagaacacgcattactatgtgttttccagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggtgagggcctggcagggctcagacctgcccccgggtgtccccatccttcatagcagtgtgcttcaaaatgggaatctggtttgaaacccacctaccacctacttgttacttgtctaattatccttttgttttcctcctctgctcttcctcccctctgccttcactttgccagctcacctggtgactcctttctcagatgtactttgtggctagagattcgtggtggttgtgtaacttcttaattttaaagcttttagttaaatgctttgaattcaggaggtagaaaagaacatggggaagtctctgctttccagagaactgttgagattcatctcttgatgagatggtttaaaaactagttattgatatacacggctgaggctgatattgtatagtctgttttgttcagtatggattatgtaattttgaaaggttttagcaggaaggattttgatgactttcagggtgagataattgaggcttcccatgatctcatttggagttgggagctggattctctacatgaatttggtgagtacttgttaaggcttgtttgctgccattctccacaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggttcgggagggggctgggagaggtcaggctgggccttggggttgagactgtctagggcttttttttgtttgtttgtttgtttaaaaaagatggagtctcaccctgttatccaggctggagtgcagtggtgggatctcggctcactgtaacctctgccttgggggctcaagcagtcctcccatctcagcctcctgagtagctgggaccacaggcacaccacacctggctaattttttgtatctttggtagagacagggtttcgctatgttgcccaggctagtgtggaactcctgagctcaagtgatccacccgcctcagcctcccaaagtgctgggtttataggcatgaaccaccgcacctggccaaggagggcttttgaagcaactacgatagttcctcagccttagaattgcccatcgactaccctcggatgagatggaatttaaaaatgaggctctatttggaggagagatgcagatctggtggcttctttccctgatagactcttcgtatcctgtcttagaaatgataatagtttgtggtaggtggtttagggatggaggggccaaggggcagatgcttttaggaaacttttaatattgggagtggtagagaaattgctggttttttctgatccttgaaatcgtagtcaccatgatgtcatggaatttatgaggtggaagaattttgcatatcttcctgtcgagtgccctcattttacagatgaggaggcaggtcctaacgttggccgtgttctcatagtgggttattgacagcactgtgagtctggcctggtttttattccttccccgactttggccagggaaagaagtgatgagaatcagagtgggagccaggtagccctcactgggattttatatctgatgtgcgttaggattgtgctcccactgagtgtctgggtctacaatgtagcatgctctgcttttccctcaggggaaggagttcgagacacgactgaaggagaagaagccaggagatctgtctgatgagctaaggatttccttggggatgccagtaggaccagtgagtgtcagttagctgtctggggaagcagcgaagaggctggtggggattggagtggaaggcagagacagggatagggtttggcagatggtatcctgttctctttttcctgcagaatgcccacaaggtccctcccccatggctgattgccatgcagcgatatggaccacccccatcgtatcccaacctgaaaatccctgggctgaactcgcccatccctgaggtgagcattgtcctttcgttcattcttggccatttctgcttttgaactggaaggtaatttgtttgttttccttctctaactccaccatgtgtctctttatttacttaaaaaatattttattgacataatatttgtcatataccatgtgtatgtgtagaaaaacaaataatggtttttgttttttaaagaaactgacatgctcatcataaaatattcagtcagaattgacaagtacaaagatgaaagcaagtcacaattttaccactcagaaatagccaaattcactgtttggtgaatgtgtttccagatatgtctctgaatattaagaatgaccagagagaaataattttatctcagccagatgtggtgtctcaacacctgtaatcccagcactttgggaggctgaggtgggaggatcccttggggccaggggtttaagactagcctgggcaacatagtgaaaccgcacctctactttaaaaaaaaaaaaaaagaaaaaagaaataatttttttttagcttcacttcagtctctcagaaataattttatctcaagaatgtcttcaaatttcttattttaaaataagcattaaaaaaattgatgagtcattaaagtaaaacagtagtattgttaaattttagatagaaatttctgccccttaagataaatagattctgaacaagctagctttccaaagttaggaaaactcaataagaaattgaagtcatgttttcaatgtacgtattttggtttcagacagtaaagactctgccatgacagaagttattagcatactttctgcctcctgtctccttatcctgttgcctccagattttagttgtttattaattttggtttctaatgcttcataacatttgatttaattctgcagtcataatttccggagttcccaagtatcagctctgtacttttgagtgtgccttttctctagggcttcagaatttcttttgcagctaaggagtgaactgattgtgctcactgtcttgcagagctgttcctttgggtaccatgctggtggctggggcaaacctccagtggatgagactgggaaaccgctctatggggacgtgtttggaaccaatgctgctgaatttcaggtatgggccatgtactagcgatcttggttttacttaatgtcatgaaggttagattgttggtttatagcttcattatcagggagttgtgtgttctgacacagcagagcctggaaaagggcatacattttcctgagatgttaatgtaagctcctcactagaatttgagctctaggtaggtagggattattgtgttttgactcttacaccccttcagcttaaaacagcctggcacataataggtacttagaaaacatttgttgaatgataaagtgatctctttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacaggtgggggaagcagagaatgcctcttggaagtgggctatctttggggtccttctctttactccagagcttgttcctctctttacagtggccttatcactcctggaggcttttcatcagtgcctgctggaatggagacccctgaactcattgagctgaggaagaagaagattgaggaggcgatggacgggtaagggtaccagacagggctgagaggggaggaccttcacttccctttggctggctggctgactgttgttcctttctccctcatccttttttaaacaattattgaaccaactctctgccaggcactactgtaggcagtgaggagtcagcagttgaggtaaactggtaatcagagaacaagatactttcagatgtagataaggatgttgaagcagaggaaactgggtaatgggatggggtggcagggaggcctttgggaaggcctcactggggaggtggtgcttgaactaagacccgaatgaaaaagcgccagccacaggatcatctgggtcagaagtaacagtaaatgcaagcaagtgcaaaggcactgagacagggatgggctagtattttgaagctccatttttaggtagttgaatgtgtagtgttgttaggtcttcatgaattgacccctttatcatgaaatgaccctctctttatccattctgctctttgttccctttttcctgtttttctaccttcttttggattacttgaacaatttttatgatttcattttatctccagtgttggttaattagctgttaagtttttgctttgttattttagttgttgctctggggtttatagatcatgtctttatcaggatctaccttctcttgatgttacactgcttccagatagtattaagagccattatagtatacttcatttctctcctcccaatttttgcactatattgtcatatattcacttttacatatgttataaatcctatactatatagttattatttttgtttaaatggtcagttatcttttagggaggtttaaataagaatcatgcatgaagccatgtagttaccatttttgtttctttcatttctttgtgtatatccaggtttctatctgatatcatttttcctctgcctgaagggcttcctttaacatttcttaagttagggggcgtggtggcttaagcctgtaatctcagtactctcagtactttgggagaaggctgaggtggtaggattgctagattccaggaatttgagaccagcctgggcaacatagtgagaccccatttctacaaaatattaaaaaaacatttcttgtattgtgggtctgctggttttgaatttgttctgcttgagtagtcttaaaaattctttatttggccttcatttttgaaagatctttgccaggtttaggattctaggttgacaatcttttttctttcaacacttttttttttcttctttgagatggaatcttgctatgtcgcccaggctggagtgtagtggtgtgatcttggctcactataacctccacctcctgggttcaagcgattctcctgtttcagcctcccgagtagctgagattacatgtgcataccatcacacccagctaatttttatatttttagtagggatggggttttgccatgttggccaggctggtctcgagctcctggcttcaagtgatccgcctgccttggcctcccagcttgttgggattacatgtgtgagtgaccgcatcagccttctttcagtacttttaagatgttgctccagtgtcttctttcttgcattgtttctagtgagaaaactgctgtcattcttacctttgttcctgtgtacataatgtgtcatttttatttggctgtttttaagattttatcactagttctaacaatttgactacaatgtgccttggtgtagtttctgaatgtttctttgcttggggttttttaagcatcttagatctgggtttttagtttttattaatttggggaaaattttgtcatgatttctgcagatattttctctgttcccttctctttcctttgggaactcaaattattcctctattaatgaaataataaatgaaaaaataaatgaagagctcactgatgctcttcatttttaaagaaattcttctctctttgtatttcactttagaaaatttctattgctatatgttcaagtttactattattttcttctgtaatttctgatctaacagtaatcccatacaatataattctcctttctagaagtttgatttcgggtcttttaaatctattctttctctcttaactttttgaacatgtggaatgcagttataacaatattttatttttatgttattttattttattttatgacggagtcttgccctgttgcctaggctggagtgcagtggcgtgatctcggcttactgcaacctctgccacccaggttccagcaattcttgtgccgcagcctcccaagtagctgggactataggcgtgcgccaccccacccagctaatttttttgtatttttagtagagacagggttttaccatgttgaccaggctgttcttgaactcctaacctcaggtgatctgcctgcctcggcctcccaaagtgctgggattacaggcatgagccaccacacctggctataacaacattttaatgtattgtctgctaactctaacatctgtgccatttctgggttgactgccattagttgattcattttcctcattatggattgtattttcctactcttttgcacgcctggtaatttttttttcttttcctttctttttttgagagaggttctcactgtgttgcccaggctggtcttgaacttctgggctcaagcaatcatcctgcctcagcttcccaaagtgctgggattacaggtgtgagccatcaggcctgtccagtgcctggtaattttttattgaatgctaggctttgtgaaatttaccttgttgggtccaagatatttttgtattcctgtacattttcttcagctcattcgggaatatagttatatggagatagtttgatcctttcaggtcttgttttggggttcttgaggcaggactgaagcagtcctccccattgtgaggcacaagtacctgtgtactctacccaccaccctgtgaatcaggaggtttttccggctggctagtgggagttactctattcccagttctgagtgagcagcagttgctgttatgaatccttttgggtgcttctttccctgtccttggtaggcatgtgctgcttagtactcccctgcatacttgaggaccttctgtaggtctcgagttctctctctgctcttttctccagtactctatcctgtgaactctagctgccttgatctccctggactttcagtttcatcctcccaactcacggagtcctcagggctctccatgagtctcccctctgttctgtggcctgcaaactctcaggtgtggtatgctggggcagttgaagggctcatcacatttgtttcctgtctcgcaggaatcactgtgctttgttgccccatgtgtagtgtcttgaaaaccactgtttcatatattttgcccattttttttggttgtttcaggcaggagggtgtatctggttcctcttgctccttgtcaggaagcagaagtctcaagctttgcatattcaaggaagaaaaataaagaagggtactgtggacagagtatagtgaggagggcttgggtaagggaccaggctatgaaccctttaggtcatggtaaggagtttggattttattcagataatgatcagaagcctcagagggttttgagcaaaggtctgacaggacccgacatccgttttaaggtattttctctggctcctgtgtggacaatagattgtcacctcttccagcgggagaggtggagatgatgggcatagtctggggtgatagtggtagatttgctcttgttcctagtgtaatccttgaaattagtggtgaaactggctgtggatggctcttgcgttggaaggcctggaagtgtgaattacatacatgagaactccaggcatgacattcttcgggtgggaactgttgtcgcctgctctatcttgccagcttctctgtaccaaagttcttttggaaactttgagcctctctgaccttttgacccttatgtgcatgtgggagtcctggtctgtgatcccttgacttgattcagggggccccttagctccatctgtgttccctggagtcagcactgtgccacccccccgcccaattcttttctgtcatgggcagaactgcagaggctgcatccttggggagctcagaagctctccaaggcgctgagtggaggtgccacctgtatcttttgtttccgcttctggagacccttttgtcccttgctttttgggcctgatcccattgtccttcgcagaagtgagacacctcagctcttcactgtgttgccagagaagagaacagccactgttggaggggccatgatgggatcaacccacatttatgacatgtccacggtgagtacttggaggatactgcttttggaggctgagaaaggcagcagaagctagggcttctctgactctttggagatgaccaggccctgatctcctttccaggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaaggtaggcgcttccaggggcgctgggctgggtgagagccagggaccctggcctgccgttttcagtggcatggtgccctctagtggtgagagtgagggtggcctctgcttgctgctctgtgcttccttagatttggaagtcttagaaatcctccagtgggctgccctctttaaggacgatgagggggaggaactcagccaagtctgagagggagctcgaagagaattcagattcagcgcctttcccacagacttctatgtctatgtcaggctgcccacccttgttttgggggtccgggggtggttcaacctgtcttaacctgtgtctctttctccctatacagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggagtaaaaatagccagattagcgccctagcgcggcagaggaagtaacagtgggcttgggaagtaggccagggcaggccttcccaactgaccttgtgaccagaagttcaagtccttacctgtgcgacaacatagctcaaaagctaaattgtcttgagtccatatgaacccttgggttcaagcaacactagtcgctggggtttgggatttgtatgtgggatggggggacttactttctccaggttgtaatctggtcctgagcagcctttctgacagactagagcaggctggatcactggctcccatgggcatttgccagcctgtggggagggtagtcatgcgctgctgttgtactactgttggtgtttaagtgcaccagtggaggcgctcacttgccggagggttcaagatggtctcggggttgtggggggcatgatccagataggacgtggcagctgagctaggccttaggaggaatggaattttagaaatttggtaagcaacaaagcactggcactctaaagaggcatttggggggtagggaaagaagaggaaggttggctccagatgggccccggggtagcttgagaattcacttatgcgaagaaccttctggactccaggtccctgagcccccgcttgccctcggggcgggaacttcccggatcacaggcacccgcggtggcagcgggccccgggtctccgccgacctctctgtttgccggggccgcagggcagggctaggtcggcaggcggagagccggcttccccgggcagacccccaccgctgggggcgggttccgcattggctccgaagacccgaggggccgaggcgcgctcccgcggcggccccctccctgcagggaccgaatcccggaaaagccgggtttccgctggcggggccgcggccggccgtgggcggggaggggaggagcgggggcagactggcagcggatttgagggcaggacccgtgggcgcgcgctggccacagaccaccccttctactccgcgggagcgaggggcgcgcgtggctgcacgcagggcgcgagcgcgcccggcccggcccctccgcgctgggtggggccgcgcgggccgggctccccgccccctcccggacacgcccacccgtgtcggcctcgcgagccgcaacaggcagcggcggtcgagcgcgaggcccgcgcgcccagaggccccgcgcgtgcgtgcagctcgctggctgctcgcgctcgggcaggcgggctgaggaggctgccgcgcccccgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggtgagcgcgggagggtgcggcggggcgccgggggagcggggtggccgccggggcccagccctccccgccccagcgcccatggggtccccgccctccatctccccgactgtcccgcggcccggcctggctccagccaggcctcccgggactcctgccacggggacccgccctctcctggcagccccaccttctgcctggggccgggaccacccttctgtcctccccgagggaccttctggcctcggccccgggctttctccgattgggctgaccgaatccggccttcctggcagtcagtttccctgagtaagtcactctcctgcctcgccggcgccgggagctgtacatacatggatgtggtatagatctcttgatattattatttcccaatagactcagcatgtgccaaactcgattgtcacctcttgcaggtaaagctcatataatcaccctaggggcttctcattagccttcggcacacatgttcatttgaacttcatattacacacgttctgtcccaagcgctaggctcttagttttggggccctatttaatgtgtcctcaagtgtatttttacctcccctcccccactaaaactggtcccagaatctcccagctctgcagggctgtatgaaattactgccttgttcctaaattcaatccattgctctctgtctgttggaaccatctggggactttccttccattggcaaaataggcctgagtttgggaatattttctgtttttgtattggcaaggcagtctgtctccaactctggggacagggtgctgtgtcttacagtttgccacttgaataagacggtgtgtggagctggtttcacccagaaagcccagagaagtgcctggaggtgttcttttttgtcaccttgtagctgagttgattctgttgccttgaagtcttgggctgtctcctcactgttggttaggcagacggatgtgtaagtcagagttagagaggattgctgggctcccccctcgactgtcttcctttccccacctttattctggataatattgttttatatatatatcccagataggaatgatgagagtacatctttctgtttcgctcagcttaaggaacagagcattatcgcttctgttgaagctctcagggtgccccttcctgactgtctcccctcttccttctacaaaggtaaacactattttgaattgtgtttatcatttcccttgttagaaaaaaattagttttactacataatgcatctctatatattttatagttctgaatgttcttgaagtttgtgtacatggtgtcatcctgtatgtgttctgtgacttgattggtttttttatttttttttaaatcagcattaggtttgtgagaatcatccatgtggtatggtagccatagtttaaatattttcatgatgggtagtattctgttgtgtgaatgaatataccgtaattctcttgaatatgtaggttgtttcctgtttaacacccacagtaatgcacacatttccccccaggactcctagtgctcttgtgcagaagtttctttaggttgtattcatatggaggggtgggattgccgctcgcagggtatagatctgggacttcactaggcaaaagtagattgtttccacaggctgcttccactctgtgtttccacatcacttaacagatttacacattgttttttttttctctgtcctttctctagggaaatcaggagccacattaatttagtttgctgtggccagatccatagcacaacaccaagctcaagcgagagttgagtatgtgatggtgttcctctcttgatcctaagcaggcctctctctttctatacaggcccatctatcgctgaagtatcctaacccacctctttcacacatagaaacactgtgttccttcctacgtgggtccagtctttcccatttctccttcactttcatgcctgtgtttggtgacgtttgggcagctgccttctccatctcgttaggttgaaaaggcgcgagcctactggcaaggagctgcagcagaggggcgtgaatgaaatcattgactgctgttgatgtttggtctgcccctaggtcttttggtcactgcaaagtccacgtaataaattattagcctaagaaacagccaggcatcctgatcaaatgtataattattatgctaacttgctgtgagaggcttaggcggacttatttttacattccgggagtgtgcagttacgtcacgtttactgaccagtccttgagcttgtccactgtcctgctccgacattgtttttcatccatcacccttgtacctcctcactccttgtggaacacatgtgctctttgagcattttgcaggccagaataacactctgtggggagaaaatggcctgccattggtctttccaattattagagtcatctggttaatttgaggtctcctgggtgtccttgttcatgttgtttagaatatataggcaacatgcagcactctgtggagggattaacattcttgtctcatgtaactcaaacgggacacaaatatatgagatacatgccccttagaaatgtaaacatgattgtggatctaaggttaggtgtgcataagaatgtcatgggatttggtctcttagggcagagaagaggggctcgaacagtacagtgttaggaaggtcctgctgcttttcttgatgcctgtcaaaatataattttcttttgaaaaaaataccgtttcctgtattagatatttaaataaagagcagtgtagttgttcttcaggtaggtgtctgctcttatttaacatctgttaaattcccccagaatacatagtacttttgaaaaactttatataggtgaatagcttactcacagctggttttaaaagaatgaaattgttctgttgatcacatttttcaccagcattttttgttttttttctttagatggagtcttgctctgtcatccaggctacagtgtagtggcacagtcatagctcactgcagcctccaactcctgggctcagcaatcctccagcctcagcctcccaagtagctgggactataggcatgtgacatcacacctggctttttttttttttttttttttttttttaaaaacagggtctcactatgttgcccaggctggtcttgaactccttgcttcaaactgtcctcctacctcggactcccaaagtgctgagattacaggtgtgagccactgtgcccagccttttaccagcattttttttaaagacaaaatgattaatatatgtccatgattagaaatttgagcagtatggaaagatggaaagcacaaaggaaaaagcccccagtccatccctcttctcacttcccagaggtaatcactgtgaaatacagttggcttttaagattctgttacaaaaaggtagttttgctatagttcctttatcttttatgaaattcaagctttagaagttagcattgttttcccttcatgctaagtagtacttcctctactatggtccagtatggcatggaccgtggtgcagggttatggggaccaggtggcatgctgcttgatgttaaaggaagggtgttagagcctcattgttgatcccttcccttctgcctttgtatggtgaggtttccctgatgttcttttctttttgtgttgctgtaagtaggagaggcagaaaaattactaaattttacaagcattcaaaatttcctcagtggcataaaagtgattattaagagatgaaatgtgctctgctgtatcattcgcaaaccatatccaaagcccatttgcatacccttatgtgtatgtgaacttagggtaggagttggcagttatcagtcacttttctccttaggtcacattttttttaagtgggtgctgaggtcaagccttaatggacaaaagcgttggaatcacagaaggtggccatagctgagttggcatgactggtctgcagcagaagtgttactttcatgaaaacgcttgggggcatttgcccctttaaccacagaagcactatacgagccaagatatactactctatcttcttactatatactaggacaaactcttccatgcattagtttaattttattaatttttttttggtgtttttttttttttttttttgagatggagtctcgctctgtcgcccaggctggagtgcagtggtgcaatctcggctcactgcaagctccgcctcccaggttcgctccattctcctgcctcagcctcccgagtagctgggactacaggcgcctgccaccacacctggctaattttttgtatttttttgtacagatggcgtttcactgtgttagccaggatggtctcgatctcctgagcttgtgatctgcccgccttggccttccaaagtgctgggattacaggcgtgagccaccatgcccagcctttgttttgtttttttgagacacagtcttgcttttttactcaggttggagtgcagtggcacaatcacggctcattgcaacctagacctcctgggctcaagcattcctctcacctcagcctcctgagtagctgggaccataggcacttgccaccatgccaggctgattttaagatttttttgtagagatggggtcttgctgtgttgcccaggctggtctcgaactcctgggctcaagtgatcctcccgcctcagtctctcgaagtactgggatacaggtgtgaaccactgtgcctggcccatgccttagttttttcatctttatgggaatacttttacttaccatccattcttagatgtggatgaaatatatataaaattggatctatagaagcatgggagaaagtatttcttaaattataggtataaagtaaatgtaattgatcaaataagaaagacctgatgaaatttctattactaccctagcattaaaagtcctttttttttttttttttttgagacggagtctcgctctgtcccccggctggaatgcagtggcgcgatctggctcactgtaagctctgcctcctgggttcacgccattctcctgcctcagcctgccaagtagctaggactgcaggtgcccgccaccacgcccagctaattttttatatttttagtagagacggggttttaccatgttagccaggatgctctcgatctcctgacctcgtgatccacctgccttggccttccaaagtgctgggattacagacgtgagccaccgcgctcagccacattaaaagtcttaaaagcatgtttgtaccttaggagatttgaatttcacattgtgagtgttgtaatagaatatcatctctatcagggtaatagtatccatcgtccctgtggaagctcagattacatgagttagaaagataatgactttcacagagtccattttacatgtattgatttacagatcttttggacaccttagcggttatgtgatttctttctaaactagttttccaatttcttagctaagccagtaagttgtcactgttgttgtaggtgctggaatgagggcgggtacgcctcagaaaatgttagagctgcgtcttttcactacctcagttcaggaggcttgtccagtttggacttggactttttttttttttgagacagggtcttgttctgttgcccaggctggagtgcaatggtgcgatctcggctcactgcaacctccgcctcccaggattcttgagcctcagcctcccaggtagctgggactataggcgcacgccaccacacccagcacatttttgtatttttagtagagacggggtttccccatgttggccaggctggtttcgaacttctgacctcaagtgatccggcggcctcggcctcccaaagtgctgggattacagatgtgagccactgtgcctggactggcctggacttgaaggtgttgatgtagatgccagcatgcatctacatggtgggtcctctgaaatttggtgttggcctggcttgcacccatgttgtcacattccggaaattccgtgggaatctagcgtagctgtgggaatgatttgccaacgttggtcttcttccagcacagggcttgaggtgatattgagggctcttgaggaaagtcagagtttggagttggacttagaacttctttcagagggccatcaagcaaggtgggcagtctcttaggttggcaagcactgacagggtcttctttgtggacctagatagaggaataaccagcttccaaaggttttagagaccaagatatgcaccagctctagagtgttaccccttatagatgttcacagggcagtcagctggacctgtgttccccgttatctcattaaaaaccagagaatggctttggtcacaactcagggatcgccacttaggcagacctgcaccctgcctcttgaccttgggaatcgcagtagaacagacagctaaccaatgaaacacatctagaaaacttctagaaaatagtttattaaaacattccaaggctgggcgtggtggctcatgcctatcatcccagcactttgggaggctgaggcggaagggtcacttgagcccaggagtttgagaccagcctagacaacatggcaacccctctccacaaaaaataaacaaaattagccaggtgtggtggcgtgcgcctgtggtcccagctactcaggaggctgaggtgggaagagcacttgagctctggaggtcgaggcttcagtgagccatgatctcgcccctgtactctagcctgggcaacagagtaagaccctgtctcaaacaaaaatgggtgaatagagaatgttctaagtcattactttccttgtgttgaggtagatggtgaggcataggtgataaaatagtgttgatggcaggtttgtttatttaattttgtgcagatccttttaaattgtaagtttgttttttttttttttttgagacggagttttgctcttgtcacctaggctggagtgtaaaggcgcagtctcggctcacggaaacctccgcctccgaggttcaagcaattctcctgcctcagcctcccgagtagctgggattccaggcatgcaccaccatgcatggataattttgtatttttagtagagacggggtttcaccatgttggccaggctggtctcgaactcctgacctcaggtgattcacctacctcagcctcccaaggtgctgggattacagttgtaagcaaccatgcctggccaactgtaaggtttttaaggtacaacaaaggttggaatatttgagtttagtgctagcttcaacaatttttctgaatctcaaatatcgttcttcctcttttctccttgtgagtaatgatctgtgtccactctcagatcaacctgggctcccttcatcctttcaacactttcagtacttttagttttgtaaatacagtggtatccacaggtcattttggcaaaaacactttttagaactgtatgcgtcttagaaattgtgatgtgggtaatttgctgtgtatgttttttagtgacctcgtataaatataggtagatgtgaaaggagtgacgccttaaatttgctccctactgtaacacctgttcccttctttgtagtctgtgtaactcctccaaatgacagatcttttggacacattagtggttatgtgatttctttctaaactagttttccaaactacctctcaaaactttattatgagtaggatttcccccagctaacattttgggtatgactggcatgttaattgtctctgaaggattttagactggttattttgtttttgattttgagataggctctcactctgttgcccaaactggaatgcagtggcatgaacacagctcactctgttcagcctcaacctcctgggttcaagtgatcctccctccttagactcccaagtagctggaaccacaggcacatgccaacatgccctgctaactttttaattttttgcagagacaaggtcccactatgctgcccaggctgatctcaaactcctgggctcaagcaatcctcccgcctcagcctaccatagtgttgggattataggcgtaagccaccgcacccaggctaggctggttattgtgctgagatataggaaggcgttttttcttttcagctgttttcttttctttttctttttgagacagagtcttgctctcttgcccaggctggagtgcagtggcgctatcttggctcactgcaacctctgtctcccgggttcaagtgattctccagcctcagcctcccaagtagctgggattacaggtgcataccaccatgcccgactaatttttgtatttttagtagagacaggctttcaccatgatggccaggctagtcttgaactcctgacctcaagcccgcgtcagcagattactggcgtgagccaccgcccagcctcttttcagttgtttttctgaaacattgtgtgtgtttgtgtgtgagtatgtgcacttctgtatctgtctgtgagttttcttttgttcctcttggtaggtgagacattctttgtagcaggttttttttttttttttttaatagtttattgctgggaaaaggtctgggtaaaaaaaaaaaaagtttagaacacactaaggcttggggcatcagtcatcatttactgatccctcctcactaaccttttcctgcctcttgtttacaaacaccaaatggcttcagggtttagggagcagcttttcccttctgtttttctgttttatggtacctctcaaacacattgcattgtaatccctcccaacctctgccaccttagtccttcccagaaagtaaccactagtggcagttcagagtgatattttaaaatgaaaatcagaacttgtcacaccccctctataatcttccagttcattcattcagcaaaagcttatagaccagctgatatgtgccgcaagcaaaatccttgatctcatgaagtctgcattctagtgggtgaagataagagacaccatccagtaactttccgtcatacttaaaaaagatccccttttcatggttcaggagatgctaaacgatgcagccccttcccatgtctttgacctcacctttgcgttctccccttgttcctgcggtgggtcaccctcgccttagggcttttgcacttgctgttccctctacctgtgataccctttccctggatccttggatcgctgagactagctcctgggtatcattcagctcttcactgacctgctaccttggaaggctgtcctcacctgcccaaccccttctgggagtttataaagctacttcacacctactcgccattactggaaataatcttgttcctttatttagttactttatagatgctcaataactacatttgtcaaatcaatgacactgattttcctatagtgttttataatgtttattgaatgactatctgttatgcacaattcatccattcaccaaatatttactgagtgtttctgtgtgccaagcactgatctaggctctggagaagcagcagcagacaggctgacaaagtccattctctcccggggtgtgctttctggtgggggtgacagatgaggaacaattatattgttatatctgtgataaatggtcagatagcgagtagggtcacaaagaatagtgtggtggggaactgagtgtggggggaaaggctgtcttggtgagggagggcctctggtaaggtgacagttgcgctgatgctcgctgcagtgaagctgatgaccagagcatttactgtgtgccacaaaactgccagagccaggtgctacgatcccttttctcagaagggaaaattgaggccctgtgaggtgaaggcatttttttaagactacacagtttaaaagtgggcggggctggaatttgtctcatgactcatgattgccagacaccagagccgtttctgtgtttaaacttggtcccccaagccctgtctggttctcatagctgacaaataatatttaatgccttattctttgccagctggaattacaaaacactgctcaatttccatcatagacagcgagaggctgtgtggtatagtggctgtgagtgtgggttctggagccagtcaggtcagattttactatttgagtgactctggacaagtttttaacctctataatgcttcaacttttctcatctgtaaatgggcataataattgtccctgctgagtgtggtggctcatacttataaccccagcaatttgggaggctgaggtggaaggattgcttgagcccaggagttcgagaccagcctgggcaacatagggagaccccgtctgtacaaaaaatagaaaaaaaaattagctgggcttggtggcacacgcctgtggtcccagctacttgggaggctgaggctggaggattgtgtgagctcaggaagtcaagaattcagtgagctgtgttcgcactactgcactccagtctgagcgacagatcaagaccctgtctcaaaaaaaaagaaaaaagaaagaaagaaaagaaaagtccctgtctcacaggattatcatcagaattaaataaggttaattttgttattaacacatgttaatcgtgtgtgtggcaacatagaaagcacttaatatcagctattactgttgctgtttttcttgtcaacctaatttctccgtcttccctgccccccccaaccaaaacaaaacaaacaaaacaaacaaaacaaacatgctttctttctagaattagggtaatattcagatttcctcggtgggaccatcacaaggtcttgggttcacctgaggcacagatcctgccaaaccccaagcttattagactacaaagtcaaaacaaaatattttggttctctgaagcagtggctgggtcgggatcctgtttctacatcctgccagcttatatgaacggaagagatggtacaggccccgcctgcaaaccacagctttgttttgagccagcttgacttgacagcttccctgttttacctgctgacttctttagccctggtttggcagcagaagagcaactgaaccggtttacagcttgccatttgtcaccggtgaaaactgagcaactcctaggaaaatgagggtttaaatgtagttaatttttttttctcttgtctttttaagttttcctttttgtgtctcaagccatagaaaaactacattctacttttacaggagaaacctgataatacatttgtggtctctcctgaaacatgtagatctttgggtgtatgttaattttcacctttaataagcatcaggactttatttttccattttggttggaaatctacaattatatttacttgtttctggttcttctttaagaatgtataaaacacagattaacatttccttgaatctggatcttaatgatgaatggattctcatggtaaacatcagggcttaatgaagagtgtagactggtacatggggcacaactgctttctttagttttttggttttgtttgtttgtttgtttttgagacagtcttactctgtcccacaggctggagtgcagtggtacaatcatagctcactgcagcctcgaattcctggactcaagtgatcctctaacctcagtcttccaagtaaaggtccacatcaccatacccggctaatttttaaattatttatagagatggggttttgccatgttgccctggcctcaagtgatcctctcacctcagcttcgcaaagtattgggattacaggtgtgagccactatgtctggccaccttaaaaaaaaacaaacaaaaaaacacctcatttgttatgaagatagataaaatgtttgtttgtaaaatgtttgcgcatcaggccgggcgctgtggctcacgcctgtaatcccagcactttgggaggccgaggtgggtggattacctgaggtcaggagttacctggccaacatggtgaaactccatctttactaaaaatacaaaaaaattagccgggcgtgtggcggtcgcctgtaatctcagctacttgggaggctgagacaggagaatcgcttgaacccgagaggcagaggttgcagtgagccaagatcatgccattgcactccagcctgggcagcaagagcaaaactctgtttcaaaaaatataaaataaaatgtctgagcatctatgttcatagaaatcatgaccttcacatctttgaggagtgtcagtgaaactatgaatatgatggtataatatttatactgcagcagctctcatatcagccaccttttacattgtcttcacaagcaggtttttgtttggtactttaaatcacaggcgatggaatggggcagtgtaatatgccttaagtctattgtttatgaaattatgtcctcagagttaaaatatgtagaaagtagttgacagcattctgtcatctctcccatgcactgcttttgctgtggatgaaaatgaataagcaactctggaaaccaaggtcctctgggaacataaaaactcctgtggctattaatggatttaattgtatttcctctctgccaccaagatatgcaataaattgtttatgcccttgccgttagtggggagaattgttcattaaacgcatgtaatgtcattattgctttgtttttattacttgtaggtagtcctatctctccttttaaaaaaagtataaaaagaatggccgtaattattaaacactggccattaatccctttggttgactttttcctccatggagaaaaaggaaagtatcatctcactggggaagcaagcttgggctggaaatgggtcatggtctcccaaatctaagatctggcagaaggttggttttgtatgctttggacttgggccaagtgatatgtttacttaggctccagaagggcctggttctaaggcagccacactgataaatgaatgccttgtatcaagtgtggagaggcttcattatatttaaatccacttaagagaacagctatagaagaatgactgtttaggactgtggctctgttttcttgtttgtcatttagatatttctgccaattataataaatgtggaggaaaaaaaaagccagcaaattgctatagtctctttaaaaccatgtgccagaaatgctttgacattaaagtttgatttctcacttggctttaccccaccatgtgggtttggataagtctttgtaactcttcctgcacatacctttactgtttcctcatttagttgaaagatacttattgagcacacattacagaccagtcactgcttggatactgaggagagagcagtgaacaaaacagacagaaattccagctcttgcggagcttaccttctggggacagggtgggcagcaggcagtagtgagtgagtgagcaaatattagggtgtgttggacgggaagaataaagctggatggggataagtgggcagaggaaagaggtcacggttttaaacaaggtggtctagaaagacctcagaaagcgagccggccacatggaacacacatttaggtaagctgggtgcattttatgggatgaggccccccagtagagggaacaagaagtactggcaggttccagagcatccaggaggccagtttggctggagccaggtgaattaaagagagagtaatggataaagtcagagaggtaaaacaggtgatctcacaggccattgtgggactctggctttgatcttgagtgagatgggaagtcactggggcttttgagccagcgaggaggcatgatggtcacttccaccctaaaagaacccctgaccactgtgtgtggaagcagggagtccggtcagggggctgctgtgatgatctaggtgggagctgatgctggcttggactagggtggtggaggtggagatgagaaagtggtgggagtctgggcatattgtcaagcctgaaggatttgcctatggattggatttgaggtgtgacagaacaaaaggattcaaggatgacaccaatagttcatttaacttctttgtgtcagttttctgtttgttttctttaaaaataattattgtcgtctctttatcttagcgactttctgtgagaatgagatctgtgtaacagagctcttgagggagttttttttgtttccacttttaccatttgtaattaattggaaataaaatttcttgggaatgtactgggtgatagaataatccataggttggcacctgattgttttaaaaacctggatgagttcttcttatgctttaggccacagtgatgctgtgggaatggctgagtctcaatatccctaattactctgctgttgtgtttgctgtctggtgtcccctctgcaatccttatttatttgatggtttccaaagaggtagattgcagaagccattaataactgtagccccatagcctttgtcactaacgcagcgaaatagaaaagtccaaaacatcatgtttttttcttttttaatattttttcttttctaatgtaactgtaagagtttttttcttttttgaaagactggtttgctgtatcagacagcctgtctgcacttcctaggagctgctctgtgaggaggaatcctgctgcagaatgatctaatttgtgtaatcttgaaggtggagctatttttgaaagagaacagaaaaataatggagccctttgctcaagattgccaaactggatcttactgttttataaaggcaaaggactcagagtttgcagtttgaactcctatttccctctcgttctgctcattatatctagatcaaatttatgatagatatacttagataattactcttgaaaatgacagctgggttttcatttgtttctttcattcgttcttttacattttagttaagtatattattcaacttgtggtattgatgaagtgagtagtataaaagaatagttaccaagtttaggaattagaattctctttacagttcttaacaatagactgatggtttgtaactagttctcaaccctgtcataccctgtgactccctttaatatcctgaaataaaattcccagataaaatctactgacctgtctacaaagtcttaactgtaatatgaaagaaaaataaaaggaacattatggtaataaaatatgtatttctgtgtaaattctcagaagacaaatgtaaatgctcacagcacattggaaactggagccatcaggtgcttgtgggtacacgtggctttatttgtgtgaatatgacacctataaatagaggccaatacaggtgtattgtgttggtcactcagatatgtagcaatgccactggcgatatgattttctaaaatggtgaataaatcttcataaagttctacacaaaacaaagtataatctttcccttatttacatagtggttacattcctggaaaatttagtgtatatttagtggtgaaaaaatgcttatgatttctttttttttttttttttttttgagacggagtctcgctctgtcgcccaggctggagtgcagtggcgcgatctcggctcactgcaggctccgccccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgcctcggcctcccaaagtgctgggattacaggcgtgagccaccgcgcccggcctgtaagatctctttaggtctaggctgagatagttataaactgctttttacttagatgatgtgtctggcagggccaaaggccgatttgttatgaacctgatgaagcttttaagttttagggccctgtacatgcacaggctacttccagggccctaattagaaaaacaaaagcaaaaacaccttttttcttttcccttgagacagggtctcattctgtccgccaggctggagtgtagtagtgtgatctcagctcatggcaacctccgcctcccaggctcaagtgattctcgtgcctcagcctcctgagtagctgggattacaggcacacaccaccatgcctggccagtgttttaatttttttgtagaaatggggtttcaccaagttggtcaggctgatctcgaactcctgacttcaagtgatccacccacctctgcctcccaaagtgctgggattacaggcgtggggccggccccaaacaccttttgagcacgttttcagggccttctgaggctgtgtcatggaaataaacaaaaaaccttttgtttggaatgtcatgtacactcagaaaaggacatatatcataagcctaacttgataaattttcataaactgaacatataagcagcactcacatcaagaaacaacattaccaacgccccagaacattaccatgcccccttctaataccacccctcccactccaccaacgatagctagtttcctaatttccagcagcacgcattagttttgcctgcttttgtacttcacacagtggatgaagtacaaaagaacacttgttttttttttttgtttttttttttgagacagagtcttgctctgtcgcctaggctggagtgcaatggcacgatctctgctcactgcaacctccgcctcccaggttcaagtgattctcctgcctcagcattcccctgtagctgggattacaggcatgcgctaccatgccccgctaattttttgtacttttagtagaggaagggtttcaccatgttggccaggctggtcttgaatgcctgaccttaggtgatccacctgccttggcctcccacagtgctgggattgcaggcatgagccagccaagaacacttgtatctaacttctgctgctcaacattatgtttatgtgatgcatccaccttgttgcatggagttgtagtgaatgtaatcttgttgctatgtagtactgtattccatggtgtgagtatatcgtagtttgtgtacagtccgctgttgatggctatatgggagatttccagtttgggctatgctgaatagtgctactgtgggcattcttgtacatgtctgttggtagaccaaagcactcatttctctgcagtatatacctgggagtcagattgccgggctgtggggtatatggacagtatattcagctgagcaatatatgaaagttcctgttgctgcacatctccaccaacaattgttttttggtttttttttgcctttttcaaggcaaagaattgggctggagtaaaatgatttctcctatggctttaatttgcatttccccaatgatgttgagcaccttttcatgtatttgttggccgtgtgtgtatcctcttttatgaactgtctgttcaggttgattgcacatttatctattttggttgtctctctgtttcttatttacctttaggagttgtttttctcaaaaatatcttctcatactctgtgtgttccttttttactctttatatttatttatttatttatttatttttatgacgatatcaagcaacctttttactctttcagtggtgtctttcaatgaacagaaattcttaatcttataattcaatttatcaattttttcctttgtttagtaccttttattttctatttaagaaatctttgcctactctaagatcatgaagatgtcctctactgttttcttctaaaagttttattgtttgccttcgacatttagagttccagtccatctgaaattgatatttgtatgtgatgtgaggtatggattaagacacatttcccctgatacggatactcaaccctgtaccatttatttacaaggtcatccttttcccactgcactgcattatcaccttgatcataagtcccatgatattttacatgcagttctaattttaggctttctgttctgtaccatcggtcagtctgtccatccttgcatcaatgccgccctgtctccgtgactgtatctttataataggcctgttacgtagtgtgtcttcccgctttgtgcttcttcataattgccttaaggtagtctttgccttttgtgtttccttaggaattttagaatcagcttttcagtttccttaaaaacttctcttgggggagaaattttattcaggattgcattgatctctatggattgatgtgcagataattgaaatctttaaaattgaatcttttaattcatagacatatgtccctttatttatttaggtcatggttttgcatattttagcatataagtattctgtacttttctttagatgtattcctatatatttgatatttttaaaccctaaagctaattttgtaattgtaattttgtatgctttttcttatagaggactcttttttaagctgtaggccctacaaaacctcattctatccctgggcagaatgttttcactcacatgaatgttgaaaatcatgtgggaagctagtcatttcttaattgtgcaggactcgaaggttcccacaactgtgggtcgtaggatgtttggcattcttatttttcccaccactgaatgtcagtgaattctcaatcattgtgacaaccccagagacattaccaccaccatcattcttttgagactcaattgttaaagacattttgctcttattatgacagttattatagttcataaatgtaagcatgcttgaatgtccccaagtgcgtgtgatttttttgcaggaagagacctaaaataagtcaacagtttcaagtgttgccatttattaatacaacctagactttataaaaattagcaaacagttaatctttacagacttctgcttacaagcttcctggtagagtggattgaacgctggacttggaaccagaagaattaaatccttcttttagcaattagaaactctgtgatttggggtctatgaccttttgcagctcaatcttctcctcgaaatagaaataagtaaatataactatctagctgactactcagagttcttgggaagaacagacgagacaacttataaatgctttgtatctcagagcaccatagaaatgccattggtggctgggcgcgatggctcacgtctgtaattccagcactttaggatgccaaggtgggcagatcacaaggtcaggagatcgagaccatcctggctaacacagtgaaaccccgtctctactaaaaatacaaaaaattagctgggtgtggtggcgggcacctgtagtcccagctactcgagaggctgaggcaggagaatggcgtgaacccgggaggctgagcttgcagtgagccaagatcgcgccactgcactccagcctggaggacagagcgagactccatctcaaaaaaaaaaaaaaaaaaaagaaatgccattggtataaattcaagtatttgttaactcttctttgccgggactgtgggcataattaccaagaggaaacctcctaaatagtttggatccatccagtttggggttctttgaacatggacactttagccataacttacagaaagtggcttggcttgacttgacttggcttggcttggcttggcttggcttttcttttcttcttttctttctcttctcttcttttctcttctttcctttctttttttttttttttttttcagatagggtcttgctctgttgcccatgctggagcacagtggcatgatctcagctcactgcagcctgaacctcccaggcccgagcaatcctcccatctcagcctcggaagtagctgggactacaggcccgtgctgccacacccagctaattttgtttattttttgtagagacaaggtcccactgttgcccaggctggtgaactcctggactcaagtgatcctcctgcttcagcctcccaaagtgctgggattacaggcatcagccaccgtgccctgcctaaaagtggcacctgttttctaaaagtgtgtgtatgtaggaaggcaacaagagcactgatctgttgggattcctgtgtcttaattctgattttctaaatgaaagtaggcaaaccactcactttccagacccttcattgtcttactgcttagaaatgctctgaggagaaagatagaatcactaaagagttttatgttcctcagtgaaaggtatcagatgaatataggtgatatattattataattagattttctttcatataaatgcacgataaccctgactttccagccaatggattgagaaatccttggcctgttagtggataaaaagataatgagaacttggaatgtaagttgtgaagaagggatacagtttttacaattttaatatggaatatgcctaatactaataaaatattgaatttcaatatgatttctccaccccagtaaatcttagtctctttaattagcattacatttagcatacagattcttagaaaagacaaatgctccttttaattgtgtttttgtttcatttgaagtttcagcatttgattactttcctccctggtttgttttacttatttatttttttgagacagactctcactccagcccaggctggagtgcagtagtggatctcagatcactgcaacctccgcctcccaagttaaagtgattctcaggcctcaacctcccgagtctctaggattacaggtgtgtgccaccacaccaagctaatttttgtatttttagtggagacgaggtttcaccaagttgtccagtctggtcttgaacttctgagctcaagcagtccacccacctcggcctcccaaagtgctaggattacaggcatgagccaccacgcccagcctggttttattttttggtagtccaaattccccagtagttttttttctcattgttgttgttgttgttttttttcttttttttttcttttattattattatactttaaattttagggtacatgtgcacaatgtgcaggttagttacatatgtatacatgtgccatgctggtgtgctgcacccattaactcatcatttagcattaggtatatctcctaaagctatccctcccccctcctcccaccccacaacagtccccagagtgtgatgttccccttcctgtgtccatgtgttctcattgttcagttcccacctatgagcgagaatatgcagtgtttggttttttgttgttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaactctttgctattgtgaatagtgctgcaataaacatacgtgtgcatatgttgttatagcagcatgatttatagtcctttgggtgtatacccagtaatgggatggctgggtcaaatggtatttctagttctagatccctgaggaatcgccacattgacttccacagtggttgaactagtttacagtcccaccaacagtgtaaaagtgttcctatttctccacatcctctccagcacctgttgtttcttgactttttaatgattgccattctaactggtgtgagatggtatctcattgtggttttgatttgcatttctctgatggccagtgatggtgagcattttttcatgtcttttttggctgcataaatgtcttcttttgagaagtgtctgttcatgtccttcgcccactttttgatggggttgttggtttttttcttgtaaatttgtttgagttcactgtagattctggatattagccctttgtcagatgagtaggttgcgaaaattctctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctaaggtttttatggttttaggtctaacgtttaagtctttaatccatcttgaattaatttttgtataaggtgtaaggaagggatccagtttcagctttctacatatggctagccagttttcccagcaccatttattaaatagagaatcctttccccattgcttgtttttctcaggtttgtcaaagatcagatagttgtagatatgcggcgttatttctgagggctctgttctgttccattgatctatatctctgtttggtaccatgctgtttcggttactgtagccttatagtatagtttgaagtcaggtagcgtgatgcctccagctttgttcttttggcttaggattgacttggtgatgcgggcccttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttctatttgtttgtatcctcttttatttcattgagcagtggtttgtagttctccttgaagaggtccttcacgtcccgtgtaagttggattcctaggtataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacaagatagaaagttaacaaggatacccaggaattgaactcacctctgcaccaagcggacctaatagacatctacagaactctccaccccaaatcaacagaatatacatttttttcagcaccacaccacacctattccaaaattgaccacatagttggaagtaaagctctcctcagcaaatgtaaaagatcagacattataacaaactgtctctcagaccacattgcaatcaaactagaactcaggattaagaatctcactcaaaaccactcaactacatggaaactgaacaacctgctcctgaatgactactgggtacataacaaaatgaaggcagaaataaagatgttctttgaaaccaacgagaacaaagacacaacataccagaatctctgggacgcattcaaagcagtgtgtagagggaaatttatagcactaaatgcccacaagagaaagcagggaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccagtaccagatggattcacagctgaattctaccagaggtacaaggaggaactggtaccattccttctgaaactattccaatcaacagaaaaggagggaatcctccctaactcattttatgaggccagcatcatcctgataccaaagccgggcagagacacaaccaaaaaagagaattttagaccaatatccttgatgaacatcgatgcaaaaatcctcaataaaatactggcaaaccgaatccagcagcacatccaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcaattaggcaggagaaggaaataaagggtattcagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttacacaccaataacagacaaacagagagccaaatcatgagtgaactcccattcacaattgcttcaaagagaattgttgttgttttgagacggagacttactctgttgcccagtctggagtgcagtgatgtgatctccactcactacgaactcaatctcctggattcaagtgattctcctgcctcagcctcctgaacagcaggggttacaggcacatgctaccatgcctggctaatttttgtatttttagtagagacggagtttcaccatgttggccaggatggtctcgaactcctgacctcaagtgatccacccgccttggcctcccaaagtgctgggattacaggcgtgagccaccacgcccggcctcattattgcttttatttttaatcaaagttatacatatattttagagagtcacgtagttttacagacttatttagaaaacaatctttaggtattatctggtgaattccagctgtcgaaaactgtttggctttttcatcagcacccacattttcccaataagtttgtaatttcttcttttttttttttaaatttttgagatagagtctcactctgttgcccaggctgaaatgcaatggcgtgatctgagttcactgcaacctccacctcccaggttgaaggaattcttctgcctcagccttctaagcaactgggattacaggcatgcactaccatgctcagctaatttttttattttagtagagacggggttttgccaattgcccaggctggtcttgaactcctgccctcaagtgagccaccatgcctggttttctttttatctttttctttcttttttttttttttttttttttttgatgtagggtgtttcgctgtgtcaccaaggctggagtacagtgatggctcactgcagccttaacttcccaagctcaagtgatccacctgcctcagcctcccgaagtgctggaattagaggtgtgagccactgcgcccagctagtagttcattcttttttatttccaagtatttcattgaaacatgatataatttgcatatccattctcctgttgatggacatataggttctttacagcttttagcttttatgaataaagttgctatgaatttttttttttttttttgagacgggagtttcactcttgttgcccaggctggagtgcaatggcgtgatcttggctcactgcaacctctgcctcccgggttcaagcgattctcctgcctcaacctcccttgtagctgggattacaggcatgcgccaccatgcctggctaattttttttattttgtggagacggggtttctccatgttggtcaggctggtctcaaactcctgacctcagatgatctgcccacctcggcctcccaaagtgctgggattacaggcctgagcaccgcgcccagccgctgtgaacattcttacacaggtgtttttacagacatacattttcatttctccctctctctctcttttttttttttttaatgtagagacagtctcgctttgttgcccatgccagttttgaactcctggctttgtggaatcctattgcctcacactcccaaagtgctgggattacaggcatgagccaccacgcccagccccattttcatttctttgggggtacatatgttggagtggaatggtgtgtcttagagtaggtgtatgtttaaactttgtaagaaactgccaattttttcaaagtgattgtatcagtttgcattcccactaactgaggcagacagattctgaagtggcccccatgataaataccccctggtatttatggcctagtagtcctgtgcccttgggtgcaggtgggacctgtgattgactcctcactgatagaatatggcagaggtgacaggatgtgtatggtcatgcatacctgattattcccagtcagatcgtaatgctcatcttgtgaggagactctctcccttgctggctttggtgctgtgttgtgagctgcctatggagacggccctgtggcagggagctcagggcagcttcaaacccacagccagcaagagactgtggccctcagtccagcagcccacaaggaattgagtgttgccaacaaccatgtgtgtttggaaacagatcctatcccactcagttctcagatgagaccatagtctcagccagtaccttggtggcaccttatagaggacccagctaaactgtgcctgggcttttgacctatagaatctgtgagataataaacatgcattagtttaagctgctgctaagctttgctagtattattatgctacagtggataactaatacgagcaatatagttcctgttgccctgtatctccaccgacatttagtgcctgtcttttagattttagccatgttagtgggcatgaaatggaaactctgaggctttaatttgcatttccctaatgacattgaatacctgctaattggacatttggataccttcttttgcgaagtatctgttcaagtctttttcttattttaaaaataggtaggttgggcatggtggtttacacctgtaatcccggcactttgggggccaaggtgggtggatcgcctgagctcaggagtttgagaccaccctggcaacatggtgaaacctcgtctctactaagatacaaaaaattagctgggcatggtggtgggcgcctgtagtcccagctactcaggaggctgaggcgcaagaatcacttgagctcgggagatggaagtttcagtgagcccagatcatgccaccacactccagcttgggctacagagtgagattccgtctcaaaaataataaaaataataagagtaagaataatcaatatgtttgtctttttataatttatttgtagaagttctttatatatgacgggttaagttctttatcagatgtgtgtgtgtgtgtctctgcatgaatgtgtgttgtatgtttgtgtgtgtatctgatagagttttcttctagtctgtgatggggaggaacttgcacattcctctcacctcatgcagatttccaaactgttcacgttttactgcatttactctattgtactatttctctctctaaatcagttttttctgggtcatttgagaccatgttatgcacatgctatcctagcacccttaaatatttcagtgtttattttccgccagttaagggcactcccaaataaccactacatactcctttaagtcagacaatttgcagtgataaaaccctattgtccaatctattgaccccattcacagtttgctgccccaactatatctcatttctgttttgtcccagaatcccagggaggagtgtgcattgcacctagctgtcagcgtctcttcacaccctccagtctgggatcatcctttgtcatcccggttgttcttgtccacaaccgttagatatcctgtagggtgattggcaaggcggatcttatagtatttccttatgaccaaattcaggtcatgatttcttggcaaaagtatcacaaaaatgatgctgtaatagtctcagcacatcacatcaaggggcacattctgttaaccagccctgttactgctgttgttggccctcatcacctgctcatgttggtgtcttccaggtatctctgtttttcttactgtaatgccattgtttttcttttcttttccttttcttttttcccttttcccttcccttttcaatggagtctcactctgtagcccaagctggaatgcagtggcacaatctcagctcactgcaacctccgcctccagggctcaagcagttctcctgcctcagcctccaaagtagctggtactacaggtgcatgacaccacaccgggctaatagttattgatttatttatttatttatttttgagacagagtgtcgctctgtcgcccaggctgcagtgcattggcacaatctctggtcactacaagctccgcctcccaggttcactccattctcctgcctcagcctcccgagtagctgggactacaggcgcccaccaccacactcggctaatttttttgtatttttagtagagatggggtttcactgtgttagccaggatgttctcaatctcctgacctcgtgatccaccctcctcggcctcccaaagtgctgggagtacaggcataagccaccgtgcccagcctatcactttctatatcattttcttttttgggggggttttgagggcagggtctggctctgtctcctaggctggagtacagtcgctcgatatcagctcactgcaacctccgcctcctgggctcaagtcatcctcccacctcagcctcccgagtagctgggaccacagacatgtgccaccatacccagctaatttttgtattttttgtagagttgggattttgccatgttattcaggctggtcttgaactcctgagctcaagtggtctacccaccttggcctcccaaaatgctgggattataggcatgagccaccatgcctggcctatatctgtttttgttttttgagatggaattttgctcttgttgcccaggctggagtgcaatggcgcaatctcggttcaccacaaccttggcttgctgcaacctcggctcactgcaacctccgcctcctgggttcaagcagttctcctccctcagccccctgagtagctgggattacagacatccgccagcacacccagctaattttgtatttttagtagagacgtggtctcgccatgttggtcaggctggtctcgaactcctgacctcaggtgatctgcccgcctcggcctcccaaagtgctgggattacaggcgtgggccaccacgcctgcctttttctttatatatcttaaaaaccatgtattcagactgatctcttaaattccaatgtaacattttagggttctctccagcctaagccctttgcatgtttgtaagtacctcttccaagaggtacttggaagaaacctggctttcactattctcagtatatttacttatttgctccttgtaactggtctttcacctaccctgaccttgccttctgtctaccacatctgcacgtgccctcacacccctgcctcagcaccctgcgtccttgagcactagtaggtggaagcaggaaaacagacgtgtaaacttcataacagtgactcataagacaatagaggtggaaagcgagaagccgatttactctgcaaaatcataagtagtatttgttccattatctactgttgtgtaaaaaagtctctccaaaagttatcacttaaaataagggaagaactattttgcatacaaactgcactttgggcagagttcagcaataatactcaattctctctgcggcactcaagtgaggtgggctggttcaaagttggagcatccaggggcggaggctagaatcttgtgcagtctccctcaccgtgtgatgtctggcagctgatgccagctattagctgggacctccatgagaactgtggctggaacacctgttatggcctttccacgtggctgcttggcttcctcacggtacggtggctgggttccaagggcaggcatcacacaagcaagagcgagctggcggaagcctcagtgcctgtcctcctccagcgtggagagtcacatggcctcatttctactgcattctgctggttagaaggaagtcactaaagccagccatattcagggggagggtaatttgtttccactttttcatgagaggactgttaaagaatttatagatatgttttaagactggcacagaatttaaaaatatactattttctggaagaatggaagattcatttgtacagttgcattcgttcagtatttttaattcattttttttaaaagttttaaacacttacatctactggtatataggtatgcttgccccatttccttttcttttcactttctctttttacagaaccctgctgcaagctaactcatgtatgcgtccgttcatgcttttgttcattcttgtgtgatacagaaatgtatatacacatacatacagtgggttgggaatcttgtttttaaaaaatagaatcacattgaaactaatttttgcatcctgtttttctgaacaccttggagaaatccctataaatcaagaggtttcattctaatttgttctttttagatgctgcacatactctgttttctgatttggttatttgatcatgacggggtaggaatagagagggacaggcttcaaagaaagggtagtcaggaaagagaaagaggaggagtgctaggtattcctggggtcttcaacctgatgtgtcatcgaagtgggtgggaagttgggaaaatggtggtggggaggtgtgttggttggttttagcggggaaatgagtatttttttatatgcactaaaattacctaccaggcagttgaatacataggagcagggagtgagtccaaggataggactggagttgatagacaaagctataaagggagacggttactggggggagagctctgtctcgcttagcatcacttgctgttagtggtgggcccagacagtgactgaaatattttcattccagaccagggtccagtgtatttatacttgatgcattaagttctgatctttaaaaagctgccagttttttagaaggagagtttttattttcattttatatggtgtgggctgaaggaatcttttgctaaatataacaatgtgagtttgctagtctttctgaggcattgaaggcatttaaaatttgaaaccagagctacctgatgggaacatccttgatctcttctccaagtcaaaccaacctaggccacgtgtaataattagttcaattgaatggctgaagaaggatttatttgccccttttatgttacagaggagatccacagtacagctagaaaagggatgcagaatgaacaggacagacacgtgattctgaccctgataaccactctgcatccatcggatttactattattattattattattattattttattttttattttgagacgggtctcactctctcacccaggctggagggcagtggtgcgatctcggctcactgcaacctccgcctcccaggttcaagcgagtctcctgtctcagcctcccaagcagctgggactacaggtgcataccaccacgccaggctaatttttctgtttttagtacagaaggggtttcaccatgttggccaggctggtctgggattcctgacctcaagtgatctgtctaccttggcctcctaaaatgctgagattacaggcctgaatcactgtgcccagccaagtttactattattattaaaaatactggtggccttgaaatcagtgtaaaataataatgtcatctttttaggaataaaaatactgctctccccatgccccactggctgtaggaaaattgagggaaatggttgttattttctctttgtaggttggattactgaacctcggagtgagatgacctgtgagttttatttatttttatttatttcattttatttattttggagacagatcttactctgtgtcccaggctggagtacagtggcacgatctcagctcactgcaacctccacctcccaggttcaagccattctcctgcctcagcttcccgagtagctgggattaaaggcacgtgccaccacgcccagctaatttttgtatttttagtagagaatgggttttaccatgttggccaggctgctctggaactcctgacctgaagtgatccatctgccttggcctctgaaagtgctgggattacaggcatgagccaccaagcctggccaacctgtgagttttatataaatggcacagttgaaatgataaacgtccttaagatttaattttgattaggggaagtgagtgaaaggtattcctcttgttggttttccctgtattctgtttggtttggtcttttttcagataagttcaacagtggggtgtcaattatatgtaaagtacatggagaaagctgcaaggatgtgggtggctcaggcctgtccttagagagctccccatcttggtatctacagctcactgcaagacagagcagattgaaataagtaacaactagagttacatgtggggtaatttaggagaaaagggcattagtccctttggaatctggcatttgacctggaatttttcttttcagttttttgtttggaatttttttttttttttttttttttttttgaggcggaatctggggctggagtgcagtggcacaatctcatctcactgcagcctccacctcctgagttcaagtgtttctcttacctcagcctccccagtagctgggattacaggtgtgcaccaccacgcccagctgatttttgtattttttttagtggagacggggtttcaccatgttggccaggctggtctcaaactcttgacttcaagtgatccatccgcttcagcctcccaaagtgctgggattacaggcatgagccagtgtgcccagctggaaaattttttaaatatacaaaaatagagaaaggtgtgtgatgaatccctgtgtactcaccaccctgctttattatcagctcaggggcagtgctgttttatctgtgcccccatcccctccccccactcccacccccagattatcttgaagcaaatcccagtcatcatcacatttcttttgtaataatttcaatatgtatcttcaaaagatagggacactttaaaaaatacataaccacaataccattatctctcctaaaataatagtaagtccttaattttatctgatttgcagtcactttagttggaatttacaaagagaagattttaatagatggtgaatgggaggaagggaattcagatagagggaataacacatggaaaatcagggaccgtgtgtaagtgaaaggtaataaaagtctgatttagggctgtggcattgggcggaaaggaaattgcaaatgtcagtcacggcagaggtaaacttaatggaattttccagttgaggacagcacgtgtgtcttccttctatttctggttaatagtagtcattttgaaccctatagaacagggttgacaaaccatggtttgtagcccaaatcctgttctcagtctgtgtttgtaaataaagttttactggaatacaaccacacccatttgttgatgtattgttgtgtatggctgctttcatgaaccccacaatgggcagagtcaagcagttgcagcagagactctatgaactgtaaaaccccaaatacttactactatctggccctttatagaaaaagtttgccaacctctgatctagaagaaactgggccctggatttagtgcttgctctcagaggagttgagtagagtatatggattagaaacagccatgtctttgtgatatacaggggtatacaggagtcagaaacagtggattttgttttgctctgtctttatcattcattttatagcctgagaaagtaagtctaagaatctttctgcctctgtttattatttgattttatattgtgaactaagctctgtgaaatcagaggtttttgtcttttcctcactactctattggcagggcctggatcagtgccagacatttagtaggcattcagtaagtaattgttgaataagtaagcaaatattttagtctttttgcttctcttctgtattacacacatttggagtttcttgggggaacaaggatgatatatttgtaggtggcaattatgttactatgtaaatctgttataatttttcccaaaagttcagaaaattgtttcattagtacaatggagtattaagcagcagttaaaactagtaattatgggctgggcacggtggctcactcctgtaatcccaacactttgggaggccgaggcgggcagatcacctgaggtagggagtttgagatcagccttaccaacatggagaaaccccatctctactaaaaatacaaaattagccaggcgaggtggtgcatgcccataatcccagctactccagaggctgaggagggaaaatcgcttgaaccggggaggcagaggttgcagtgagctgagactgcgccattgcactccatcctgggcaacaagagtgaaactctgtttcaaaacaaacaaacaaactggtaattatgataactatagaaatgaggagaaatgtttatggtaggtcaaaatcgtaggcacactgcctccctaaaatatgaatgaatatggacaaagactggaagataatgtgaaaatgaaatcattttaagacagtggaatttttggtggtttttctctccaaaattttctttaatactattgcttactcatcttttcagaaatgattttaaatatgtataaactttccatgcccttccctgcactatgtacagaaatagaatctttaatgtggatcacaaataacacaataatcagaaattagagatggtgttgaatctcagcattggtaatgagaataggctttatggatagatattccactttatcctgagatacacagctacagtatactttctgggaggagtatgcctataagcatccttggctggaacctgaattgggtttacaagcttacatttagataaaagcctttttatttgagatgaaacccatacaggcagggtagaaaggagtggcctgggtgagaatgtctaatgtttgggttttctcaaagcgtcattcctcctttcctcttattctggctagcttttccacagtgtcatgtaaagaggcagcattttctagaagatgcaagtcatttgaagtagtcatttggttttcttctcatttcactttcagcctgcctttaaaaatgtagctgaggcccaccgctgtggctcacacctgtaatcccagcactttgggaggctgaggcggaaggagcacatgagcccaggagttcaagaccaacctgggcgacagagggagaacctacaaaaaatgaaaaataaaaaatacaaaaatggccgagtgcagtggctcacgcctgtaatcgcagcactttgggaggctgaggtgggcagatcacttgaggccaggagttcaagaccaacctggccaacatggtgaaaccccatttctactaaaaatacaaaaattagccgggcgtggtgacacgtacctgtaatcccagctacctggaaggctgagacatgagaatcacttgaacccggggaggttgcagtgagctgagatcgtgccactgcactccagcctgggtgacagaatgagactccatctcaaaaaataaaaaaaaatataaaaaaattagccaggcgtggtggtgcatgcctgtaatcccagctactgggtggaggtgaagaggtaggctgaggtgggaggatcgcttgagcccaagaggttgaggctgcagtaagccaggatcacaccactgcactgcatgcaacctggatgacaaagcgagaccctgtctcagagaaaaaaaaaaaagataaatcttgtctttgtaccttagtttctccacatgcaaaactggttctttatacctttccgaaggttgtgtggtgagtttgctgctaaataggtttttgtgtttcttctaccaaactacctttccaggatatctacagttggtgttcaagccattgcctctgggcttcatgtgagcattcttgccccgggcaggaattctgcagcacaaaacaaagtactaaagattttaccctttgagaagcctactccttaagggaatattacctcccaggtttagcagttgggaagacatgaagtacctgttctcatttcattcaaatgccattcagtggtctgtgagtctacatgaaatgactccctgcggacagcaccctcccccagtctgaccacctactacttcctcccaggtcactcccttgcagccacgcaggcttctttgctctttcctgaaaatgtcaattatgatctgccttggtctctgcactgcctctgccacatagagtcatggttcattttcactcctcctcaaagtgtttgctcatgtgtcatccatcccagtgaggcctgtcctgtgctcccctccccccacattattcctgcttccctttctccatagcacttgtcaactgctaacacactatatccttttcctgtatactatgctgattgtttactgtctccctgtttccaggtagaatgaaagctccatgagggccatgatttgtactgattttgttcactgttctatccccagtggttagattagggtcaaccacatagtaagtgcttggtaaatatttgttgaatgaatgaaatggctgggacactgagtttcaccctctgcttggaattcttttacttatatgattgttaccactataccacgttggccagggatgctctgttccccctttaatgaacaaggacaaaaacatcttctcttgattctttcttagcataactgagataggctggagagttcaaggaagtgttttgagtactaagaacaatagagaaaccagcatagagaatgcaacaagtattacaacagtctggcttaacagtgtttcactcttggagctgccatatctagcttgttctcatattttgcaggccccatcctaatctacccacttaggagaaatctaattccagcttcataggactagtcctgaccttgccttgatgccctgcatgtggcaccatctcataatctgttactaaggagctcccttttgtacatcatgacagctgccaacaaggccaagagaacccagcaaggctcattttctagtttgagtgttgtgttagtctgcatgggctaccataacaaaataccatagaatgagtggcttaaaaagcaaacattttctcacagttctggagactggaagtccaagattaaggtgccagtaggggttggtttctggtgaggcctttcttcttggctgcagacgggcacattctaggtgtgtcttcatgtggcctttcctctgtgcacagagagcatatgtaagcccttgtgtcttcctttaataaggatgccagccctatcagattagggccccacccttctgacctcatttaaccatattacatccttagggcactatctccaaatgcagtcactttagggattagggctccagtataggaatttagggccaggtatggcagcccacacctgcaatctcagagctttgagaggccaaagtgggaggatcgcttgagcccaggagtttgaaaccagcctgggcatcatagcaagaccccctgtctctacaaaagctggcagcctgagtattaagatcttatctctacaaagaaaaaaagaaaattaaccagacagggtggtatgtacctgtagtccaagctacttgggaggctgaagtgggaggatcactagagcctgggtaattgaggctgcagtgagccatgattgtgccactgcactctagcctgagtgacagagagaggccttgtctcaaaaagaaagagagaaagagagaagagagagaaagagaaagaaagaaagaatgaatgagttagctgggtgtgctgatgtgtctgtagtcctagctacttggggctgaggtaggagaattgcttgagcccaagagttcagggctgcaatgagctatgtttgtgccactgtactccagcctggatgacagagcagcaagaccctgtctctaaaaacaaaacaaaactaagaattttaggatgacacaactcagtccatagcaagtgatacctctttgactggaacaaataaccttatgcttcaggtgcaatatctcacacagacactatggccttcgttcactttttaaactagcatttattgaagacaaaactatgtgccaagttttatgccagctgcaggggatatcccgtaccctccaccagtagaggagacagagccagtttcagagaagggtggtgagtacctggggatggatggatgtgtcaggaaaagtttcattgagaaggtcgcatatggccaggcgtggtggctcacgcatgtaatcccagtactttgagaggctgaggtggatcacttgagccaaggagtttgagaccagcatgggcaacatagtgagaccccatctctattttaacaaaaagtaaaagaaaaagagaaggtcgcatatggtctttcaggtctgtgaagaagtgtgtgcatagtttaccacacaacagcatatga

SEQ ID NO: 36081 - DNA, 23487 bp, Homo sapiens
gggagcagtgcccgagcgcggtgagctgctgggcgcggggtctccccgggtggggatggggaaaggaaaggagctggccaggtcgtccgaagggatggggtccggatggggaggaccggagcagatccgaggaggggaacgggggtggaactgggctcagaggcctggccttcctgcagggtttctgccccattttggcgcctgcaataagaggacttaatcattttcactaccttcttcctgccttccccagggcagagtccaggccggatcgctgtcatccagcaagccggcgggagggggaaatctcccagatctgatctggcaaagcactaagaagaagaaatttgggggaagtgttcctccttgccacttattaggccacgctttcagttcaacttatttatttttttaagacggagtttcactcttattgcccaggctggagtctcggttcactgcaacctccgcctcccggattcaagcgattctcctgcctcagcctcctgagtagctgggattacaggcgtccgccaccacgcccggctaatttttgtatttttagtagagacagggtttcaccatgttggccaggctggtctcgaactcctgacctcgtgatcctcccgcccccgcctcccaaagtgctgggattatagacgtgagccactgcgcccggcctcagttcaacttcttaatctgtgaaacaggataattgcaaaacgtaacctgggctttgtaaaccgtgaagctctatgcaaacataattgtagttgagagttgtaattgctgttgtattgtggtgggatttgcaactgggaggccgattccaacgttgagaatatgatttcttttctttttttttttttagacggagtctcactctgtcgcccaggctggagtgcagtggcgtgatctcggctcactgcaacctccgcctcccgggttcaagcgattcttctgcctcagcctcccaggtagctgggagtacaggcgcgcgccaccacacccggctaatttttgtatttttagtagagatggggtttcaccatcttggccaggttggtctccaaatcctgaccttgtgatccgcccgcctcggcctcccaaagtgctgggattacagccgtgaaccaccgtgcccggctggtcctctctttcctcactgtaaaatgagcttagtagaacatgcctcatcagtgctatcgtgaggttgagtttgtgtccccagttcatggtcctatataggccctcaacaagtgtgggttcccttctttacttaggagatgaattaattggttcattcattcaacaaatgatagcatctactatatatcaggtgtcattctgaatagaccagaagttcttaaacagtgattctcagaaggtgtatgaacctcttaaaattgcatacatctcctaagttttcttagggaaaaagtccacacatgttaccaatttcagaaaagtctacaacttcctaaaagtgattgcctaaggtgatccttaagatttttgtaaaggtttacctgctgagaatggaaaaattaatctcagagttgggtgtattttgcacagagtagagcaggcttgtgggtggctggtgtcttaaacaggcaggatacttcatttctactacttgatgttagaatttccctgtgctagcttcctcaccctcccactgaatgggagtttaacttccaggctcagaagttaaactgtgggttgggggtagtgggaggggccagtctgactgggagatgggaaccactgggcttagttatgctgggaaaggaggttatgtgggggcgttgagggaggtcatgtctggaagaactgacagcatagaagagcagtcactggaaaagaggtgaagttcaagttcagctcccttttagatggtgtccttctccctccttcacatccaccccagctcccagctgctccttttttttttttttttgaaacagagttttgctcttttgcccaggctggagtgaagtagcttgatctcagctcactgcaacctccaccccctgggttcaagtgattctcctgcctcagccacctgagtagctgggattacaggcacccaccaccatgcctggctattttttttttttgtacttttagtagagatggggtttcaccatgttggcaaggctggtcttgaactcctgacctctggtgacccacccaccttgggctcccaaagtgctaggattacaggcatgagccaccgtgcccggccccggctgctccttctaatcctgttgttcactgcagcacaaagtatttctgaacactggagaattatatttctgggaggcgccattgcctctacagaggaggaaatttaggcccaagtaggaaaaggacttgctcagcatctttgcagctcactggcttaggcaggatgataatccagctctccatactacctcatcatttcatggcatcagcacctactttgtgcagaaagatgtctctgggatagctgtaggtggggctgaaggagcccctggtccctgggcagtgacaggctgaatagaaagggtagagagaaggctctggcctggagggggttgctttgagctggattctgtctttattacccagctggaggtcgctatggggagcagctcccacagcctcctggctggatggcaggaagcacatgtagatattgaagggttgaagggttgaagggttgaaggctgaaggggagtgagggagctgggctttggcatcactcagagaaatgcattcctgaccgtgagggatcattcttctctgtgttcttgggaagggattatattttggtggtaaccaggggtagtggatgaggacaggggacagggagaggaagaagagggtttttttgggctgttttcgctggttggctttggcttgggagcatgaaacagcgttaccactcaatccgtgtggttgccctggtgatagggtggctgttgctaggcacagggagagggctcaccatccagggcccttggctgtgatgtgatgtgtgcaggaggttgtcaagtggcctcagagcccagagtctgtggctctgggatggcagctctccccctcttcttcctgcccacccccagggcttgtctgctctccttatctgccctgctgattctctgaccatatatgtcagttttggggctccaggaatgcagctggacatggagcagcctcttccctggggttagactgaataggttgaactaaaaactgccctccctcatgtggggagcttgtggcaggagggggagttgctgcccattagggctgagggcagaggtgcctacccccaggctgcatgcggctgcagccttctggccagattccagacctacagaaacccagcttggtggtcgagtctgccttgtgcctgccggagctgctgttctgctggtgacctcctcatctcagcaccccagacatcacgagcatccccctttcccatctgcgccctccaatccttagggccgtcaacctttccaccttgaaactggtgtcaggagcaccctgcagagtaagagtgggcttggacgcccctaggagcctgcagactgtctgcaatgactggcaggcgattccacatcccctgctgctagttcctgtcctggagcaagcccagctgggcccctcagccatagcttttatttttttatttttatttttttgggatggagtcttgccctgtcgcctaggctggaagtgcaatggcacaatctcggctcactgcaacctccgcctcctgggttcaagtgattctcctgcctcagcttcctgagtagctgggattacagatgcctgccaccacgcccagctagtttttgtatttttagtagagatggggtttcaccatgctggccaggctagtcttgaactcctgacctcaggtgatccgcctgcctcggcctcccaaagtgctgggattacaggcgtgagccacggtgcccagcatgttccttagattcttacaacatttctacccctgtaactgctagagcctgggaggcttctgtgtccaggtctcctgaggcgaggggcgtggacctctgccctctacagctgggactgcatcactgagccagctgggtggcgggcggcacaggacctggcacagctcttccctccccagctgcagggcctggagggaggcgctgagctgtgccatcctctgccccagctgccttttctggcaacacgcctgagccacggagccaggagaacccagagctacgtggagctcttggcggggatgaggagtgttgaggaatagggacagggagcctgggagagggaatggtgggggcaggagggcacgcggtggaggtcgcagaaggtgaaaagagcaggtcactgacctgccacctgtcttcctctctcccaggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcaggtgggcttgtgtctggtctcaggcagctacaggcgctttagagggggaagcactccttctgctgaagggagacgccaggagggcaggatggggcagaccagtcccaggtttgggctgggagcatgggccttactgggggaagggccagacagcatgcctgtggggcagagcatggtgccagccccctggcttgtcccctgaccctgctgtgttcctcagatgactccaaaagcagctccccggaacttgtcacacacctgaagtgggatgacccatactatgacatcgcccggcaccagatcgtggaggtggcaggtaagcacacccaacactattttcctaaccctcagagctcctggcctcaggaagtcagcccttcacaccacaggggaagggcctctctgcagtctgaccgctggccctggtgctcctggcatgtggggagccatgtggcctagtggctttgaagtcagaaagccctgggtttgatctccagctctgctctttgaactctaatttcttccttgtgggttacaataatgaatgcatgtcagggcctagcccagagccagaacacagttggccttgaataagtagccttcccttcccctcgttctattgccctcctacccctccaccctaatgttggcttttccaccctatcagttactggggaggatgaggagtgccagtccttcctgggaaattgtagccctagggaagtctggaatgggcagagcctctttccaaaaatggggagggggcacatggctccctggagcaccagattcctggcagatatgctgccctgctgagagtgggtacagagccccgcttaggtctctgtctcagggagctccctccctcctgttcataaggggggacccagaagaaaccaggagccagggagtcaggctgatgaggtggttgctgcccttagggccccactttagaaggagcagctggaatctaggatcctttatcttttccctaacatttgtccatccttgctggtgaggccaggcattcataagcagggtggcagcatggccctgctctgaggcattggcgtgggcaaggagaacctggcagacaccggccctggaagaagcctgtctggctatgggggtgctgggcttggaaagggagggggcagttgagaggattgccccgaacgtcaaaggtgtttccatggcgtttgtattcttggcgcctgccctgatctgggttgagggccttggctctggcctcattcaccccctgcagaagcaaagctgagagttttttccccagtctggtcctgaattgggcacgggaaagtcaccttgaaggttctgaacttgactggagtctggggggtacctgatgtgaaggagtctctgtcctgacatcatcctggcctgtttggtcaaggcagagctgggggagcctgcccctccccacctccgtgggtgacacctccttccccacaacccccgcacagagctgcaatttgtttctatttccctagactacgatgagcctgagggggcccagccaggtaggtgtccgtcctggctcgctgtgcttgtcctctttggactgcaacctctggggctgtggatcaggaagggctctcggtggaggccagatggggctagcttaattgcagtctcaccctggggagctgggagttggtggtgcctgggagtcggaaatagcagaagatttatgggaggtaggatgggggtgggggaggctgtgtggggacacacccaggccccaaagggaaaggagcttgcgggagggtctggccttgggcaatggcctctgagtggtggctcagggaccttctgggtgatggtgtccccatggatgtgcctccctgattgctgagaggaggctggattggcatcaccaggcactcatttggtgagaccgtggagatgtccgggagaagcccttgtaggaagggagggtgggttatagcctcagctctccctgccgggaatagttgtcatgccccagggtcagatttggctcagtcccagtgggttctttccagtggtgtgctggtaaatggctctctggagagggggaaaaaggccatgatttgtagcatttgcagtttctgcctcccagctctctagctaccaacatgatgtcaactggcttgcaaaattcctgacagttgaacagcttaacaaatgtgtgagctggctgtagcacatgactggctccatcagcccagccctacctcccaggtcccaggcctgctggtccggttgtgggtggggctggtttgagggggcccagaatgcctggggagacctgttggtgattaactccagggccaccctggagttaggaccagcctgggcaacatagtgaaaccctgtctctacaaaaataataacaataaattagccaggtgtggtagcctgtgcctgtagtcctagctacttgggaggctgaggtgggaggatcctttcagtccaggagttggaggctgcagtgagctatgattgaaccactgcactccagcctgggtgatagagcaagatcctggctcaaagaaaaaaaaaaaagattacagtctagtgaagtggttcttaaaactggtcacagtccactttgcaactatgaaaggtatccccaggataggggggatctctttgactgaaaaaaaaaaaaagtgcagccaggtgcggtggctcacacctagtaatcccagcactttgggaagccaaggctggtggatcacgaggtcaggagttcgagaccagcctgatgaacacggagaaaccccgtctctactaaaaatacaaaattagctggggttaaggccaggcgcggtggctcatccctataatcccagcattttgggaggccgaggcgggcggatcatgaggtcaggagatcgagaccatcctggctaacacagtgaaaccccgtctctactaaaaatacaaaaaattttctgggcgtggtggcgggcgcctgtagtcccagctactcaggagcctgaggcaggagaatagcgtgaacccgggaggcggagcttgcagtgagcggagatcgtgccactgcactccagcctgggcaacagagcgagacgccgtctcaaaaaaaaaaaaaaaattagctgggtgtggtggtgcatgcctgtaatcccagctactcaggaggctgaggcaggagaatcgtttgaacccaggaggtagaggttgcagtgagctgagatcacgccacttcacttcagcctgagcgacagagcgagactgtctcaaaaaaaaaaagtgcacatgcttgtaatatttgtcatataacatcatggaggtgctgtgtctgctgagcacattggtggagccctggttcagaacccaaagcttcccacttacaaagtgctgtggccagctgagaggagacaccacaggcctccagccctccccccaacagcttccctaaccagttgctacctcttatattttagacccaggggcctcacagactttctgccctggctgaatcctcaaatctgccagccaatgaggcctgccttgctgctggtgcagatgtgaggtgcggggactcatgggctggaaggaaagatccttttggtagcccccattgtcctcgagcatttcccccaaatcctggttatttcctcgcttagaaggaggtaggcagatgaggccccctcttcccaggctggtggtaggcatctctggggtttctgaagctccagactagtgagactgggcttgccagtctaaccctttgtccctggcccctgccagtctgcttttccttccactgtcagagccagtgggaagtgaatcagagcaggcacatagccccagagccacccccagctggcctccgggatctcagcacctcaggatctaggctagggtacgaaagagagcaggtaccacctggtccttcaaaacagacctgccgggatggagctgcacctcctctgcagacaagctggtagaggattctctacttgcaaatctggagacgttctgtcctgagctttgggaaactcactatctgaagcagtctgacccataaccaaagcataatcaagaacaaacacagaggccaggtgctgtggctcatgcctataatcccaatactttgggaggctgaggcgtgcagatcatctgaggtcaggagttggagaccagcctggctaacatggtgaaaccctgtctctactaaaatacaaaaattaaggctgggcatggtggctcacacctgtaatcatagcattttgggaggctgaggcgagcagatcacctgaggtcgggagtttgagaccagcctgacaaacatggtgaaaccccgtctctactaaaaatacaaaaattagctgggtgtggtgggacatgcctgtagtcctagctactcaggatgctggggcaggagaatcacttgaacccgggacgcaaaggttgcagtgagccgagatcgcgccattgcactccagcctgggtaacgagcaaaactccatctcaaaaaaaaaaaaaaaaaaattagcctggtgtgctggcacctgcctgtagtccctgctacttgggaggctgaggcaggagaatctcttgaacttaggaggtggtggttgcagtgagcccagatcactccacagcactccagcctggatgatagagactccatctcagaaaaaaaagaagaacaaacacagaaatataactagaaccaggcatcccatagtttaatggtgacctgcgattttgtgcaggctaccaaaacgtattgaatacctgccacatgccagacactggaccagtactggagactgtaggtgccatggtacgcaactgtaatcccagctactggaaagctgaggcaggagttcaagactagcctgggcaacataacaagattctgtctcaaaaaattgtttttaattaagcaggtgggatggcatgtgcctgtagtcctagctactcaggacatgggaggctaaagcaggaggattgtttgagcccaggagttcaaggctgcagtgagctacagttatgccactgcacttcagcctgggtgacagagcaagaccctgtctcttaaaaaaaaaaaaatcacagcttgccaggagtaaacaaagaaaaagaacaaacaaagacaatgagacacagcctctgtctttgagctgctcacaagcctgtcagggagacaggtacataaacaattctacaggagagtgaagggtcaggacagtgatgggtgacggtttatgctgggagccatgaaaaggggcagctaacctgtctggggagagagggcgaggacacaggattccaggcggcgattatgcctgcattgagtcttaagggttggtgggggccctagaatatcttaatgagaaaggatagaatgcttagaaacctacagaagtcaatcagaaccagtgtcgtccataattctagtaataagctgggtgcagtggtgcacacctgtagtctcagctgcttgggaagctgaggtgagaggatcacctaaagccaggagttcaagaacagcctgggcaacacattgagacccccatctcttttctttaattttgtctttttttttttgagacggagtctcgctttatcacccaggctggagtgcagtggggcgatctcggctcactgcaagctccgtctcctgggttcatgccattctcctgcctcagcctcccgagtagctgggactacaggtgcccgccaccacacctggctaatttttttttttgtgtgtgtgtttttagtaaagacggggtttcaccatgttagccaggatggtctcgatctcctgacctcatgatccgcccacctcggcctcccaaagtgttgggactacaggcgtgagccactgtgcctggccgagacccccatctcttaaaaaaaattctagtaataaaatcagaaagcgattgtcagtggtcagaaatgagacatgactgttaagtaatcagactgatttcctcagtggctgaaacatgctgagaaggtaacttcaagaggctttccaaatacacactgctcagcgggggtgcttttggaaaagtgtagacttataagatgactatttggcaagatcacaaatgctttagtgagcattttttaaaaattgaggtaagagccgggcgtggtggctcatgcctgtaatcccagcgctttgggaggccaaggcaggtggatcgtgacgtcaggagttcgagaccagcttggccaacatggtgaaactctgtctctactaaaaatacaaatattagccaggcatggtggcaggcgcctgtaatcccagctactcgggaagctgaggcaggagaatcgcttgaacctgggaggtggaggttgcagtgagacaagactgtgccactgcactctagcctgggtgacagagtgagactccatctaaaaaaaaataatagtaataataatttgagataagaatcacataacaaaattcatcagtttgcagtgtacaattcagtggtataatatttagtgcataatgtcataaaattatcacctccatctaatcccaaaacattttcaccacccatacccataccaaatgctgtacccactaagcagtctgtccccattccccactcctcccagtacctggaaaccactaatttgcttcctgtctctatgcatgtacctatctagacatctcatgtaactggaatcatagacttggtggccttttgtgactggctttcacttggcataatgtttcggaggttcatccacattgtagcatgtatcagtacttcattcctttttatggccaaacagtattccattgcatggattaactacatcttttatccgctgatggacatttgggttgtctgcaccaggcataacttttttttttttttttttgagacactcttgctctgtcacccaggctggagtacagtggcaccagctcagctcactgcaacctccgcctcccaggttcaagcaattttcctgcctcagcctccccagtagctgggactataggtgtgcaccaccacacccagctaatttttgtatttttggtagagatgggttttcaccatgttggccaggctggtctcgtaactcctgacctcaggtgatccccctggttcagcctcccaaagtattgggattacaggcgtgagccaccgcgcccggccggcatgactttttaaaaagtgatgttggctgggtgcggtggctcacatctgtaatcccagcactttgggaggctgaggcaggaggaggccaggagctcaagacccagccatggcaagatagtgagatctgtctctacaaaaaattttaaaatttcaccaggtatggtggtgctcacctatagtcctggctacttgggaggctgaagcaggaggatctcttgagcccaggagattggggctacagtgagccgtgattgcgccactacattccagactgggtgaaagaacaagaccccatctcaaagaaaaaaaaatcactttttttttaataccccagctcagtagccctgaaagcaagctgtccctgtcttcagtggcacacccttgcatgcaggaggctgcccggaggtctgtctgcatgggcactctggcccctgtggtaactggctcagatcagcaggcctggcccctttaagttcctcaccccacttcttttggttccccttcaacccactgtgctccatctttctccacacctaggagatgacaagtatgggcggaagatcattgtgtttagtgcctgtcgaatgccccccagccaccagctcgaccacagcaagctcctggggtgagtacctgctgggaagtgtgttggggctttgcccagatccccattgtagcctaatgccacgttctttactgtccctccctgcctgtgggtgctaggccacctgccttaatgccttccctcttctcatgaaggagctggtttatatttaggggagagcactggacgaggagtcagacctagtttctagttattgaagctgggtgaccttggtaagcatctttaagcctcgctttcctcacctttcaaaagggataataatataggcctctttccttgtaggagtgacaaacagcacatgaaaaggaaggacttttgtccagatgtgatgattgactgttataatcctatggtgtttctgagatggttgcagttgtttatcgtttataggactcattagtgttgtcttattttgtgcctttggtgtcagtggtttctataccgatgtgggttctggggccaaacatatgtaatagctctggccggtccagacatgtcctgattcatgtctgaaggctggttgaatgccaaggcttgaaagactcatttatggttgagccagctctgggcccacaggcgagcaaactcacttcctgctgctgtcctcggggtgtgtagtagagtgagaccatcttgcccttctttctgttttctcggcaaattttagaaagatgcagttctttcctgaccagtttgaagcactctctgaaatgtaaaatcctggcactgtcccaagcagctctttgagaccctgaatggttgcgtgcgagcaggaggaggtgtgggcttagggacagacccagagggcagccgcagaaggagaagggcctgaatttggagtctcagccagtcctggcaagccagggccacaggctgagtcttccagcgtcatctaggaattctatctctctggccttctgaaccctcttcccactgctcttcagacaaggcaggcagagccttgtccaagcccgccgcacggcccagccagaatgggcaagagcttggcctggggctggtggaggcacatggccttttctctagttctttctatgtctgatgtaccaggtgacagcctcctgcccagataataagtgaagtgggaggaagtcagtggatgtgggtggaaagcacctggttttcaggagacagcttgccagggaaggccacacccaccccagggcgtccttggcttcaggaagtcctcaacatcagctgctgcttgtcctccatcacttccgtcctagtcacagtccctgctgagggcagtggggtgcttccatcatggagcactttgtcccattttcagtcagattatctcagatgtggctcttcccagctgtccacccagatccaggaggttgaaatagaaagtgcctgagcgccactgcactctagcctgggcgacagagcgagactccgtctcaaaaaaaaaaaaagaaagtgcctgaagtggctggacgcggtggctcacgcctgtaatcctagcactttgggaggtcgaggcgggaggatcatgaggtcaggagatcgagaccatcctggctaacatggtgaaaccccgtctctactaaaaatacaaaaaaaagattagccaggcgtggtggcgggcgcctgtagtcccagctactcaggaggctgaggcagaatggcgtgaacccgggaggcagagcttgcagtgagccaagattgaaccactgcactccagcctgggcgacagagcgagactccgtctcaaaaaaaagaacgtgcctgaagcttggaatcaaattcagaagacacattcaacttcagctctgcacctcttgctagctgcgtgccttggggcaggtcttttccaagccctgtaaaaatgagacttgtggctgggcgccacaagtctcttgtggctcctcgtccagcggctcatgcctgtaatcccagcactttgggaggccaaggtgggtggatcacgagatcagcagttcgagaccagcctgaccaacatgaccctgtctctactaaaaataaaaaaattagccaggcttggtggtgcatgcctataatcctagctactcaagataatcccagctactcaagaggctgaggcagaagaattacttgaacccgggaggcagagatttcagtgagcccagatcatgccatttcactgcagcctgggtgacagagcgaaactccatctcaaaaaaaaaaaaaaaagtccgggtacggtggctcatgcctgtaatcccagcactttgggaggctgaggcaggtggatcatgaggtcaggagattgagaccatcctggccaacatggtgaaacctcatctctactaaaataaaaattagctgggcatgatggcatgtgcctgtagtcccagctactcaggaggctgaggcaagagaattgcttgaacccgggaggtagaggttgcagtcagccgagattgcgccactgcactccagcctgggcaacagagcaagactctgtctcaaaaaaaaaaaaaaaaaaaagagacttgtgcccacctcccagggctgttgtgggcattaggtaagaacatatgacctggcgcggtggctcacgcctgtaatctcagcactttgggaggcgaaggtgggtggatcacgaggtcaggagttcaacaccagcctgaccaacatggcaaaaccctgtctctactaaaaatacaaaattagccatgtgtagtggcatgcgcctgtaatcccagctacttaggaggctgaggctggagaatcacctgaacccaggaggcggaggttgcagtgtgccaagatcatgccattgcactccaccctgggcaacaagagtgaaactctgtctcaaaaaaaaaaaaaaagaatatacatgaaatccattgtgtacatttttaaagtattacaatttagagagtttagaaaaatatacatagccataaataaaaaaatatatagacaactgtgaaaaaaaaaaggtctcccacacacccaccacctagagagaaagttactgttaatatttttgtgtagtcatttcctattttttctgtaatgtatatggaactctatagtcagtttggtatctttttttttttttttttttgagaccgagcctcgctctgtcacccaggctggagtgcagtggcacgatgttggctcactgcaacctccacctcctgagttcaagcgattcccctgcctcagcctcccgagtagctgggattacaggcgtgcaccaccacactcagctaatttttgtatttttagtagagagagggtttcatcatgttggccaggctggtcttgaactcctgacctctggtgatctgcccgtctctgcctcccaaattgctgggattacaggcgtgaggcaccacacccagcctggttttgtatcttacataacatttttttctgagcattaaatattcttcaaagatatcttctaaaaaacattttattgacatcaaatatgctgacagaaaagtgaataaaatataagcgtactgtgtgaattttcaaaaactgaacacatctatgtcactcacaccctacaaagggcataaacactgttctgacatctgacttcacagattcattctgtctgcagaaatgtcctgtgagctattctatttatggttgtcacgtggttgatttaaccaattccctgctgttgcagttagcttgccactagattttttttttccctatcataaaatgggccatgaagaacagccttctacaaaaatgttttcgttcatctcagattatttccttaggacaaactcctagacatatttttacagggtcagagagtatgagcattttatagcttctgataaacatcactttatttccctacaaaaggccataacctccatcagtggatgagagtgtctgttttcactacaatctttgctatttttgtagttgcaaaatgcaatctctttatgcgacagctctttgtaaactgcagtgctcagtgtggagaaggggtaaatgaccatgtactggggatcccagcatcagccaccccatgcctgcctgtgctggcccagcctggcacccacgggccagtcttgagcatactctgtctgggttaggtcaagctctggccacttcaccaggcttctctccttccctgcctccccttggaagtgcttagcattctgcctgcccagcctcccagcctgcagtagtgtccctgtgggagcctaggagctgtttggccaactagaaagagggctctatggccgggcgcagtggctcatgcctgtaatcccagcactttgggaggccgaggcaggcggatcacctgaggttgggagttggagaccagcctgacgaacatggagaaaccccatctctactgaaaatacaaaattagctgggcgtggtggcacatgcctataatcccagctacttgggaggctgagtcaggagaatcacttgaatctgggaggcagaggttttggtgagccgagatcatgccactgcactccagcctgggcaacaagagcaaaactccatctcaaaaaaaaaaaaaaggagagggctttacacacactcccttccctttccccagttcttgttcattccatccataactctcagtgtgctcaacaccaggtgtgtatatgtttgtgctgagctggtagatagcgtgtcatgagcataatagggaaccagaggaattggggctctttggtccactaaaggcccagtgactggagcaggtgactctctggccaccccatcccctctcatgggcacagtgttttaccgccggcactggagttcatgtgtagaaggcaaagctgtcccatggtcaagaatgcaggctttcggccaggtgcagtgactcatgcctgtaatctcccagcactttgggaggctgaggtgggaggattgcttgaggccaggaactcaagaccagcctgggcaacatagtgagacctgtctctacaaaataaaaagtagaaaaaagagccgggtgtggtggctcacacctgcggttcctactactcaggaggctgaggcaggaggatagcttaagcctgggaggtcaaggctgcggtgagctgtgattgcgctacggtgccccagcctgggtgacagtaagaccctgtctcaaaaaaaaaaaaaaaaaaaaagcaggctttggtgttagacacttcacttccaggatctaccacaagctgtgtgaccttggatcagcacttgacctctctggtcattgccttcatttgtaggatggggattacatcagcctcagttataagcaatgtatgagctaatgtatgtgaagtgcttggcagacactaaaaacttaatattgagaaatggtgactgtcatcattattattgattcagagaaatccctgattcaggggaaacgtcattccccttttcactgcaggcctaggcaggcccgggttagggtcctggtctcctgacatctagttcctgctcaagagtgagaactgttattattattactattattgagacagagtttcactcttgttgcccaggctggagtacagtgccacaatctctgctcactgaaacctccgcctcctgggttcaagcgattctcctgcctcagcctcctgagtagctgggattacaggcctgcaccaccatgctcggctaatttttgcatttttagtagagatggggtttcaccatgttggccaggctggtcttgaactcctgacctcaggtgatccacccgccttggcctcccaaagtgttgggattacaggcatgagccactgcgcccggctgagagctgttattactattctcattcctctgcccagcctctaccctaggcctcctccacagcaacctggtgactgattatgagccagaacagactgtgctaggggagggcctgtggggaaggggctgtgacgtggtgggagactcttggggctgctttctgtcttcgtggggccgcccctgtgcacagggcaggcctgagcagggcttttccctggaaggtacctgaagcacaccctggaccagtacgtggagagtgactacacacttctgtatctgcaccacggcctgaccagcgacaacaagccctccctcagctggctccgtgatgcctaccgggagtttgaccgcaagtgggttggggcatggggcctgcacagtcagatccagaggcagcggctctgccagcttccgggctgccctccacttgggcaggagcttattccaaggcagggggtggcgggggctgccgtctacgtcaatgtaaagaatctgcagtcagatcaccctgggcttaagtaaggcccagtttctcagcttatttgcactctgacctcttgttttacttaacctctttgagcctcctgttttctaatctgtaaaatgagacagtgatggcccttacctcgcatgctggccatgcatgttcaaatcagaaaatatgcactgaggcagggtgtggtggctcacacctgtaatcccagcactttgggaagctgaggcggatggatcacttgaggtcaggagttccagaccagcctggccaacatggtgaaaccctgtctccgctaaaaatacaaaaattagctaggtgtggtggtgggtgcctgtaatcctagttactcaggaggctgaggcaggagaatagcttgaatccgggaggtggaggctgcaatgagctgagatcacactccagcctgggtgaaggagactctgtctcaaaaaaaaaaagtatgcactgggaccctagcgtggcacctgtcccaccacgcctgctcctgagttgtccattctgtctctgcaggtacaagaaaaacatcaaggccttgtacatcgtgcatccaaccatgttcatcaaaactctgctcatcctcttcaagcccctcatcaggtgagtggccacgggcagggctggtggtcccggcttgcctggaactctgaagctgggaggctgggcagcctggggaccaccaggtgcggctgggcttccgtctgaactgggtgggtgttgaggggagagtggaggccaccggaagcgggcccccacaacccaggccctttcttccaccaacagcttcaagttcgggcagaagatcttctatgtgaattacctgagcgagctgagcgagcacgtgaagctggagcagctggggatccctcgccaagtgctcaagtgaggcgggtgcggcggctgggggctcgtgaagccagggtaatgaggacgtgtgtcctgattcagagaccgcgtggggcttaggcagagcaagcccgtgtcccgacctctcccaggtctttgctttctgctgtggaaagcggagttgttacagagatcgcatgagatgatcctcctgaccccgcgtggtcaatgcttgattgaattggcagagtgactccagagccaggcaggacctgacccacctccctctactcctacagatatgacgacttcctgaaatccacacagaagagccccgcgacagcccccaagcccatgcccccacggccccccctgcccaaccagcagtttggagtctcgctgcagcagtaagtatgaaaggtggctgggccacggcggggcgggaagggctgcaggcccggctcaccagcctttttcccgcagcctccaggagaagaatccagagcaggagcccattcccattgtactcagggagactgttgcctacttacaggcccacggtgagtgccgggcctgcctcctcaccagccaggtctcccggctcccttcaggaagctggggaagctgctgggcagggcagagggaggtcctgcaagcctcaacgtccccacccagccctgcctagaaccccaagacagagaaggggcagggaatccagccggtgcccagcgctcggaggctcaccaggccctactgtttcccagctctcaccaccgagggcatcttccggaggtcggccaacacccaagtggtccgggaagtgcagcagaagtacaacatgggtgagcagccctgggctgttgcagggccatatgtgtgttactggtagggggcttctctgccctctgctgccctgtaaatgagagtctcagagtctcttcctgctggaggtttccgtggctctgggtgtcacataagtcctacttctgccaggcctgctgcctcatcggtcgggctcccgggtcctgggtataggcacattcagaggcaaggaataacggtggggtgtgccgggccccacttccccagatggccggaacctgcattctctgatcacagaggaagagggaggcaggtgtcagagggcgcccctgggaggaggggcttatgcagtgtccaggggcagtcaggcagtgcggcccgcgttgtctgcagatgggtgctgcccttcaggctgtgccgagcttctctcacgctgcccccaccccagggctgcctgtggatttcgaccagtacaatgagctgcacctgccagcagtcatcctcaagaccttcctccgggagcttcctgagcccctgctcacctttgacctctacccccatgtggtgggcttcctcagtgagtccccatctcttctgttgggcctggggctggacttggggcaggtgcgctgcaggctttcgggcctaggcgcctcccagggaagactgctgggggtctcccctctagcctgcatcagagcgtcctgaaccagcccagcctagggcccctataacccgggcctcctttcctcatagacattgatgaaagccagagggtgccagcgacactgcaggtcctccagacgctgcccgaggagaactaccaggtgcttcgtttcctgactgctttcctggtgcaggtgagaccttggacttggcctctggggtgaagggagggggaaggaggagctgccgcctcctctgcgccctggtcattgttgctgggagtgggaggcagcatctgtggcttcctgctgcagtccctgattccctccacagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcacccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgc

SEQ ID NO: 36082 - DNA, 12668 bp, Homo sapiens
tgcaccctgagccggagctgcccagtcgccgcgggaccggggccgctggggtctggacgggggtcgccatggtaacgggggagcgctacgccggggactggcggagggggggcccacgcgtaaatagccgaggctggatcgggcgctgacaagtcccttctctgccgcggatggtctgggtcaggcgcgggctctggggattgggaccgatccagggccgggaaggagggcacagggcggtgattctgcgcgcgggggttaccaggggtctcgcggcgacgggcattgggggtggtgttccaaggggaaagggctgtgcaggtgggaaacgttgtagatggttggaagctttgaaacgagaggaaactcgtgagacacagtcttgtgggtagcgagaaggcattggaggtggggagagggcgtccgaaagaggaaggcgctctggaagtgtggcgggagcgctgggacgagaacgcgagaccttggaaaaggggagggaggttttcttgatgggaggagtctctagagacaaggatctgattgcaggtggagaggggatgttgagacaggggcaggagactgcctgtgagagagggatgatctcaagaagagacctggcacaggaaaccaaaaggaggcaactgtagggaatgaaacttaagggtctgggaaagcgctgtaaaaggagagaggacctggaggtaagatggacactcggaaagaatggggagcaactgaataggtctttccaagaggagagatcttgtggggtggggagtaggcttgaaagtgtgagacctggggaggaatctttgttggggcaaagactcaacattggatttaggagtgcccctatcccccaggttggggctttggatctaggaaagggttctttgggctggaagttgggaaagaaaacgaatgagaaagagtgtcagagcgggggcggagtctcctccaggaacagggtccttggaggcaaaatgtgaccttttgaagaagggaggaagcttgggagtgggacaagggatgtcaccagtaaaaagcccattgaggccccaaggaggggaactgagactgagaaagtggaggtcaaaagggaacaactccagaggagggggattggagacagggaaggttggggggcatctagaggggacagcagaggcgtgaggatgcagagattcaggacggaggggacttgagattccaaatgggaagaaaacagggagaggtatacaagggaatttgggagtaagaggcagagctttttgtcaactctgtgggtttgcttctagttctcctaactgtgtgaatatgtctccggctctgctcccaggctgtggctgcctggtgtaggccccccaacgtcccttcctgcctgggacccctgccctgctaggaagtggttttccctggctcagcaggagttcttggaaggagagtgtaacatcctgttccggtccagtttggttggttgggggagggaggatagagtgtgtggagaatgaggcttaggaaagactctcaggctggggcggtgactcatgcctgtaatcccagcactttgggaggctgaggcaggcggatcacataaggtcaggagttcgagaccagcctggccaacgtggtgagaccccgtctctactaaaaatacaaaaataagccaggtgtggtggtggatgcctgtaatcccagctacttgggaggctgaggcaggagaatcgcttgaacccgggaggcagaggctgcagtgagccgagattgtgccactggcctaggcgacagagtgagactctgtctcaaaaaaaaaaaaaaaaaaaaggctgggcacagtgactcgcgcctgtaaccccagcactttgggaggctgaggcaggcagatcacaaggtcaggagttcgagaccagcctgaccaacatggtgaaaccctgtctctactaaaaatacaaaaattagccgggcatggtggcatgcgcctgtaatcccaggtacttaggaggctgaggcaggagaatcgcttgaacctggaggtagaggttgcagtgaaccgagacagtgccactgcactccagcctaggcaacagagtgagactgtctgaaaacaaaaaagaaaagaaaaagacaggactagagggctctctttcctaagagagaaggctcccacaagttggggtcaggtggttcagagcaaagcctttggactcccacctctgctttctggctgtgagacttcctttccctaaatctcagtttcctcatctataaaatgggcatgagcatgcctgtctcagacagaaatgggcccagaacttctaatggagtaagctttggccatggttttctgaacatcacataatggaaaatataatgctgctaagagctggttcttatgtaacacttagtacgtgccagtcactgtactatacctctatgtttttgtttttgtttttttgagacagcgtctcgctctgtcacccaggctggagagcaatggtgcaatgtcagctcactgcaacctctgcctcctgggttcaagtgattctcatgcctcagcctcccgagtagctgggattatagccgcctcccccctgccccccatcacacctggctaatttttgtatttttagtacagatggggtttcaccatgttggccaaactggtctcgaactcctgacctcaagtgatctgcccgccttggcctcccaaagtgctgggattacaggtgtgagccaccgtgaccggccaggaatatcctttactcctcacagtaaactcaggcaccaaagtggcaccaaagttaagtcatgaaagtggcagacgctttggaaaacggtttagcaattcctgagaaagttaaacatagcgttaccctatgagccagcaatctcactcttaggtatatacccaagagaaatgatccatccacacgaaaactcatacacgaatgttcatagcagtattattcataatagccctaaagcagaaacaacccaaatgcccgaagtacggccttatccatccaacagaggatcactcagccacggaaaggaattgcagctctgccgcttgccaccccacagatgagcctggaaaacgtcacgctgagtgaaggaagccagacacgaaagccacagagtgcatgattccactcatatacaatgtccagaacagacacatccacagagacagaaaggagactcgtggctgccaggccctgggggaacggagagtgactgctaatgggtggggagttttttggggggagatgatgaaaatgttctggtattagataataaattagatagtggtgatattaggtggggtgcagtggctcacgcctgatgcagcactttggggggatgaggtgggtggatcgcttgaggccaggagttcgagaccagcctggacaacatggtgaaacactgtctctactaaaaatacaaaaagttagctgggcgtggtggtgtgcacctgcggtcccagctacctgggaggcctgcacccaggaggtggaggttgcagtgaggcgggatcgcgccactgcactctagcctgggcaacagagctagaacctgtctcaaaaaaaaaaaaaaaagtggtgatttttacacaactgtgaatatatactaagtgaatataccaaaaaccatttaactgtctacattttaagtggatggattttatggtgtgtgaattacatttcaattttataaaaagttaggaagcaaagagaaaaaaagaagtggcagagctgagacttagcccaaaggagtctgaacctcaaatgtttattgagtatctaccacctaccagccaccgaactaagtttataaactttttttttaacctttaaaaaaaccctggctgactgggcgtggtggcccatgcctataaccccacactttgggaggcagaggcgggcggatcacctgaggtcagaagtttgagaccagcctggccaacatggtgaaaccccgtctctaccaaaaatacaaacattttccaggcgtggtggcgggtgcctgtagtcccagctactcaggacactgaggcaggagaatcgcttgaacctgggaggcggaggttgcagtgagccgagattgcgccatcgcactccagcctgggtgacagaatgagacactgtctgaaaatttaaaaataacaaaaaatataatgaaaaaaccaccctggtgagatgaatcttcttgggagacttgttttgctggtgaggaaacaggcctagaggggcagacaaagcagggcacagtggctcacacctgtgatcccagcagtttgggaggccgaggtgggagaattgcttgagtccaggagtttgagaccagcaacgtagcaagactctgtctctacaaaaaaaaaaaaaaaaaaaaacagagagagataagaggtggtggaggagcctgggactcggggccctggagctgactccagagttggagacttgtggaagggaagtcactccacaggggtgctggagggacccgggatgaagcgtgtggccaggccggcctggcttgggtctggggagcagccgagacccctggaagtcaggcagcagggaggccctgagccctatctcccctctgggtggatgggtggggccgttgggcagcacccaacccgccctctctgcctctctcacttcctccttctcctcctgctgcccccagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtgacgcccgctccatgcctcctgcaccccgctgcttcctcgtgccctacttcgccactccctgcccagcttctagttgcaagaaccccttggaccctctatccatcctatatcattcactcaacctgctttgagcttgcttgcttcttcccttcctttacttgtacttttcattgtgaaaaatcataaacatacagattagtacaatgaaagaaaagtagattggagattcgtatacctactacccagatttaatcagtattaatattttgcctttttgttctgcattgttattattaattttttttgcctacgattaaaaaagaatttttttttttggtcaaattttttttgctggtgcgtttttcaaacttcctatagaatgttcaaacacagaaaagtagagagaataggccaggtgcagtggctcatgcctgtaatcccagcactttgggaagccaaggtgggaggattgcttgagcccaggtgttcaagaccagcctgggcaatgtagcaagaccttgtctttattttttatttgattgaattgaattaattaattaattaattaattaattactttttttgagacagagtcttactctgtcacccaggctggagtgcagtggcatgatctcagctcactgcaacctccacctcccaggttcaagcaattctcctgcctcagcctcccaaatagctgggattacaggcgtgcaccacaacaccaggctaattttgtatttttggtagagacgaggtttcaccatgttggccaggctggtctcgaactcctgaccttgtaatccaccctcctcggccttccaaagtgctgggattacaggcatgagccactgcgcctggccttttttgcctttttttttttttttttctgaaatggagtctgtctcagtcacccaggctggagtgcaatgggggcaatcttggctcactgcaacctcctccagggttcaagctattctctgcctcagcctccctaggagctgggattacaggtgctcgccaccacgcctggctaatttttgtatttttagtagagatggggtttcaccatgttggtcagactggtcttgacctcctgatctcaagtgatccacccgccttggcctcccaaagtgctgggattacaggcgtgagccaccatgcctgtccctctttaaaaaattttttttgaaacaggagctcattctgtcacccaggcgggagtgcagtggcacgaacatggctcacagcagccttgacttcctatgttcaagctaccctcccacctcagcctcctgagtagctgggactacaggcttgtgcactaccaagcccagctaatatttgtatttttggtagcgatggggtctcaccatgttgcccaggctggtctcaaactcttgagctcaagtgatctgcctgcttcggcctcccaaagtgctgggattacaggcatgagccactgcgcccagccaggatgcaggtttaaatggtttggttaggatggcattgctgaaaaggtgacattggagccaagacctgaaggacttgacggggaggaaggagccaatgtctgagaggaacatttcaagccaagggaacagcaagtgtaaagtccctggggcaggagaatacttagggcgttccagggatagcaggaatgcagccaggaaggggaggagatgaaagagagaagataacagggtaatctcttggtgcagggctgcagggaagacttgggctcttactatgagtcagatgggagccgtagaaaagttgtttttgccggccgggcgcggtggctcactcctgtaatcccagcactttgggaggccaaggtgggtggatcacaaggtcaggagaccagcctgaccaacatgatgaaatctcgtctctactaaaaatacaaaaattagccgggcctggtcgtgggtgcctgtagtcccagctactcgggaggctgaagcaggagaatcgcttgaatccaggaggcagaggttgcagtgagccgagatcgtgccattgcactccagcctgggcaacagaacaagactcctctcaaaaaaaaaagaaaggttgtttttgttttttggtgttttttagagacacggtcttgctctgtctcccaggctagagtacagtggtgcaattacagctcactgtaccctcccaggctcaagcaagcctcccacctcagcttgccaagtggctgggactacaggcatgcacctccatgcccatctaatttttaaatttttttttcttttcaggtgggttctcactctgttacctaggctagagtgcagtggtgcgatctcagctcactgcaacctctgcctctcggggtcaagcaattctcccacctcagcctcccgagtagctgggaccattggcatgtgccaccaatgccgtactaatttttgtatttttggtagagacagggtttcgccatgttgcccaggctggtctcgaactcctgagctccagcgatccgcccaccgcagcttcccaaagtcctaggattacagccatgagtgaccacgcctggctaatttttaaatttttcgtagagatggggtattgctatgttgtccaggctggtcttgaaccatggagggttttgagcagagcatggccattggccgacttgaggctgcgctatagggcaagagcatagaggagactgctcggagagaggtggctgcagtggtccaggtgggagatgctggtgaccggaccagcatggaagccgtcggtgtggccaggagcgttttggaggtggacccagctgaatggccaagaattggatgtggaatgtgagagaaagcagagccagggcgacaattagatttcccacttgagcccccgggtaggatggagctgtcattatctgatatgggcagatgggaagggcaggcggaggtgaagatcaggagggaagtgttgggggtctggccccgagtatcgtccacatcccagcagagatgtccaggaagaagtgacgagtcagggttcttggagagagctgggtaggatatggaaacggcatttctgcacatagagggaaaccgaggccaaggagctcaccggggaagtgaggatagaccgaggagagcaccagagggccacgtctgcaggcagagagatgagggagaggagaaccaagagattgggtgtcccagcagccaggagggggacagggttggacttacctctccaggaggaggtcactggtggtgtcaccaagagcagcaggtgggaagggggagaggaactgggtgtcgggtgttctggctgtgtgggcaccttgctgctaatgtagtggctggtcctgtgctgagggctggggcgcgggaggggtcagtgaggcccaatgatacaggggcagccggaaagtccggctgggcaaatgagaatgttacagaggaggctgaccctcaggtcttgagttcctccatgcctccaggatccaggcccgcccattcattcagttgttcctttgtgcatgtattcacctaatgtttctgtgtgcctcctctgtgatcagcccagtgctaggttcacagcagcactgagacagccttgtgctgctttgggactcatagcccaggaaggaacacaagcctgtcctagacagtgacaaccacagtaggcagggctgggatcgaggagcctggctgggggagggcacctgacccagcctgggggtctggagggcttcctggaggggacttgtgagtgaagatcaaagggaggagtaggcaactggaagatgcgggctatccctcttgttattattattattatttgagacagggtctcactctgtgccccaggccggagtgcagtggtgcaatcatagctcactgcagcctccgcctcccaggctcaagggatcctcccacctcagactcctgagtagctgggactacagggacctgccaccacgcccaactaattttttgtatgttttatagagatgggtcttgatatgttgcctaaactgctcttgaactcctgagatcaagccttggcctcccaaagtgctgggatgataggcatgaggcccggcacctggccgtcgtccaatctctgtctgactcgcactgtcccgcctcccgctttcctttattagcagcccagtgaggacattggtcccgcctgaaccatccaggattatcgccccatctcatgcttcttaacttcgtcacaagttgagactgcagagtccctttttgccatataaggtcccatattcacagggtgtgggattaggatgtggatgtctttgggggccattacctgtgccagccctttgcagggcaacatggaggacacagtgtgacagctccagcttcccccacaggctcagtccaatggggagacagacccatccccagacagtggcgaccagcagtggtcaggctggggcagggcaggggtggggcagtggcgtgggatgttcagaggggacacctgccccagcctgcaggatgagagaatgtgcttctctgagagaatgtagctggaggagagatgggggtctgcagcagatccctgagaagcctcgaaatttaaaacaggaagggaggctggaaagatggagcagtagctggaggcggaggagggtgagagccagaaaagctggattgcaagaagagaggagcactgatgatcagtgtcagctcatttacccgtggattacatgtaggccttactgtaatcacaccagaaaacatactcaggctgggctcacgcctgtaatcccagcactttgggaggcagaggcaggtggatcatctgaggtcaggagttggagaccagcctggccaacatggtaaaacctcatctctactaaaaatacaaaaattagccaggcgtggtggtgcacacctgtattcctagctactcaggaggctgaggcaggagaattgcttgaacctgggaggcagaggttgcagtgagccaagattgcgccgctgcactctggcctgggcgacagagtgagactgtctcaaaaaaaccaaaaaacaaaaaaaaccctgaaaacatgcttggagtatagcaatgaacaagagattgagctgaaaaaatgagtaaaaagctattagctgggtgtggtggcgcgcctgtaatcccagctactcgggagactgaggcaggagaatcgcttgaacccaagaggcagagattgcagtgagccgagatcgagccactgctctccagcctgggcgtcagagccagactcaaaaaaaaaaaaaaaaaaaaatgccgaagactgatgctggcactcatagctgtcagcaggtggcgacacaggcacaccccagacctagagctgctgtttttttgtgttttttgagacagggtctcccgggctggagtgcagtgatgggaacgtggctcacagcagctttgacctcccaggctcaggtcatctccccacctcagcctcccgagtagctgggaccacaggtacacgccaccatacccagctaagttttgtacttttgtatagatggggtttcaccatgttgcccaagctggcctgaaactcctgggctcaagtgatcctctcgcccggcctcctggagtgctgggattttttttttttttttttttgtaatgaacctgacattgagaacatatagaactgaactggattttcaggttttggccaaagacattgtactttgcaacccagtatgcatatatatctgtctttgtctacttaacacgcgcataaaatgagaatccatgtccctgatcctggcatgtttgttcacggtgtgtgtctgtgttactattgctaactgtgtatatcgcatttcagtgagggcaggacaaggacccaggatcgtcttggtggcagtggtaaccctcctccccacactgcctatcacaggcctggcatagagtagctgctcaggaagtatttgttaaataattgagttaattaattccaggctaagggatgtgactgtctccagaggtagcaggaagtcacagaagggagtggcaaggttgcatggacactattgaacacgtcaggctcccgcccagccccgggcttttgctatctgcttagaacattcctgcctatcctccagctctcagctccgataccccctcctccaggaagccctcctgactctccaggatcagagggggttaggcaccctctttgggctctcacagcccatcctgtccattctggggatgcctgcccccgctgcactgtgagcagggttagggctgtctcggtcactgctgtgaccccagcacagggccaggcacagagctgggcctcgggaccacgtatggagtgaaggagtgaatgttttggccccactctgtctggcacgttaggtcctggcaatctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtacggcgggagagggatgtaaggtggggaggcgggtgggcagccctggagtggcccccaaggcctgggaaccctccctggtccctcctgagccctccctctgcagtgactgggactctccctctccatttcttttttttctttttctttttttttttttttttttttttttttttttgagacggagtcttgttctgtcgcccaggctggagtgcagtggtgcaatcttggctcattgcagcctccacctcccaggttcaagtgattctcctgcctcagcctcttgagtagctgggattacaggcacacgccacgatgcccagctaatttttgtatttttagtagagatggggtttcaccatgttggccaggctggtcttgcactcctaacttcaagtcatccttctgccttagcctcccaaagtgctgggattacaggtgtgagccaccgcgcctgaccttttgccatctctttgcatcgatctttgcttttgtttctctctgtgtgtctccttgcctctctccctgtcactgtctctctctctcccctgcctcccccttggtctctttttttgctgtctctttctgatgaccttgttcccatctctgtgcgtgtgtggctctctccctgcccatctcttaccatctctgccttcctctcccaggtcttaaacgaatatttccacaatgtctgtgaactggacctggtgttcaacttctacaaggtaggctcctggtgaagaggaggctgaaggagccagaggagggggacgggggggacccgtggtgcactagccacccggagcctctgctgaggtctgtgtcccagctcgaggggcatcagagccccagcttccagggtccgggccagcatcctggggggcctcgtctcaccccagggtctcccctcacacaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggc

SEQ ID NO: 36083 - DNA, 3553 bp, Homo sapiens
acgtcacgtcgtttaatccggaaacggcggcggcggcgacaggaccgaggggccttagttggtgggcaagtcggggatcccagaaagagaagcgtgacccggaagcggaaacgggtgtccgtcccagctccggtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcttcacagccccacattcacctgttcttggtacttagcgtttccgcccatcctgtcctcctctatcagaacccccacaattgctctgtcctcggtgcccacagtctccaaaacaccagtgcaccggcccgcgtcatcccccgctctcagtcgtatcaaggactccagggcctcacccatagttctggagagggaagctgaacttgcaagccataacttcttttggggcatggcgatgaaggaggggctcgggccagcacttggataattttcaggtctacctgtccccctttatgtgtccccgggacaatcccagtgttctcagctgctcccttttggctcctcattcctgcctccagtctccgttagccccttcccatttggcaaggctcccgtgaccctgttctgcttcttgccctcctgggccccatgccctacaactgggcctcactcacatctgtctcaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggtgagtgtgggtggtcgggcaggttgctgtcaatcaggcacggctctaacagcagtgaacaagagagaccagacaccaaacacaggtgctttcagcaaaacgagtggagtgaaaggtcagcagggcttccctagtttgagggtctggaaggctgcctccaaggaactggtatgagatccaaggcttgagtgatgagagtgagcctacagatctgggcagggaatgtgttaagcagacagagcagcaaatgttaaaaaagagcctcaaaaaaatgggagatgacaggtgagcttcaagagttgggcatggaccagacaattcagaactctgggccaaagtgggagctaagttggaaggttagggattacagggccgggcgcagtagctcagagacctgtaatcccagcactttgggaggcagaggtggttggatcacctgaggtcaggacttcgagaccagcctgaccaacacagagtaaccccgtctctactgaaaataaaaaaaactagccaggcatggtggcgcacgcctgtaatcccagctactcagcagggctgaggcaggacaatctcttgaacccaggaggcggaggttacagtgagccaagatcatgccactgcactccagcctgggtgacagagcgagactctgtctcaaaaaaaaaaaaaaaaaccagttaactataaggataagctggcccggcatgatggctcaagcctgtaatcccagcactttgggaggctgaggtgggtggatcacctgaggtcaggatttcgagaccagcctggccaacatggcaaaaccccactctaccaaaaattagccgggcatggtggtgcatacttgttatcccagctattcgagaggctgaggcagaagaatcgcttgaggccgggaggcacagtttgcagtgagccaagattgtgccactgcactccagcctaggcaacaaagcaagactccaactcaaaaaaaaaaaaaaggtaagggtaagctataagctatggccaagaggctggtaagagacagccggaaccagtagggagagcatgaagaaggaacacagcctttgatgggtgagagggttttggcctgaacaggtaggcagagaagataccatttcttgggatgggcaagaaagatgtttggagaggaaatcaaaagctgagcctcagataggtctgtatgtgattctggatagttcgaggtatgggtttgtatcaggtgaaggaagagacagattctttgtctaggctgggaataaaaattgaggaatggctgttgtaagtcaaaagaatgactgaaaacatggagggaaaaggaaccctcaggagtgagcctggggcctttcttttaccatttacagatcaagagaagtgaggaggaccttacaaaggagcccagggagttggtggcccaagaggcagaggagggttaggtcagaaggagggagggaccagtgaccattgggttagccagagtctctggaaacttcaagtggaattgcaaattgggctggtggggagggacaaccaactaatggggtgtcaagaagtgtaggataatctcattcctgtgtccttgatacccttgtctactctgcaggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacaggtgcgcttttcccaatcccccttcccactcccacgacccatggggatcacactcacactcctgtcacttccagctgaagttgccccagatccagaagatcatgatggagtttgagcggcaggcagagatcatggatatgaaggaggagatgatgaatgatgccattgatgatgccatgggtgatgaggaagatgaagaggagaggtatggggaaactggatgggagggtggagatgtttgcctggccctcacggagtgcatagccctcactgagttctctctcttccctagtgatgctgtggtgtcccaggttctggatgagctgggacttagcctaacagatgagctgtcgagtgagtgctccaaatcctggaccccatttcccacccaaggcccagccacagctccaagccctccctttccctgcattactcccctccgctgcctgaccccacctgctcaaacccccactttctctgcagacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacact

SEQ ID NO: 36084 - DNA, 29331 bp, Homo sapiens
ttccaagctggttttgaagtcgcggcagctgttcctgggacgtccggttgaccgcggtgagtggcgggggcgtctcagttgagctggggggcggtgtccatggagtcctggggcaccccaggggccggaggggtcggggagggcctttctcggggtgggatttgctggactctgcggcctggggaggggtcttcagcccaggctggtcacccctccccccagaaaaatccaacttctgcaacgaagctcagactttgaaaccctcttctcacttcctgggacttttgaggggcgaaagagccccgtagaaggggtgatattgaagggggtgggctaaataccgccccccgcccaccaggttttctctaaattttgaacagtttgcttttggaaacgccatttgcaggcaagtttcctcctgcgggcagaatctccgccctcccttctggggttttcagagacaccccccgccaccgcaaagccccctcccctacagatggttttgccacgggtgggggtgggggttgccccagctcctggcgcccccaactgattctggggaggtcttgggcaaagcctgcccacttccctcgggtgggcgtggcgacgaggtggcttaaaagtaggaaggcctatccgttaactgctttggggttcttgtcccggctaggcctggcagtgggacctggggcccttggaattttggaagtccagtcttagcatgctctgaagttgctggatggctgggtctggcctggagctccccttctggagccagcggcaaggcaggtcactgacccccaggggtttcatagggtgttgacatctgccatggccacccttgcttaaaccagttccaggaagtcatggtggacagaggggacgggaggaagctgcctgagtcctaagtgggacttgagaatcggtcgaggccaggagtttgatgcctgcctacctggccccctgcccaggtgagctcaggctccaaaggaggtgaggagaagcacagatttaggcaatgatcactgggaggtaggtatgtcttctcacctgacttcccagttgggggacttttgtacctagcaggaagctggttcctggctggctttacccctttgtccgtggaagccagagtgcggtgagatagtttatggagcacttactatgtgccgggcacggatctgagcttccccggagcagcgtctcctccagtccacagggactccaggctcttgtgaaacacttatacacatttcacagatgtggcaagcaagactcctaggggatgctgccttcccaaactcctattcctagtgagttgccaagctgggattagaacccattctgggctgggcaggatgactcacgcctataatcccagcactttgggaggctgaggtgggcggatcatttgaggtcaggagttggagaacagcctggccaacatggtgaaaccccacctctactaaaaatataaaaattagccggacgtggtggcgggcacctgtattcccagatactctggaggctgaggcaggagaatcgcttgaacctgggagatggaggttacactgaactgagatcacgccactgcattccagcctgggcgacagagcaagactctgtctcaaaaaaaaaaaaaggccgggcatggtggctcacgcctgtaatcccagcattttcggaggccgaggcgggcggatcatgaggtcaggagatcgagacgatcctggctaacatggtgaaatcccatctctactaaaaatacaaacaattagccaggcgtggtggcgggcgcctgtggtcccagctactcgggaggctgaggcaggagaatggcgtgaaccggggaggcagagcttgcagtgagctgagatcgcgccactgcactccagcgtgggcgacagggcgagactccgtctcaaaaaaaaaaacaaaaaaaaaaaaatggaaagaacccaatctggactccagatctagtgcttgcaaaacatcatcattttgctgggttctgcttaggggacatcgaagcaaggccaccaggaggtggggcctcattcctctgggaaaagatgctcagactcaaggccacaggttcttaggctcacaccagaattccccaggaaagcagcccataagacaggcatgacctttagccccatgtttttttttttttgaaacggagtctccctctgtcacccgggctggagtgcagtggtgcgatctcgactcactgcaacctccacctcccaggttcaagcaattctcctgcctcagcctcctgtgtagctgggactacaggtgtcagccaaaatacacggctaatttttgtatttttagtagagatggggtttcaccatgttggtcaggctggtctcaaactcccgaccttaggtgatctgcccgcctcagcctcccaaagtgctgggattacaggcgtgagctaccatgcctggctttttcttttttctttgagatggagtcttcctctgtcacccaggctggagtgtagtggcgcagtcttggcttactgcaacctccgcctcccaggttgaagcaattcccctgcctcagtctcccaagtagctgggactacaggcgcccgccaccacacccgcacctaatttttgtatttttagtagagacagtgtttcagtatgttggccaggctgctcttgaactcctgacctcatgatccacccacctcagcctcccagcgtgctgggattacaggtgtgagccaccatgcccgaccctttagcctcatattacaggtaagatgaccgaggccagaggaggggaaggcgccttgctccagggagcatagcgtaggtggagctgggactcctggcttccccctgagaatctcttctgatgatggtgtcccagcttcatttcactagtccaggaaaagggagttgtggcttcatcccgcttacatagactcacctggggaaccccgtcctccccacacccctgacctggacttcatagctctgcggtgcaggcaggcatgttatctcactttttaaaaaaagcctaaattttggctgggtgcggtggctcacagctgtaatcctagcagtttgggaggccaaggtgggcagatcccttgagctcaggagttcaagaccaacctgggcaacatggcaaaaccccatctactaaaaaacaaacaaacaaaacaacaacaacaacaaaaaaaaaaacaaaccacggctgagtgcagtgactcatcctgtaatcccagcactttgggaggctgaggcgggtggatcacgaggtcaggtgttcaagaccagcctgaccaacatagtgaaaccccatctctactaaaaatacaaaaaattagccagacgtggtgcacacctgtaatcccagctactcaggaggctgaggcaggagaatcgcttgaacccagaaggcggaggttacagtgagccgaaatcacgccactgcaccccagcctggatgacagagcaagactccctgtccaaaaaaaaaaaacaaaaccacacacacacacacacacacacacacacacacacacacacacacacacacactagccaggtgtggtggtgcgtgcctgtagtcccagctacttgcagggtcaaggtgggagaattgcttgagcgtaggagacagaggttgcagtgagccaagatcgcaccactacactgcagcctgggcgacagagcggaaatccgtctcaagaaagagaagaaagtttgccctatttaacacattttatcccttgactagatctttgttcatgtcatgtcagttacatttagtcttttgtttgttttgttttgttttcttttttttttttttgagatggagtctcgctctgtcacccaggctggagtgcagtggtgcaataccaggtcactgcaacctccacctcctgggttcaagcgattctcctgcctcagcctcctgagtagctgggataactaaacatggaggcgtgcaccaccacgcctggctaatttttgtatttttagtagagacggggttttgccatgttggccaggctggtctccacctcctgacctcaggtgatcctcctgcctcggcctcccaaagtgctgggattagaggtgtgacccaccacatctggcccatgtgagttacatttaaatctcttttttttttttttttgagacagagtttcgctcctgttgcccaggctggagtgcagcggcgcgatctcggctcactgcaacttccgcttcccgggttcaagtaactctcctgcctcagcctcctgaatagctgggattacaggcattcgccaccatgcctggctaattttatatttttagtagagatggggtttctccatgttggtcaggctggtctcgaactcctgacctcaggtgatccacccgccttggcctcccaaagtgctgggattacaggcgtgagccaccgcacccggcctttaaatctcattctttagccactgcattgggatacacttatttttgtttttgtgttttgagacggagtctcactctgttgcccaggctggagtgcagtggcgcgatctcacctcactgcaacctccgcctcctgggttcaagcgattctcctgcctcagcctcctgagtagctgggattacaggcgcccaccatcatgcctggctaatgtttgtatttttagtagagacggggtttcactatgttggccaggctggactcgaactcctgacctcgtgttccacccacctcggcctcccaaagtgctgggattacaggcgtgagccactgtgtctggccacacttgttgttttcttattccccttttgctgggcatccaggttgtttccagtgtcatgttgtggccagtaagtccacacagctctgctcatgtggaaacacaggtgtgggttcttccccgaagtgaggtttctgggtcaaggggaagatggctcttggaacttgacagctattggcaaattgtcctctacagaggttttaggtcatacctggcttgctggagtacaggtgagccctgaagggactgttcccaagccttgcttcctgacgtgtgtcccagggaccagctgcatcaacactgcctgggagccttttagaaatgcagggtcagggccgggcatggtggctcactcctgtaatcccagaactttgggagtccaaggcaagaggattgtttgagaccaggaattcgagaccagcctgggcaacatagcaagataccattggccaggcacaatggctcacacctataatcccagcactttgggaggccgaggcgggcggatcacgaggtcaggagatcaagaccatcctggccaacatggtgaaaacccgtttctactaaaaaaatacaaaaaattggccaggtgtagtggcacacgcctgtagtcccagctactgggaaggctgaggcaggggaattgcttgaacgtgggaggtggaggttacagtgagccgagatcgtgccactgcactccagcctggcgacagagcaagactctgtctcaaaaaaaaaaaaaaaagataacatctctacccaaaaagaaaaaattaagtaggcgtggtggtgtgtgcctatagtcctagttacttgggaagctgaggcaggaggatcccttaagcccaggagttagaggctgcagtgagctgtgattgtaccactgtactccagcctgggtgacagagcaagaccctgtctttaatgagaaaaaaaaaaaagaaaggatcaggtgtggtggctcacacctgtaatcccagcactttgggaggccaaggtgggtggaacacaaggtcaggagttcaagactagccaggccaatatggtgaaaccccgtctctactaaaaatacaaaaattagctgggcgtggtggtgggtgcctgtaatccagctactcgggaggctaaggcaggagaattgcttgaaaccaggaggcggaggttgcagtgagcccaggttgccccactgcactccatcctgggcgacagagtgagactgtctccaaagaaaataaagaaaaaaaaaaagaaatagggggccaggtgagccccatcccgaagctttagaatcagcacttgctattgaacaaagtccagaggtcactcttgtgcctgctaaggactgaaagacacagctgtaagtcatgggcaggtgtgaaccctgtcttccagctgcagcgtgggcctggactttctcctggaaggtggggccaggcaggctgtacctgactgttcctctctcctcagcgtctgctgcagagaccatgtctgccgacggggcagaggctgatggcagcacccaggtgacagtggaagaaccggtacagcaggtgaggaagggccgggaccagggactgccccgaccctgtgattcccgtgcaaggaggcttcccaccccagggtgccctggcagggagccagggatctgccggcagctcacggagccagagggatttattcctcagtggggtatggaccactcactggtgtccccagttgggaggggggaatctcaaaggcccttggagggcctgagggagcagggttctgtctgaaactacctgccctccccaacccctgagccaaatcatcctcacctctgaaggctctctcagggacgtcctaggaggccagtttctattccagatctctcatcctcaggtgattttattttatgtatatatttttgagatggaaccttgctgtgtcgcccagcctggagtgcagtggtgacatcttggctcactgcaacctctgcctcctgggttcaagcaattctcctgcctcagcctcccaagtagctggggtaacaggcatgtgccaccacgcccggctaatttttgtatttttagtagagacggagtttcaccatgttggccaggctagtctcaaactcctgacccaaagtgacccacccgcctcggtctcccaaagtgctcggattacaggcgtgagccactgctcctggccccaaaaataattaaaatttaaaaatcaagtggtgcgctggctgtgacccatgggctgtggtctacagcccccggtttagaccctaactgccatgagaatggaactgttgtcccttatcaccacctggcacatcgctgggataaagtgcaggctcatgtaaatagcctgtgttcaaggaagcacgtgggctgagtgcggtggctcacgcctgtaatcccagcactttgggaggctgaggtgggcgaatcacgaggtcaggagttcaagaccagcctggccaacatggtgaaaccccatctctactaaaaatacaaaaaaattagctgggcgtggtggcacccgtaatcccagctactcaggaggatgaggcaggagaatcgtttgaacctgggaggtggaggttgcagtgagctgagatcgcatcagtgcactccagcccgggcaacagtgcaagactccgtttcaaaaataaaataaaaataaaggaagcacgtggcgaaaccccaaggttcctggcttgtgcaactgcctggatgcaaagtgtgggtaaactgagccgtttcactggccaggagtaagagcaaaactgcagggcaccctgagtttccggctgagctccccatcttcccccacccagtttgcctgagccacttctctcctgtagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagagtgggtgaagtcccagggggcactgaattcccctcctggtcatttccctgggtggggagtaggggggtctacccagctcttggtcctgtccccctgaaccattactaggtgaccttccagcagtcacatttgcgtcttaattgttgttggcagttgcatcagccagcgaatacgcccacagggggctggacaagttggaggagaacctccccatcctgcagcagcccacggagaaggtaacgatgtccgtcctcaggggctctgtcgagacagggacctacctgggtgtggagtgcgctggtcccagcttaactagacaagcttgatggcatcctccctgctgcctctcctgtcggttcccatccccaccccgaatccactccccacagggtagctggaggaataattgcaaagccagccagattacaggcgcctgcaaccatgcccatctagtttttgtatttttagtagagatggggtttcaccatgttggccgggctggtctcgaactcctgacctcaggtgatccagctgcctcagcctctcaaagtgctgggattataggaatgagccacggtgcccagcccacttgtttttataataaagttttattggcacacagccatgcccatttatttacatattgtctatgactgctttcaccctacaatggcaaggttgagtagttgtgacagagactgtgacccacagtactgaaaatcttagttacgtggccctttacacagaatgttgccacctccataacttattagtcagaaaaggttggcggcaggaaagtcaaaacatcaaaacaccatgttcctggccgggcgcggtggctcatgcctgtaatcccagcactttgggaggccaaggcgggaggatcacctgaggttgggagtttgagaccagcctgaccaacatggagaaaccccgtctctactaaaaatacaaaatttatctgggtgtggtagcgggtgcctgtaatcccagctactcgggaggctgaggcaggagaatttcttgaaccctggaggcggaggttgcagtgatccgagatcatgccattgcactctagcctgggcagcaagagtgaaactccatctcaaaaaaaaaaaaaaaaaccaaaaaaacaccatattctggccaggcgcggtggctcatgcctgtaatcccagtactttgggaggctgaggtgggcggatcacaaggtcaggagatcgagaccatcctggcaaacacagtgaaaccccatctctactaaaactacaaaaaaaaaaattagcttggcgtggtggcgtgtgcctgtagtcctagttactcgggaggctgaggcaagagaatcacttgaacccaggagacggaggttgcagtgagctgagatcgcgccactacactccagcctgggcgacagagcgagactctgtctcaaaaacaacaaaacaaaaaaaacaccatgttccaaactgtgtcctgcccctcagcagctgggtggccctcacacaagttactttgcctctgtgggcctcacttttttttttttttttttttttttgagacggggtcttgctctgttgccaggctggtgtgcagtggtgcaatctcggctcactgcaacctccacctccgggttccagcgattctcctgcctcaggctgctgagtagctggggttgcagacgtctgccaccacgcctagctaatttttgtatttttagtagagacggggtttcaccaagttggccaggatggtctcaatctcttgacctcgtgatcctcccgcctcggcctcccaaagtgctgggattacaggcatgagccactgtgcccggccccctctttttttttttaagatggagtttcgctcttgttgcccaggctggagtgcactggtgcagtttcagctcactgcaacctccacctcccaggttcaagcgattctcccgcctcagcctcccgagtggctgggattacagacatgtgccaccacacctggccaatttttgtatttttagtagagatggggttttaccatgttggtcaggctggtctcgagctcccgacctcaggtgatccacctgccttggcctcccaaagtgttgggattacagacatgagccaccaggcccagcctgggtcccactttcttttctacagaatggcaatgctgacctggggttaacacctgaaggcccagaacagcacatggcttgtagcaaatgttggctcttaacattaaaaaaaaaaattttttttttgagacaggttctcactctgtcacccagggtggggtgcagtagtgtgatcatggctcaactgcagccttgaactcctgggctcaagtgatcctcccatctcagcttcccaagtagctgggaccacaggcatgcaccaccatgcctggctatttttaattttttgtagagacgagttttcaccatgttgcccaggctgttctcagactcctgggctcaacagatcctcctgcctcagcctcctgagtagctgggactaggtgcatccaccacgcctggctaatttttgtactttttgtcaagacggagtctcgccatattgcccaggccggtctccaactcttgggctcaagcaatcctcctgcctcagccccacaaagtgctagaattataggagtgtgccactgtgccctacctcagtttcccttaatcaccgctttttaaagaccctgtctctaaatacagccacattcttacccctggggatcaggacttcaacataagaatttggggttgagggggccataattcaacctataacagcctgggatgaaaaaatgaggcacagaccaggcgtggtggctcacgccttactcccagcactttgggaggccgaagcgtgcagatcacttgagatcaggagtacgagaccagcctggccaacatggtgaaaccctgtgtctactaaaaattcaaaaatcagccaggcgtgatggtgagttcctataatctcagctactcgggaggctgaggcacgagtatcacttgaacctgggaggcaagaggttgcagtgagccgagatcgtgccaccacgctccagcctgggcaacagagcaaggctctgtctcaaaaaaaaaaaaaaaaacaccctccttcagataagtgtgaggcttaatcggttattgtttgtctccccagctgggaccagggcacaggctgcctgctttgtggctgtgtccagtgcccagcaggcagcctggcacagggtagatgcttatttttttagttttttgagacagagtgttgctcttgttgcccaggctggagtgcaatggtgcgatctcggctcactgcaacctccgcctctcgggctcaagcgattctcctgcctcagcctcccgagtagctgggattacaggcatgcaccaccatgcctgggtaattttatctttttagtagagatggggtttctccatgttggtcaggctggtctcgaactcccaacctcaggtgatctgcctgcctcggcctcccaaagtgctgggattacaggtgtgagccaccgcgccctgcagatagatgcttattaagtattcaggtgctccatgtccgcttcagcccagtggttacagaagggccaccctcgggtaccacctgcttgtgtctgggtctgtagcatcagaaataggtgatccctgggttggaggcaggacaagccagccgcatcccagcatccttggactttccctgagaccacctgcagggacaggcagcttattcatccacttgctattgagtgcctactgtatgccggggagctgtgctgtcccatcatggttagacttcctcacctcccatttatgcagaaatggccttagctgggaaacagcagagcggttgtcaacttgcattttttttttttttttgagacaaggtcttgctctgtagcccaagctagagtgcagtggcgtgatcttggctcactacagccttgacctcctagacttaggcaatcctcccagctctcagcctcctgagaagctgggactacaggtgtgcaccaccacacctgactaattttttaattttttgtaggaatggggtcttgctatattgcccaggctggtctcaaactcccaggctagccaggcacggtggctcacgcctgtaatcccagcactttgggaggccgaggcgggcggatcacgagatcagaacaacagagcgagactccatctcagaaacaaaacaaaaaacaaactcctgggctcaagcaatcctcctgcctgccttggcttcccaaagtgctgggattatagttgtgagccactatgcccagccatgcctacaccttatcagcaaaggccaatagtgggcttggctgaggggggatggaaactgctgagcttacaggaagatgggaaacgtcaaccaggagcccccgtctcagggccaagcccttgcttccctttctctcccactgatagcgtaggaggccaacagtctttctgtttatagaagggataagctcagggtgaattcttcaaggtcactgaacagagcagcagctgggagctttttttttttttttttttttttttcagatggagtctcgttctgttgcccaggctggaatgcagtggcgtgatctcagcccactgcaacctctgcctcctgggttcaagtgatcctcctgcctcagcctcccaagtagctgggattataggcgcccatcactacgcccagcaaatttttgtatttttagtagagatggggtttcaccatgttggccaggctggtctcgaactcctgacctcaggtgatccagctgccttggcctcccaaagtgctgggattataggcgtgagtcaccgtgcccggccaatttttgtattttttgtagaggtgaggtcttactatgttgcccaggctgttctcacacttctgggcccaagcgatcctcccacctcagcctcccaaagtgccgggatgacaggtgtgagccaccgtgcctggcctgctgtgagctcttgactttttgagaggtgcaatgctctctcaattctgggccctatgagttttttccccctttgtgaagaggtaactttccccaggttctgggggacggtggtgttgtcagagctagattttaatccgggccagtgtgagaacgtgcgtgttcactgagtagtggggctgttagaacctgactctcatcgggggcgttggctcatgctggctcacacagtgaaaccccgtctctactaaaaatacaaaaaattagccggccgtggcagtgcacgcctgtagtcccagctgctggggaggctgaggcaggagaaccgcttgaacctgggaggtggaggttgcggtgagccgagatagtgccactgcactccagcctgggtgacaagagcaaaaactctgtaaaaaaaaacaaaaacaaaaacaaaaaacttgactctcacaccctcttcccccacaaaaagatgaactctcatgagtacaagaggactgagtcttcagggaagcaccaacttgggtaggaatggggcaggtgtggttttcaactttgcggagagccctctgcatagagatctgtctaaagacttagcttcagctggacacagtggctcatgtcggtcatcccagcactttgggaggccaaagcaggaggactgcttgaggccaggagttcgaaaccagcctgggcaacatggagagtccttgtctctacaaaaaataaaaaaataagccgggtgtggtggtgcgtacctgtagtctcagctacttgggaggctgaggtgggaggatcgctggagccgaagaggtcaaggcttgagtaagctatgattgcaccactgcactccagcctgagtgacacagtgagaccctgtctcaaaagaaaaaaaaaaaaaagacttagattcgagaacagcaggtattgacagatgagcgctcaccatgtgctgggtggggcgtagtcaaaggattccatgcaaagcttttttttgtttgtttgtttttgtttttttttggagacagagtctctctctgtcacccagggtggagtgcagtggtgcagtctcggctcactgcaaactccacctcccgggttcaagggattctcccgcctcagcctcttgagtagtaaggattacagacatgcaccactgcacccggctaattttttgtattttttgtctctacaaaaaataaaaaataaggctgggcgcagtggctcatgcttgtaatcccagcactttgggaggcccaggcaagtggatcccctgatgtcaggagttcaagaccagcctggccaacatggtgaaacccgtctctactaaaaatacaaaaatcggctcggcatggtggcatgtgcttgtaatcccagctacttgggaggctgaggcaggagaatcacctgaacccacgtggcagaggttgcagtgaatcgagattgcaccattgcactctagcctgggcaacaagagtgaaactccgcctcaaaaaaattaataaataaataaaaataaaagataaaaaatagccacgagtggtggtacgtgcctgtggtcacagctactcgctggggaagctgaggtgggaggctcacttgagcccaggaggtggagtttgtagtgagccgagattgtgccaccgcactccacctgggtgacagagggagactccatctcaaaagaaaaaaaattaaattgaaaaaaaaaaacaaaaaacaggcagagtgcagtggctcatgcctgtaatcctagcactttgggaggctgaggtgggcggatcactaggtcaggagtttgagaccagcctgaccaacatggtgaaaccccatctctactaaaaatacaaaattagcctggcgtggtggcgcatgcctgtaatcccagctactcgggaggctgaggcaggagaatcgcttgaacccaggaggcggaggttacagtgagccgagatcacacaattgcactccagcctgggcaacgagagtgaaactccatctcaacaacagcaacaacaaaaaacaattagccaggcatggtggcgggcacctgtaatcccagctgcttcggaggctgaggcaggagaactgcttgaacccgggagacagaggttgcagtgatctgagatggtgtcactgcactccagcctgggcaagagagcaagaccctgtctccaaaaaaaaaaaagaaagaaagaaatgaggtacagggaggtagagtgactttcctgaagccacacagctgagaagtagctagctaggaacggagcctaggtagtctggctgcagagtatgaggtcatgcccacaactccagactcagggtcacctgggggatggcgctccctgcctcagtctccctggaagttggggtgcaggggaggggtgcccacatacagagggaagacggagatgctggggtcacccgggggatggcgctccccgcctcggtctccctggaagttggggtgcaggggaggggtgcccagatatggagggaaggcagagatgctgatgctgttgcatctcctaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactgggtaagtgtggccagcgggctgctctgggacccctccccaggccccctgaccggaagccgctgtcggcctcctggggtctgtgccgacactcactgccgcctcgtccctgccacttctcccgggcatcttggaatctcatcactaacgcagtcccctctgtcctgctcaccagctcccgccctcatccaccacagtctcctccccacagcagccaccagagggcgcctgtgaccacctgagtcagaacccgtccctctgcccacagccctccatggaccccacctcccctggggtcaaagcccaagtcctcgtcacagcccacaaggtcctgcacaacctcccctgtcctctccccgccctcctcctcttcccccttcgccactccgctcctgcataaatacgtgactaaacttgagatctcactgaactgtgacaacaatgctggtgttcccgccaggccagacatcccactccagtcatctcggtcacatattcgcactccctgcactgtttatttgatattcttctttaattaatttatttatttatttagagacagagtctcgccctgtcacctaggctggagtgcaatggcgtgatctcagctcactgcaacctctgcctcctgggttcaagcgagtctcctgcctcatcctcctgagtagctgggattacaggcacctgccaccacacagctaattttttgtatttttagtagaaacggggtttcactatgttggccaggctggtctcgaactcctgaccttgtgatctgcccacctcggcctccccaagtactgggattacaggtgtgagccaccatgcccggcccttttttatttatttgttttagagatagagtctcactctcttgcccaggctgaagtgcagtggtgcgatcatagctcaatgcagcctccaactcctgggttgaggcgagcctcccatctcagcctccgagtagctgggactacaagcacacaccatcacgcccaactaatttttctttatttaatttttggtaaagacggggtctccctctgtcatcccagctgatccagaactccttggctggagtgatcctactgctttagccccccaaagtgcggggattgggatttttgcaaataagtagcttaggatataggcagggcgcggtggctcagcctgtaatcccagcactttggtgggccgaggtgggcagatcacctgaagtcaagagtttgagacaagcctggccaacatggtgaaacccggtctctactaaaaatacaaaaattaggccgggcacggtgggtcacgcctgtaatcccagcactttgggaggccaaggccgggcggatcacaggttcaggagatcgagaccatcctggctaacacagtgaaaccccatctctactaaaaaaaaaaaaaaaaaaaaaaaaaaaattagccgggcgtggtggcgggtgcctgtagtcccagctactcgggagactgaggcaggagaatggcatgaacctgggaggcggagcttgcagtgagccgagatcatgccactccactccagcctgggcaatagagctagacgccgtctcaaaaaaataataataataaaataaacattagccaggtgcggtggcaggcgtctgtaatcccagctacttgggaggcagaggttgcagtgagccaagattgggccgctgcactccagcctgggcgacagagtgagactccatctcaaaaaaaaaaaagcatgggtacagtaggagcaggattaaataaatacatgcagctgggcgcagtggctcatggctgtaatcccagtactttgggaggctgaggcgggtggaggttgaggtcgggagttcgagacaagcctgaccaacataaagaaaccctatctctactaaaaatacaaaattagccaggcatggtggcgcatccctgtaatcccagctaactcgggaggctgaggcaagagaatggcttgaatctgggaggcagagcttgtggtgagccaagactgcgccattgcactccagcccaggcaacaagagtgaaactccatctcaaaaaaaataaaggccaggtgtggtgactcatgcctgtaatcccagcactttcggaggctgaggcagctggatcacatggtcaggagtttgagaccagcctggccaacatggtgaaaccccatctctactaaaaatacaaaaattagccaagcatggtggcacattcctgtaatcccagctactcaggaggctaaggcaggagaatcacttgaacccgggaggcggaggttgcagtgagccgagatcatgccattgcactccagcctgggcaacagagtgagactctgtctcaaaaaaataaataaataaataaataagtaaataaatacatgcatatacacatatgaacctacgaacatgggatgaggccaggcgtggtggctcacacctgtcatcccagcactttggtgggaggattagttaagcccagtagttccagaccagcctggacaacatagaccccatctctacaaaaaatttaaaaattagctgggtgtgctagtgcacgcctgtagtcccagttgctatttgggagctgagacaggaggatcacttgagcctgggagttcaaggctacagtgagctatgattgcaccgctgcactccagcctgggcaacagagcgagactgtacttcaaaatataaaaaccgacaaaacaaacagatctaaacatagaaaaggtacaggaagccaggtgcaatggctcacacctgtaaacctagcactttgggagtctgaggcgagcagattgcttgagtccaggatttcaagaccagcctgggcaacatagtgagaccccattcctacaaaaagtacaaaaattagccaggtgtcttgccgtagtcccagctttatgtagtcccagctactcgggaggccaaggttgaaggatagcttgaagctgggaggttgagcctgcagtaagctgaggtcgtgccactgtactccagcctgggcaacagaccgagaccctgtctaaaaaaaagaagaaaaagtacaggaaaaatacggtatatatggtattataatcttatgggaccactgtagtatatgcagtccattgttggctgaaatgtcattattctcttttttttttgagacggagtctcactctcacccaggctggagtgcagtggtgtgatcttggctcactgcagcctccacctcccgggttcaagcgattctcctgcctcagcctcctaagtagctgagattacaggctagtgccatcacgcctggctaatttttgtatttttagtagagatggggtagtgccatgttggccaggctagtcttgaactcctgacctcaagtgatctgcccgccttggcctcccaaagggctggcattactggcatgagccactgcacccggcctacggtattataatcttatgggacctctgtagtatatgtgatgtattgctggctggaatgctgttattctctgcaggactgcataatgaacattcaggcctatattcacaggttgtccaaggcaggtctggcctgcaggccatagcttgagaccctcctgctagtctaaggtctctgattcctgtgaggtttaattttccttatccccgttttgcagatagggaaaaccaaggcagaatcctttgctcccaggccttcgaggtttataagaagtagaactgggttataaactggacagcatggccaggtgtggtggctcacgcctataatcacagcacttttggaggccagttcggatgaatcactggagatcaggagttcgagaccagcctggccaacatggtgaaaccccgtctctactaaaaatacaaaaattagctgggcatggtggcgggcgcctgtaatctcagttactcgggaggctgaggcaggataatcacttgaacccgggaggcagaggttgcagtgagccgagatgacaccactgcactccaacctgggcgacagagcgagactccatctctaaataaataaataaataaactggacagtgtgattcttgggactgtctgcatgggacgagcccagctgtgtgttctggtcttcacagagacccttctccttttccttgcagcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctggtgaggttccagggggtcggggccctgagccagcagccttcaccccgcagcagacacccacccagagctcagtggcttattgctcacccctctgcaggctggcagggccattcccgcttgctcctggcactgtatctggttgtacactcatttgctcaggatgctgccacaaaccacactgtctggggccgggcacagtggctcacacctctttgtgtgagtccctcaagtgctttgggagcccaaggcaggaggatcgcatgagtccaggggtttgagacccacctgggcaatatagcaagaccccatctctacaaaaaataatttaaaacaattagctggctgtggtggtgcgtgcctgtaatctcagctacttgggaggctgaggtgggacgattgcttgagcccaggagttggaggctgcagtgagctatgattgtgccactgcactgcagcctagtcaacagagcaagaccccatctcaaaaaaaaaaaaaaaatcgtggccaggtgcggtggctcatgcctgtaatcccagcactttgggaggctgaggcgggtggatcacgaggtcaggagttcaagaccagcctggccaacatggtgaaaccccatctctactaaaaatacaaaaattagccaggtacaatggcaggcacctgtaatcccagctactcaggaggctgaggcaggagaatcgcttgaacccgggcggcagagattgcagtgagccgagatcatgctactgctctccagcctgggtgacaagagtgagactccatctcaaaaaaaaaaaaaaaaaattcgtactgtctgggaaatgtaaacaacagatatttattttctcacatttctggaggctggaagtccaagatcagagtgtccttctggggcctctctccttgactcgtagacagccatcttctctctgtgtattcacgtggtcgtcccttccctctgtgtatgtctgtgtcctaatctcttttttttctttgaacggagtctcgctctgttgcccaggcgggagtgtagtggtgcaatctcagatcactgcaacctccacttcccgggttcaagtgattcttgggcctccacgtcccgagtagctgggatcacaggcacttgccaccatgcctggctaatttttgtatttttagtagagatggggtttcactatgttggccgggctggtctcaaactcctgacctcaagtgatccacccacctcagcctcccaaagtgctgggattacagacacgagccaccacgcacagctctaatctccttattgaaggagaccagccctttatggattggagcccaccctaatggatagcttcatttacctttatgacgatttttttttttttttttccagagacaggggctcactctgttgcccaggctggagtggatgatcatggctcactgcagcctcttaggtgcacccatcttggagcatatgtctgccatcattcctctttatttatttttcttttctttttgtggcgcgatctcagctcactgcaagctccgcctcctgggttcatgccattctcctgcctcagccttctggtagctgggactacaggcgccggccaccatgcctggctaattttcttttctatttttagtagagatggggtttcacagtgttagccaggatggtcttgatctcctgacctcttgatccgcccgcctcggcctcccaaagtgctggaattacaggcgtgagccaccgcgcccggcctttttttttttttttttgagacggagtctcgctctgtcacccaggctggagtgcagtggcatgcagtctctgctcactgcaagctctgcctccttggttcacaccattctcttgcctcagcctcccgagtagctgggactacaggcgcccaccaccacgctgggctaattttttgtatttttagtagagatggggtttcaccgtgttagccaggatggtctcgatctcctcacctcgtgatccacccgcctcggcctcccaaagtgctgggattacaggtgtgagccactgcgctcggccgactatttttcttttctcttaaactttatgtaatatgtagagatgagatgtcactgtgttgcctatgctgttctggagctactgagctcaactgatccaacccccttggcctcccaaagcgctgggattgcagaagtcagcctgcttcgttcctttggaaggctgagtcatatttcattacaagcacttttttttgttttttgttttttgttgttttgagatagagtctggctctgtcacccaggctggagtgcagtggcgcaatctcagctcactgcaacctccgcctcccaggttcaagcgattctcgtgcctcagcctcctgagtagctgggactacagatgtgcaccaccacacctggctaatttttgtatttttagtagagacggggtttcaccatgttggttaggctggtctcgaactcctgaactcaggtgatccacccacctcaacctcccaaagtgctgggattacaggtgtgagccaccatgcccagcctacaagcactttttaagcctttgctggttccatctgctcatgtcccattggccaaagccagccacgtgtccaggctcccttgcaagcgcaggagaaattgacacaatgggaagagctacaggggatgtgcagcccttctttgcaccaaccacacagagcctgagtatgtcaatgattaaaccaaaggccccagagctcaccgtagccaggaaacccttcctccctccctccctttctcttttctagactgtcatgtaagtcagatgctggaaggattccttgggttccttctggaatcccgtctctcccaggggagcctccttccctcacttctctctcccctgccccagatggaaactgtcaagcaaggcgttgatcagaagctggtggaaggccaggagaagctgcaccagatgtggctcagctggaaccagaagcagctccagggccccgagaaggagccgcccaagccagaggtacccatgaggggactggggggtggcctagggtacttggagtcccgatgccactctctacacctctgcttcatgggcctacctgcttcgaatgatttccctagcctcacctgcttttggaagctaatgacacctccttcaggaagcctgccttgatttctcctcttgggcatgcataggtatggcttctgttttttgttttgagatggagtgttgctctgtcacccaggctggagtacaatggcatgatcttggctcactgcaacctccacctcctgggttcgagtgattctcctgcctcagcctccctagtagctgggattacaggcgctcaccaccacgcctggctaatttttttgtatttttagtagagacagggtttcaccatgttggccaggctggtcttgaactcctgacctcaagtgatccgccctgcccagcctcccaaagtgttgggattacaagcgtgagctactgagcccggcccctagcagcaacttctgactagtattctccggccccctccactctatctcaagccttggcctcttgtgttctctaatgggtctcgctgcctgtcccaccacccacttaagctccccaggggcaaaggaagtttgcagtgagccgagatcgcaccactgcactccagcctgggcaacagaaggagattctgtctcaaaaaacagaaaatgtcctgaaattagatgaaggtagtatttgcccaaccttgtgaatgtattaaaaaccaatgaatcgtacacttcaaagggcgagttttagggtgtgtggattatatatcaatttttgaaatagttgtttatttatctttgagacagggtctcactctgttgccctggctggagtgcagtgatgccatcacaggtcactgtggcctcgccattgcaggctcaggcaatcctctcgcctcagcctcccaagtagctgggaacacaggcgtgtgccacgatgcctggctaattttttttttaatttttagtagagacaggatctcactgtgttgcccaggctggtcttgagctcctggtgtcaagcaatactcccacttcagccttccaaagcactgggattacaggcatgagccaccacacccgaccccagatcaattatttatttatttatttatttatttattttttgagatggagtctcgctctgtcacccaggctggagtgcagtggtgtaatctcagctcactaccagctctgcctcccaggttcacgccattctcctgcctcagcctcccgagtatctgggactacaggcgcccgccaccaggcccagctaattttttttgtatttttagtagagacgcgatttcaccgtgttacccgggatggtcttgatctgctgaccttgtgatccgcccgcctcggcctcccaaagtgctgggattacaggcgtgagccaccgcaccctgcctatttatttatttattgctctgttgcccaggctggagtgcagtggcacaatctcagctcactgcaacctctgcctcctgggttcaagtggttctcctgtctccacctccccagtagatgggattacaggcatgcgtcaccacgcccggctaatttttgtactttttagtagacacggggtttcgccatgttggccaggctggtctcaaactcctgaccgcaggtgatccgcccacatcggcctcccaaagtgctggtattacaggcgtgagccaccgtgcccggacccagatcgattttttaaaaactgaaatgagatcatatcaaaagcacatagtaagggctacaaaagtgacatgcataaagatatggtgaatatctctataaatgcaaattgttcgggaggcagaactagaccacctgctgcctaaaactgtctcctgtttccccgactgctaagcacagcagccagaatgacttttcaaatgaaaaaaccagatcttatctctctcacgtgggcactctcccgtaatccctcgctcaagtccagagtcctccagctgccagggctctgggcaaaaccctacctcccagtgtgtgccttttttttttttttttttttttttgagatagagtctcactctgtcaccctggctggagtgcaatgtcatgatctcggctcactgcaacctctgcctcccgggttcaagcgattctcctgcctcagcctcccgagtagctgagactacaggcacctgccaccacgcccagctaatttgatttatttatttatttttgagacagagtctcactccgtcacccaagctggagtgcagtggcgtgatcttgactcactgcagcctccacctcctgggttcaagcaattttcctgcctcagtctcccaagtagctgggattacaggcgcctgcaaccacacccagctaatttttttgtatttttagtagagacagggttctgtcatgtttgccaggctggtctagaactcctaacctcaagttatccacccgtcttggccccccaaagtgctgggattacaggcctgacccactgcgcccggcctaatttttgtatttttagtagagatggggtctcaccatgttggccaggctggtctcgaaccctgtctgtgctcatctcactctctggccaaggaaattttcaaggacctgatttcaactatgttctccccggatggtttacaacttctgcctagaaagttcttccaggctgtcccagcctggcttccactttttgttttttaacagcttttttttttcttttttttttttttttttttttgagatggagtctcgctctgtcgcccaggctggagtgcagtgacgcgatttcggctcactgcaagctccgcctcccggattcacgccattctcctgcctcagcctcctaagtaactaggactacaggctcccgccaccatgcccagctaatttttttgtgtttttttagtagagatggggtttcaccatgttagccaggatggtcccgatcgtcctgacctcatgatccaccctcctcggcctcccaaagtgctggggattacaggggtgagccaccgcacccagccttttttttttttttaacagttttattgagatctcatttgcataccatacaagtcacgcatttaaagcatacacatcgctggttctcagcattgtgcaactatccctatctcatctcatgcccctaaaaagaaacccttttcccatcagcagtcactgccccatttcctcctcctcccaaccacgtatcccctcctgtctctggatgggcctgtcctggacatttcatagaaatgggatcacaccctgtttggccttttgtgtccggcttctcgcgctgagcgtgacgtccttagggctcacccatgctgtggcctgggtcagagccccatgacgttccatggctgagtcacattctgttgtatgggtggatcacattctgttcacccatttatcaaccgaaggacacttgagtcgtttctactttttgctgtgcccctgtgtgcatgtctttgtgtgtggacgtatgtttccgtttctcttgtgcacacacccacaactagaattgccgagtcatatgatgattctatggtttaacattttgagtaaccgctagactgttttccaaagtaactataccaccagcaatacacgaggcttccaatttctccgcctcttgactgacagtgggtatcatctgatagcctctggggtttttgtttgtttgtttgtttttgagacagagtctcgctctgttgcccaggctggagtgcaatggcatgatcttggctcactgcaacctccgcctcctgggtgcaagcagttcttctgcctcagcttcctgtgtagctgggattataggcacatgccaccacacccggctaattttgtatctttagtagaaatgcgggtttcgccatgttggtcaggctgaactcctgacctcggtgatccacgcaccttggcctcccaaagtgctgggattacaggcatgagccaccatgccaggcctccttatggttttgatttgcatttcctcaatgacttataaggtcaaacagcttttcatgtgctctccctatatcttctttggtgatttgtctatgccctttaaagaatttgactagtggccaaatgcagtggctcgtgcctgtaattccagcattttgggaggctgaagtgggcaggtcacttgggcccaggagtttaagacctgggcaacttagtgagatcctggctctacagaaaattttaaaaatgtagctgggcgtggtagtgagtgcctgtagtcaggcaggctgaaatgagaggataacttgagctcaggagttacaggctgtagtaagctatgatcacgccactgcactccagcctgggcgacaaagtgagatcctgtttctaattaaaagaaaagagtctgggcgcggtggttcatgcctgtaatctcagtactttgggaggccaaggagggccgatcacttgaggtagagttcaagaccagcctggccaacatggtgaaaccccatctgtactaaaaatgcaaaagttagacgggcgtggtggcacgcgcctgtagtcctagctattcgggaggctgaggtaggagaatcgcttgaacctgggaggcggaggttgcagtgagccaaaatcatgccactgcacgccaacctgggcaacagagcaagactctatctcaaaaaaaaaaaaaaaaaaaagggccgggcacggtggctcacgcttgtaatcccagcattttgggaggccaaggcaggcggatcacgaggtcaggagatcaagaccatcctggctaacacggtgaaaccccgtctctactaaaaatacaaaaaattagcctggcgtggtggtgggcgcctgtagtcccagctactcgggaggctgaggcaggagaatggcgcgaacctgagaggcggagcttgcagtgagttgagattgtgccactgcactccagcctgggcgacagggcgagactccgtctcaaaaaaaaaaaaaaaagtttcgcctatggaaagcgtttgccccaaggtcagtggtagaacccctcttcccctctttccctggcttcagctccgatcgcctttcctgaaacaaatggtcctgattggtgtccccatctcccttctcagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggc

SEQ ID NO: 36085 - DNA, 173354 bp, Homo sapiens
atggggcagcagcctggaaaagtacttggggaccaaagaaggccaagcttgcctgccctgcattttatcaaaggagcagggaagaaggaatcatcgaggcatgggggtccacactgcaatgtttttgtggaacatggtgagtgcttttcaaaatttctgctcatggttttcctcatgcattcatcttaggccttcaaggaactttgaacaacagtacttgcgacagttccttccaattccacttaataaatttgttactgtagttatctcttagtggaactttctttgtataagaaaaagttacttcgtgacttcggctttattcaaaatctatttgagttgcttatttcttgcctgattcctctgctaattcactgttgaccttggacaagccactttactgttccagggctttagtttcctgaggggctggacttcagtggtttcttagggtccctggttctatgattctgctctaaccgaagtcgtgggctcttctgacaagcatggattctttactgctttgtctacagagagcttttatcatattctcaaagtggtttgtgttcctgagaaagttaagaatcatagatactggttgacgctaatatccttgaccttttccttcgtaagtaggacttgaaaatactcactttggagccatgtgggaaaaatcaagtggggaagcagcattccttgtgaattttagatagacagcttctgtcttaccttccataaggagtaatctcttcctcgttgatgaagctttcatcctgtcttctccctgtttagaatgatatttgggccaataaaggttatctgtgacatttttatgaacatatttggcatttgaatgctgcccgtacattttatgttgttcatgtccagtaattctgtgcgaagttaaagctaagggtcggcttacactgatgtctataaccagttaattagggttactgtttgtactgttgcagcctgacattttttggattgtgtcctttatattaaaaaatcagttgagcccacctatcctataagcaaacgtatgaagtgtgccagtggcttatactttgaaattcattcagaaataccccaacattgggtgactgcagtcaacaaaggcttctgttggatgaacttgcatttgacagctgaagttttactttcttacgggaaaatattcacttcatctaaataaatccgggtgcttggattttactttgccttgaaacattagttctattttagctttgtttttaggcaggcaaatatggtaatgtgttgttatgatggttcccaaattcaggatttaaaaagtgaattatttacattttaactagtgatgatcatgcaccttacatagtgaaaattggaacagactttttggagagctttggcggaacttatcagaatttgaaatgtacgtgccaatgacccagtaatcccattctgggaagctagtagagaaagcagtgtagttccctgtgtgtccctgatatctcttcaggggttgagaggctaaaactattttcttgttaatagagtaccaaggtcttgtctcttttgctgtgttgacgtttgcagtaatggtacaaaagtaaagcaggtgtcttagcatgattcagggttgtggcacctaactatacttgtagtcattgcattcttcatgacgtgcactcacagttaaacaaactaaatatatatatacacacacacacacacatatatatccacttttcactgaaaaatgtccttttttttttttttttttttttttttttttttgagtcagagtctctgtgtgtcacccaggctggagtgcaggagtgcagtgtggcgatctcggctcactgtaacttctgcctcctgggttcaagcgattctcctgcctcagcctcccaagtaggtgggactacaggcacgcgtcactgacgcccggctaatttttgtattttttagtagagacggggtttcgccatgttggccaggctggtcctgaactcttgacctcaggtgatccacccaccttggcctcccaaagtgctgggattacaggagtgagccactgcgcctggctagttttcactggacaataccttgatgaagcagcaaaaattattaattttattacattttgacccttgtgtatgtcttcttaatattctgtgggttaaaaaggggggtatgcatcaagcacttctgtacagtaaagtataatgattatctccaggaaaagcactttggtggttgggttgcaaactgaactagccacttttttcatggactgccatttttacttgaaactatgacaaactatggttattcagactaaaaagtgtatgaaggaatctttcaaagaaaacaacaggtagcatttgttgccaatgatgaaattttagctttccagtgaaaattaggattttggagaattttttttttttcctcttcggggtagagtttcgctcttgtcgcccgggctggagtgctgtggtgcaatctcggctcactgcaacctctgcctcccgggttcaagcgattctcctgcctcagcctcccaagtagctgggattacaggtgtgcaccaccatgcctggctaatggagaatttttatctgcctctgtgatatagagattggtggtaatatttacagatgccatattttaatatcttataatgaaatgtattatttggaagatctacataaatcagtaaatcaatattttcttttttgttcgtttttgcgacagagtcttgctgtgttgtctaggctggagtgtagtggcatgatctcggctcactacaacctccacctcccaggtttaagcaattctcgtgcctcagcctcctgagtagctgggattacaggcatgcaccaccacaagtgaataatttttgtatttttagtagagatggagtttcaccatgttagccaggctggtcttgaactcctgacttcaaatgatctggccacctcagcctcccaaaatgctgggattacaggtgtgagccaccgtgcccagccaaaccattattttctaaatgatcaatgcatgatataaaatcatgcacaggttaaagatccattcaaagtgcaaaatggaggccaggtgctgtggctcgtgcttgtaatcccagcactttgggaggccgaggcaggtggatcacctgaggtcaggagttcgaacccagctgtgcaatctagtgagatcttacctctacagaaatttaaaaaattagccaagctcccactggagccaaagagtcgaggctgcggtgagccatgaacacagcactgcattccaatttgggcaatagagggagaccgtgtctctggggggtaaaaaaaaaaaaaaatacagttcattggtagagtttcttaaaggcagccagcctttaagaaattcctggctaggccgggcacagtggctcacgcctgtaatcccagcactttgggaggccgaagtgggcagatcacctgaggtcgggagttcaggaccagcctgactaacatggagaaaccctgtctctaccaaaagtaaaaaattagccgggcgtggtggcacatgcctctaatcccagctactcaggaggctgaggcaggagaattgcttgaaccccggagcggaggttgcattgagacgagatcacgccattgcactccagcctgggcaacaagagcgaaactcttgtctcaaaaaaaaaaaaagaaattcctggctgggtgtggtggctcacgcctgtaatccgagcactttgggaggatgaggcaggcggatcacttgaggtcagtagttcgaaactggcctggccaacgtgatgaaaccccgtctgtactaaaaatacaaaaattagatgggcgtggtggcatgcacctgtaatctcagctactcaggaggctgaggcaggagaatatcttgagccccgggggaagaggttgcagtgacctgagatcgcaccactgcacttcagcctgggtaacagaatgagactctgtctcaaaaaaaaaaaaaaaaaaaagaaactaccatttaccatgttttgatgtagcatcaaagaacaatatctacggttatctagaaagtctgttttggggggagaaaacagttattttccagtaataaaaatatttgtttttaaatgaataattatgtttttaaatttcagtattcatttctaatgtggtaactattgatgagataacctacacaaactaagcctcttaggggccttcggttatttttcaagagtgtgacaagggcctgagattaaaaagtttgaggccaggcactgtggcttatgcctgtaatttcacactttgggaggccaaaggcaggtggattgcttgagcccaggagttcaagatcatcctgggcaacataagaagaccctgtctctacaacaagaacaaaagaaattagccagacgtgttatcacacctgtgttcccagctacttgagtggctgaggtgggagggtcacttgagctcgggaggccaatgctgcagtgagccatgatcacgccactgcactgcagcctgggtaacagagcaagaccccatctcaaaacaaagtttgagaactgttgctatggaaagtctatcaagaaggcacatagggatgtttgttgctgaagtactaacactgaatgatgtctgtgttgtggtgagtagaaaaaaagcaatttgaaaatcattatttatggtatggccccatttttgtaaaacaaaaatatctgtttatttgtgtatgtccaggaaaaaaaagtatggaaggattttacaccgaaatttttatctctagggacttggagctttaggtggaatcggagaaaactttctctttttggtttgtgtgatgttccaagtgtctttttacaacaaacttgggttatcttataatacgaaaaattcgaagatttaaaaactgaggccaggcacggtggctcatgcctataatcccagcactttgggaggttgacacatgtggatcacctgaggtcaggagtttgagaccagcttgaccaagaaggtaaaaccctgtctctactaaaaatacaaaaattagctgggcgtggttgcaggtgcctgtagtcccagctactcgggaggctgagacaggagagttgcttagacccaggaggtcgaggttgcaacgagctgagattgcacgccactgcactcccagcctgggcgacggagtgagactccatctcaaaataaataaataaataaaaataaaaactgaattgatgacagcccaacctgtcacttttttcagatccctttttatgaaagaatttgcttaagttgtgtctgaagacaaaccaatttctttggaccctgggtattctttttctaagggaataccatgttattttgtgttacagattgtttgcgatctttcataggctgatctttctagagttggttaatatccatgtaggttagattgaaaaacttgaattcagaaatgtacggtgttggagcagacatggatctggaagccaagaatagcgttggtgttgttgttgatggtgaatctgaaagagtgggcagatggcaactttttgccagaatcattcagggtcaaagggctagtcatatttacaagggaaaagaggaaaccatgttattaaatatttcatgcaccatatgttcctttcaaatttcagtggcttgactaagaaaattcacttttgggagagttggtacaacaattgaaagcacttagtagtcaactttttccttagtgtttccttcttccttcaacaaacatttattttattgagcacagactatgacaggtcgtgttgtagtcactgatgatatatttgtaaacaaaacaatccctgccctcctagaacttacattctagtgggaggagacacatcataaataagctaagtaaataaaatacagatatgttagtgatatgtgctgaggagaagaataacatagagaaggggacagggaatggggtaggaggtgtaattttagttagggtggctagagaggcctgactgagagggcggcatttgattaaagacccgaaggaggaagatgagcagcaggccctgttgaaatatgtgaaagaatttcaggccgagggaaccaggatgcagaaacctgaggcagagcttgctagtttcaaggagcagcctagaggccactgcaccagagcaaagagcaaaaggagagatgcaggaggtaaaatggagggtgggaagagaatggctgaaggagagggtggccttattggcccatttcaaggattttgactttgattcatatgatgtgggaaggccttggagaattttccgaggggactatactatctgatgtatgtttcagtatgaaatagaatctctctggctgctatgatctgaaggaggacaagggagcagggattccacgggggcattgattgcacagagccaggtaagagtgatgatgcttggaccaaagtggtggcactgggtggagggtcagaaccgacaagatttgctctcggattagatgtgggatatgggggtgtgagaggggccaagtgtgactctcaggttttcgaactgaataactggaagaatagagttgccttttattgaaatgaaggtcgaggctgcagtggtaagctgtgattgcgccactgcactccagcctgggcaacagagcaagaccctgtctcaaaaaaaaaaaaaatatttaccatcaggtaaaaccacttatggttctcaaaactttatttaaaataatagacacttgataaatcaacactgtaggccgggcgctgtgactcacgcctgtcatcccagcactttaggaggccaaggcgggcggatcacttgaggtcaggagttcgagaccaccctggccaacatggtgaaacctcgtctctactaaaaatacaaaaattagtcggcatggtggcacacacctatagtcccacctacatgggaggctgaggcagagggatcacgtgaacctgggaagcagaggttgcagtgagccaagatcatgccaccgcactccagcctgggtgacagagcaaggctctgtctcaaaaaaacaaaacaaacactaattctcattactcttaaaattatactaaggccaggtgcggtggctcatgcctgtaatcccagcactttgggaggccaaggcagatggatcacttgagcccaggaattcaagaccagcctgggcaacatggcgaaaccccatctctactaacagtacaaaaaattagctgggcgtggtggtacacgcctgtaatcccagctactcaagaggctaaagtgggagaatcacctgcgcctgggaagccaaggctgcagtgagctgtgatggtgctattgcactccaatctgggtgacagagtgagaccctgtctcaaaataaaataaaataaaattatactaagtatctgtatacattagaaggtgggaggaagtgcaattattggatcctataggcattaaagttaaatttgtcaggtttttttttgtttttttttttttttttgagacagagccttgctctgttgcccagactggagtgcagtggcacaatctcagctcattgcaacctccacctcccgagttcaagcgattctctttcctgcctcagcctaattttttgtatttttattagagacggggtttcaccctgttagccaggatggttttgatctcgtgacctcatgatctacctggctcgacctcccaaagtgctgggatttcaggcgtgagccaccgtgcctggctatccgattctcaaagaggttatttggacaggctgggcgtggtggctcacgcctgtaatcccagcactttgggaggctgaggcgggtggatcacctgaagtcaggagttcgagaccagcctgaccaacatggtgaaaccccatctctactaaaaatacaaaaattagcagggcatggtggcatatgcctgtaatcccagctactcaggaggctgaggcaggagaatcgcttgaacctgggaggcagagattgcagtgagccaagatcacaccactgcactccagcctgggcaacagagcgagactccatctcaaaaaaaaataaaaaggttatttggaaagattatatccatctacttaatgctagggattggattgtggcacgtggactgtgaaaatgcaaaattggaggtatgtactttattttagagacagggtcttgctttgtcacccaggctggagtgtagtggcacagtcatagctcactgcagccttgaactcctgggctccagtgatcctcttgccttagcctcccaaagcaatgggatcgtacaggtgagccattgcacctggccatgtatgtacattttttataagcattcagttgtttccaatagtctaatacattttgtatggccttcttatttttcatgaaaccttactacccattttaagaaatttgtaatatagaagaaaacagaagtttcaattgtggggtaagtaaagaaagatgatcaaagatgatttgaccaaaagagttttacttcatttaaatgaagcatgttgtcaaagaaaatgaaagtgggaaaaaatgtgaaatcattttgtatcagttcaggacagaaccgtgcttgtgcttcagatctccaagtgtgaacacactgatgtgttgtgaagtgtgttgcaaatagaagcattttttgaatgggagggagagggatgtgttaacatgatttagctgggaattaaacccataggaatgtgtcgggcatattttctgtgactagggggtaaaaagattaaaatggctactgaggatgggcttcagtaagaggaggtctcccgaaggccttctctgccctgtgcctctgcagttccctgactccttgctgtgttcgtccctgcctttttggtagttgtgcccctgatgtcactcccctgtgtgttcagatcctacctgctggccaggtgcagtggctcacacctgtaatcccagcactttgggaacccaaggtgggacggtcctctgagaccaggagtttgagagagtggcctggacaacatagcaacaccctattagtactaaaaataaaaaagttagctaggcataataatgtcctgtgcttgtctagctacttgggaggctgaggcagaaggattacttgagtccaggagttcgaggctgaagcaaactgtgatcatatcattgtactccagcctgtgtgataaagcaagaccctatcctttaaaagtaaaaaacaaacaaacaaacaaaaaacaaacctgcttaacctttcaacactctcttccagtcccccctcccttctgaaaccatattttacatctctggtcctcattaaattttctgtaacttctgcccttgtaactcttctgcaacacaaatgaatacataatcatatacttcctagtagtatttcctaatagttttatgtgagtttcatggaagagagtgttgaaacgtaggtaggtttgttttttattttttaacttttttttaacttttttttttgagatggagtctcgctctgtcacccaggctggagtgcagtggcgcgatcttggctcactgcaagttccgcctcctgggttcatgccattctcctgcctcagcctcccgagtagctaggactacaggcgcccgccaccacacctggccaatttttgtatttttagtagagaccaggtttcaccatcttagccagtatggtctcgatctcctgacctcgttatccacctgccttggccttccaaagtgctgggattacaggcgtgagccaccatgcgtggccttttaaaaaaatttttaagagataaggtcttgctttgtcgcccaggctggagtacaatgatatgatcactgttcactgcagcctcgaactcctcaagtaaactgtaagcttgtgaatgcaggtttcatctcattttctgtttccccagcataatgctgaatacataggctctccataaaaaaaattcttgataagaatgatattaaatggactaaatgagaaattaaactttttattcacttacaaggaatgaaagttctcaaatagctaacttattttcttatgtatcctaggactttttatctggttctggggtttctttcccaatgaatatacttatatatgtttattttatttatttatttttgtatttttaaaaaccagaacatttattgtgtggctaatctttgaaattcttggctgggctcggtggctcatgcctgtaatcccagcactttaggaggccaagatgggcggatcacttgagctcaggagtttgagaccagcctggccaacatggtgaaaacccatctttacttaaaaattagccaggcgtggtgacgcatacctgtaatcccagctacctgggattgtgccactgcactccagcctgggcgacagagcgaaaccctgtctttaaaaaaaaaaaaaaaaaaaaaaagcaaataaattcttgagatgaactggatgctgcaacagctgcccttttgggtttaggtgttgttcctttatggaaatccacgccgcttcattcgcccagtccctgtggcctttagtcttttagccttggcacaccagtcatacttcctcttgcgcttggcggggtagccacatttgccacaggtagacttcggaaggtgacaggccttagagccacagtggccgcacaacgtgtgcatcatattgcaacgcttttcaaacgataacgttccctttgtcatctcccttctgtgtttatttttttattgtggtaaaatatacagaaaagttaccattttaacctgtttaggtgtataactcagtggcattaagtatattcccagtgatgcagtcatcatcactatccattttcagaactttttcatcatcctaagtagaaactctgtacccattaaaaaataatatcccatttccctctttccccacttcttggtaaccacttttatgctttttctctctatgaatttgctcattctaggacttcatataactataataatacaatatttgcccttttgtgtctggcttatttcacttagtgtttttgtttgtttgtttgtttgtttttgagacggagttttgctcttgttgcccaggctggagtgcaatggcgcgatctcggctcactgcaacctctgcctcccaggttcaagcagttcttctgcctcaccctcccaagtagctgggattacaggcatgtgccaccatgcctggctaattttgtatttttagtagagatggggtttctccatattggtcaggctggtctcgaactcctgacctcaggtgatccgcctgcctaggcctcccaaagtgcggggattacaggcatgagccaccgtgcctggcctcacttagcatgttttaaaggtgcatctgttgttacgtgtatcagaatttcttcttttttaaggctgaataatatcccattgtgtgtgtatatatatatacacaccaaattttgtccatctgttggtggaacttgtgtatggtggtttttttttttttttttttttttttttgagacagtctcactctgtctcccagactggagtgcagtggtgtgattgcctgagcccaggagttcaagcttgctacaaccttgacctcccgggctcaggcagtcctcccacctcagcctctcgagtagctgggaccacaggtgtgcactaccacacctggctaatttaaaaaaaaaatttatagagacagagtcttgctatggtgtctaagctggtcttgaactcctgggctcaggtgatactcctgcctcaacctcccaaagtgttaagattacaggattgagctcccttgcgcgacctgatattttaatattttttttaaaaaagtgtaatatgcatacagaaaggggcacaaattgaatgtacagcttgatgaatgatcacaaatgaatacctctgcattccactatcttgcttaagaagtagaaaattgtgagcacacctcagaaagccttgtgcccccttccagtttcactcctgccttcctcctcctcagagataactactgtcttacgttttagcaccatcgattagtttcccttgtttttgtttttaatattcccttgttatccttttaatgtctatagggtctgtggtgatatgctttttccattcctcacattggtaatttgtgttttttctctctgtttctctctcacacacaccttttcagttagttttgctgagggtttaccaattttattaatcttttcaaaaaaaatttgttaactttctcaattgttttccattttattgatttctgctctttattttctttcttttacttaaaaaaatttttttttgtagagatagggtcttgctatgttgcccaggatggtctcaaactcctggcttcaagcgatcctcctgccttggcctcctgaagtgctgggattataggcgtgagccactgcacccagcctactttgggtttaatttgttctttatttctagcttcttaaagtagaaatttagatcgattccaaacccttcttgtccaacataggcatttaaagctgtgtatttcctactaaacactgcgttagctctatcacataagttcatcacataagttttcatgtgttattatcaaagtgtttgatttccaagtatttgggaattctagatatcttggtttctaatttaatttcattgtggtcagagaacatcttctgtagaatttcagtcttctgacatttaccaagactaattttatggcccagcatataacctgtcttagtgaatgttccatttgtagttgaaaaaagtttgtgttgttgcatgtagttttctataaatcaagttgtttcatgcttttgtttaaacatcttctatattcttactttttattttgtacttacttcatctatagctttgctgaggtttttttttttttgtagagacaaggtttcaccatgttacccaggctggtcttgaactcctgagctcaagcaatctgccctcctgggcctcccaaagtgctgggattacaggtgtgagccactgtgcctggcggtatctctcttttttactgagagagtgatgctgaagatcaacagctataatgatatattcgtttattttttcctttaattctatcacttcttttactcttaaaagcatttattccgccgggcgtggtggcacacgcctgtaatcccagcaatttgggaggctgaggtgggtggatcacaagttcaggcgttcaagaccagcctggccaagatggtgaaaccctgtctcttactaaaaatacaaaaattagctgggcttggtggcagctgcctatagctactcgggaggctgaggcaggataatcccttgaacccggggtacagaggttgcagtgagccgagatcgcgccattgcactccagcctgggtgacagagtgagacaccgccccccccccccaaaaaaaagcatttattaggaaacaggaaagactgaacaagaacaagagaactaagcatgtaactcaagaagccagagaaccaaagtaatcccacagtacacagaagagaataataaaaataaaaacaaattaagaatggaaatgatcaataaaaccaaaagctaactttgaaaaatattattgatctaggcacacttctggtaagactaatgaagaaaaagaaaaggtagaatatttagaaaaggaacaatatttagaatgaaaatataactataaatactctcagtttttgcctctttttttgtttgtttgttttttggagacaagatctcactctgtcactcaggctggagtgcagtggcaatcatagctcactgcaacctccgtctcccagactcaagctgttctcccacctcagcctcctgagtagctgggactatgggcatgcgccaccatgtccagctgattttttttttttttttttgtggagacggggtttcatcatgttacccaggctggtcttgaactcctgagctcaagcaatctgccctcctacgcctcccaaagtgctgggattacaggtgtgagccactgtacctggctggttttttttttttttcttttctttcctttttttttgagacagtgttttgctctgtcgcccaggctggagtgcagtggagtgatcttggctcactacaagctccacctcctgggttcatgccattctcctgcctcagcctcctgagtagctgggactacaggcgcctgccaccacgcccggctaatttttttgtatgtttttttagaagagacggagtttcaccgtgttagccaggatggtctcaatctcctgaccttgtgatccacccgcctcagcctcccaaagtgctgggattacaggcatgagccactgcgcccagcctgttttttttttttatagtttgtatttttctgctgagattcaccatgttttcattcattagacctgtcttttcctctaaatcctagaaggtatttgtaataaagaccgtgcctgctaatttaaatatctgagtcatcttggggtctgtttttattgattgctttttctgtacattatgagtcagattttcctgcatttttgcatgttaaataattttgattgtatgccagacatgtgggtgttatattgtagggattctcaatcttgttatctttctttaaagaagttttcattttgttttgacaagtagttaggttactgtagttacttaaattactgtaagtgactggtcgttaagttagtttgaccctgccaggtttggttttatgctttgttagtatgggtttatccttggtccagacacccggcccttagaatagagggtactctttagacttaatgcttggcctttttggggtcgaaacaaaataacagaggtgctcagcaaagtctctccaccctggatgaactggtacttgaatgtcttccagcactgtgaaacctctgtgtctgtgcagttctcagcctcacagccaccgctgtctgctaaactgcatagaatctggaagccatggacccacaggatgcctcccaccttcttctgcctacctctgtgttctgtcaccccacccatgccctcatcttctctcagatttcttgccctacaaattctacctgcctcagcatcctcaaatccaagtctttgcttcctcagttcacagagatggctgctgtcagtttaggtttcatctccctgcactgtgtttgggaaggtgccccaggcaggaagttggaagcaacatgcaacttaccttatgtttttctctttcctcaagggtcacagccttgccttgccttgcctgtcatctaatgcctgaaaacagtcgtctcaaatattttattcagccatacagttgtttaggacaaaaggatatctaataccacttttactgcattatggacagaagcagaagttcaattctgcatattctttttttttttttaagatggagtctcactctgtcgcccaggctggagtgcagtggtgtgatcttggctcactgcaacctccacctcctgggttcaagcgattctcctgcttcagcctcctgtgtagctgggactacaggcatgcaccaccacaccaggctatttttttttttttttgcatttttggtagatagggtttcatcatgttggccaggctggtcccgaactcctgacctcaagtgatccacctgccttggccccccaaagtgctgggattacaggcgtgagccactgcgcccagccagacttttttttttttttgagatggaattctgctcttgttgcccacgctggagtgcaatggtgcaatcttagctgaccgctacctccgcctcctgggttcaagtgattcccctgcctcagcctcccgagtagctggaatatggacatgtgccaccaaacccagctaattttgtgtttttagtagagacggggtttctctgtgttgatcaggctggtctcgaacgcccaacctcaggtgatccgcccacctcggcctcccaaagtgctgggattacaggcgtgagtcaccgcgcctagcctccggccagacttttaaatgttagccttgcaggtagttgtgcagtagtatctcccagccttaatttgctcttctttgatgactcatgaggttaagcaccttttcatatgtttactggccatttggaatatatgtgtacctatgtatctcttgccagttcacctcttttgtccatttttctatttatgtttattcctcattgatttttaggagttatttatattttttttcctttttttttctttgtttgaggcagagtcttattctgttgcccaggctggagtccagtggcacagtctcggctcactccaaccttgacctcctgggctcaagcggtcctccaacttcatcctcctgagtagctgggactataggtgtgtgccaccacttctggttaattttggcattttttgtagagttggggttttaccatgtggcccaggctggtctcaaactcctgaggtcaaaccatccacccacctcggccttccaaagtgctgggattacaggtgtgagctaccgtgcctagcctgtgtactctcaatacaggtccttcgttgggtgtatttattatgactattttcttacactttgtggttcaccttttcactctttatttacataattatagccattgtgcgttttcactctatctctcttttttttttttttttttttttttttgagacagagtcttgctctgtcactcaggctggattacagtggtgtgatctcggctcactgcaacctccgcctcccaggttcaagagattctcctgcctcagtcccccgagtagctgggattacaggcgcccaccaccatgcccagctagtttttgtgtttttaatagagaaggggtttcaccatgttggccaggctggttttgaactcctaacctcaggtgatccacccaccttggcctcccaaagtgctggggttacagacgtgagccactgcgtccggctgctttttcactctcttaatggtgtctttgataaaccttaattttgacttagtctaatttaatcttttatggttagtactttttttgtggtctgtgtaagaaatctttgtgtctaccctaaggtcacaaagaagtttcactctcttacatctcatgtttatagttggcctggaattgttttttctgtgtaggggcgaaggttcattttttccctcatattgacctagctgtttaattgaaaagaacatctgctgctgtgtaaatcaggtatacatgtacgtgtggatctgctggggaactccttcctgttaatttgtttgtctttccttgcaccagtattacaatgtattactgtagctttaaaataaatcttaatgcctggtagaataaggcctcctgttttgttcttcaatattgtcttggcttgctcctttgtatttccatatacattttagagtgggttttatcagcttccatacccaaacagaaatacccttaaggattttcttctctgattgcactaaatctataggtttctttgatcctagaaatgaataatagaatataaagaattcttattgatgaaagaaagctatttcaggaaacttttttttttctgttaatgataaaggctaaatgattcctgtcaattgtttcaaattttcaactttcaaaatacctgctgcttctttccaattcacctttctctattctttttttttttccaattgtatttttctttgacactcagtacttgtcccttgatagtggagaccatgtttatacattttcatggatcgaacagtatttttttttaacagactagctacttagtgaatacgcagttgaatctacttgtttggcaggttcaggcattgaacaagtactaagtgcctgttctgtatcaggtactgtgtcagtctggggtaagagagccaggaacaacatagccaacaaaaggctctttgtgtctaatttatattcctgaggaccaccactggccatctgcttgggagaatggttatggcttgaataaacagtgtggaatgggtccagggaaccggctgaggaaaggggacatttactcaacctgatcttctttgttaagcagtggagagacccctggtggagccagcagtatcctttatctataatagcttgcttttcatcttttttatatcagtggctgcctgtggcctctcaccaaatctggtggactcattttctctgtgtatttagtttttctcctggaaatgactaacagctgcttaagtccttattcctttctccaggtttctggtgctgccataatttgttctatccacttgggatactgctgtagtgggaatattgtccctgttaccatcttcaggttacaaaccttttccccagcttgtggtaaaatcccgggggtctggtggatcccacgcattttaggatgtatatgggaagctaacattataggcacagtgtttttttttttttcactgtgtccgtctgttcttcagaggagcaaaggctagcatgacctttaagtcctcctttaagagtactgaatttctgccaggagcgtggcttgttcctcaagtgtcgctaggtgaattgttattagcaaggagggatgaaattgcgaaatcttaaaaagtagagaattccttcagatttcattcttgagaggtagaaaacaggaaatagaattgctaaacagagaaggggagtgtttttaatagagatatttgtatgagaataagaggatggagccataatctgaggatgcctgtcttgtttgctctttggcttagttggatcttgggttggtttacttcctgtacaaactgtgagttagtagggactgaatttacagtaatatctaaactgattggaaccttcacttgaacagaattgagttttggcgtgttcacttttaagagaaagaaacaaaggcagccaacccagtatcaagagtttagtcaaaacaaacaactcccagatttgccttggtagtgaatagattcagcatgtttgtactttctatttcttcagtatcatatagtaatttattgtttcattggtgattttgcagcatcctaggttgcaaagaatatctcttgtggatgtgtaaagttaaaaaaaaatttttttttcttgtagcagggtctcagtgttactcaggatggtcttgaattcctgggctcaggtgattctcctgcctccgcctctcaggtagctgtgagtacaggcgtgcaccactgcgcctggctgtaaagcacttttttttttttttttttttttgagacagagtctcactcgttgcccaggctggagtgcagtggcgtaatctcggctcactgtaagctccgccacctgggttcacaccattctcctgcctcagcctcccgagtagctgggactacaggcgcccgccaccgcgcctgccaccacgcccggctaactttttgtatttttagtagagatggggtttcaccatgttagccaggatggtctcgatctcctgactttgtgatccgcccgcctcggcctcccaaagtgctggggttacaggtgtgagccactacgcctggcctgtaaagcactttcatatacttttttgtgaggtctatggtataggcaggatacgcattattcctttctttcagtaggaaaacttgtgctttgggtagtcgtgtttttagggttacattgctgattagttttagagctgtggttgaaatcaagtgtctcttgacagcttgagtgtttttcaattggaaacattactttttgaggatagactaatgcattttgaaaacatttgcatcattgaaatgagtggggtctagctttagaatttaatcaaatttttaattttttcacaatttcgtggtatgatttttaatactctattgaatattctttttttttttttgagatggagtctcgctctgtcacccaggctggagtgcagtggcgcgatctcggctcactgccagctctgtctcctgggttcatgccattctcctgcctcagcctccccagtagctgggactacaggcacccgccaccatgcctggctaattttttttgcatgtttagtagagacagggtttcaccgtgttagccaggatggtcttgatctcctgacctcgtgatccgcccgccttggcttcccaaagtgctgggattacaggtgtgagccactgcgcctggcctgaatcttcttttttttttttttttgagacagggtctcactccgtcacccaggctggagtgcactggcatgatcttggctcactgcaatctctgcctcccaggttcaggcaattctcctgcctcagcctcccgagtagctgggatcacaggcgtgtgccaccaagcctggctaatttttgtatttttagtagagacagagtttagccatattggctaggttggtcttgaattcctggcctcaagtgatctacccgcctcagcctcccaaagcggtgcaattacaagtgtgagccactgcgcccagcctctattgaatattcttaccctttggtagttgagtgttttggaatggcggtgtgtaacaaacataccttatgtatgcttttatgatttataattttatgctgttatgaaattttataattataaaattatttataatttaaaaaatttatacattgtcctacaagctttgtggcagttttacgatttattttaaaattaaattgaactttttttgttgtgtttttttgagatacaaccttgctctgttgcccaggctggagtgcaatggcatgatcttggcttaccgcaacctccgccgcctgggttcaagcgattctcctgcctcagccttttgagtaactgggattacaggcacctgccaccacatctggctaatttttgtatttttagtagcgatggggtttcaccatgttggccaggctggtcttgaactcctgacctcaggtgatcagcctgcctcagcctcccaaagtgctgggaatacaggtatgagccactgtgctaggcctaaattgaacacttttgaatagataatacattttctaatttaaactacaaagctacagaacaaacatgtattttcagaagcttgcttgcacctctgccactctgtccttttccttctcctactcctctggaaaattttttgtgtgtggttttttttttttatccttccagtgttcttttttgcaaatacaagcaaatatatatttattacacaaaagatagcatacagtatataccgttctgtaccttcttttttgtttttcccttaatagatcctcaggatctccccatattggaatatgtatatcttccttctttttatggctgcattgaattccactatcttggaagtatcattggttttccaaccagttccctttctggacttttggagtgtttccagtctttagatatgataaacagtgcttcaggggtaacgttatagctgtgggagagattcctaaaagtcggggcactgggtttaagggtacatgcgtttgtcatttctgttagtagatggattctacttggtagatagctaccattttgcgtatgtctgtgtgtatatatatgtgtgtgtatatgtgtgtgtatgcatgtgtgtgcatatatatatatatatatatatatatattttttttttttaagacagggtctggctctgttatgcaggctggagtgcagtggcatgacctcggctcactgcagcttcagtcctcggggctcaagtgatactcctgcctcagcctctctagtagctggaactataaatgtataccactatgcctggctgttttttgtattttttgtagagatggggttttgccatgttgcccaggctggtcttaaactcctgggctcaagtgcctccttggccttccagagtgttgggattataggcatgagccaccacacctggcctgtattaatatagagtaatagagatctatattggtagatatttccacattttcttccgtagacatcattctagtttacagtcccatcgctggtaatacagaggttgccttcatccccaaagcctagctaagagagtgtattgtcaagctttgggactttttccaatctgatatctaagaaatagtattttagtatggttttaaatggtaggtcttctgtgagtgaggttgaacattgttttgttttgttttgttttttgagacgaagtttcgctcttgttgtccaggctggagtgcagtagtgtgatctcggccccaccgcaacctccgcctcctaggttcaagcaattcttctgcctcagcctcccaagtagctgggattacaggcatgtgccaccacacccggctaattttgtatttttagtagagacggggtttctccatgttggtcaggctggtctcaaacttccgatctcaggtgatctgcccacctcggcctcccaaagtgctgggattacaggcgtgagccactgtgcccggccggttgaacgtttttaacatgtttaggggagatacatacttatctttctgtgaaccatctcatcaggttctttgtgtggcagatatttaaataggaaactatgtagggcctagttgattgcctatatagaatccagtaccctgtctatgccccttcactgcccaagcatgtcacaaggaactgccctattccaagctccagaggacctgctgagtaggtgcttttcaggagcttgaaaagactgtttccaggtctacccccaggggttaatttaattggtctggggagaggcctaagtatcagtttttttgttttgttttagttttttagtaaggagagactttattgaaaaggatttttgcaaggaggggaaaacgactgttgaaatagggaggacactctgaccataaggaggtgtgcaggcatcttctttttcaaaaaatgttttcagttttaaaatttaaaaaaaaatttattttatttatgtatttattttgagatgaagtctcactctgtctcccaggctggagtgcagtggcgtcatctcagctcactgtaacctccacctcccgagtttaagtgattctcctgcctcagcctcccaaatagctgggactacacgtgtgcactaccacacccagctaatttttgtatcttttgtagagatgggggtttcaccatgttggccaggctggtctcgaactcctgacctcagatgatccacccgccttggcctcccaaagtgctaggattacaggtgtgagccaccacacccagccacctggacatgtttaaagaacccagtacctcaggtttaaggagcttttatgtttggtccagactacgtttcagggaagccacaagcagagtttaaagcctgctgagcaccgagctggttcttggtgctaacagggctgagactagtgaaaaagtcatgttgaggcatctgctcagttccagtgtcttccttggcatctgcttgtgcctactgtttgccccctttgcctgtgtgttaaaacagcctctgtctcagaacagtgtctttttttttttttttttgagacagagtctcactctgttgtctaggccggagtgcagtggcacaatctcggctcactgcaacctccacctcccaggttcaagatattctcctgcctcagcctaccaactagctgggattacagatgtgcaccgccacacccagctaattttttgcgtttttaatagagatagggtttcaccatattggttaggctggtctcaaactcctgacctcgtgatccgcccacctccacctcccaaagtgctgggattacaggcatgagccactgcagtgtcctttcttgaggaatggtggtctattaggagaaaaaccaaaagataagacccgagaccaaggaaattgtagtctcaatgcaaagatacaatcagaacattgcacaagggggaaagaaatgtcatgctagtgtttgtattttaattgtctttccttatttagaccaatagtagtaacaggtaacttgggttgcatgcttactaagttccaggcagtagtcgaataacttttaatatttaatattcagaacaataaggaagaaatgaaaactaagaacttactagcaatccggagtttatatttcttgaaaagctcattacaggtagttgctggaatgagatagtttgtgtgcatgaagaagaacacacaaaaatattaaaacatgacatgagtgatggtaatacagcaggtccccagataatggcctttcattcactattgtttcattatcatgttgatgagaaaaaaaaatcaattccctgctggagctactgtctatttggaatttacacattctccagtgtcctcgtggaacttaactcttgtttatatcaattaccttgctgattgatggacaaatcatggaaaattggttttgttatatgtcattttgctcaaagccccagtttccaagaacctatcaatgacattaagtgagaacttactgtagttattccctccccattcaaaacaaatttattgtttagaggatataaggagaaaacattttttccctcagatgtatccttctgtgtgttatgtgtctttttcttttgagacagggtcttgctctgtcgcccaggctggagtgcagtggtgcgatctcgattcacggcaacccccacctccctcgttcaaacaattctcctgtctcagcctccagagtagcggggagccacccgctacaggcgcgtgccaccatgcccggctaatttttgtattttttttagtagagacgtggtttcactatgttggccaggctggtcttgcactcctgacctcaagtgatccacctgcctcagcttcccaaagtgctgggattacaggcgtgaaacactgtgcctggcccgatatgtgtctttttaggcaagcagtgcttatgttgtttgttagtggtaagctgcctttgtagctctgtgttaccttgagtgagacatgatgtgatgtttagttcgtagcatcctcagcactgtcttattcacaatcattgtcaatctaaatgcatagtccttcctgattttttttttttgaaggctttttaaaaaagtttaattgagatatggttacaatggagaaaaaccttcaggaaatataaatgtaaaaaaaatttttaagctttattatttattataaaaacaacatacatttttgtaaattattcaatcaaggaaaattgattcagaaagctatttgaaattcaatcagcatgatcaatgatactttaacccctattcaaatgaaagttatcctaattaaaagtaggtgccctaagaccatttttcagggtgcatttgggttctattgcttccacatcaggaactcataattactgtatggattttataagttgatccaaccatggtatgacttctgtgggtactggtaagtccacatcattgctttgtaataatgtataatcatgactggatgcagtggctcacgctgcaatttcagcactttgggaggctgaggtgagaagattacttgagctcaggagtttgagaccagcctccaacatagggagaccccaacatagggagaccgcatctctacagaaaataaaaaataacaataaaaaatgtgtagtcacaatgttaaagtgaatcagaagagttgctaagttatgatcctttaattgaatcaaagttttttgtttaaattggcttgctgaggagtttccagtaaattaataatgaattatgtaattaatattatgttaatattaaatgttattttaatcaggtcactgccctgcatgccaacttccactgaagtgggaatgtttcacagtgattcagtggccaattagcaatgctcagattcgccatttattgagagattcacacacacacaatcaatcaaacattcacaatgtggttattaaaggctgtaattagggggacaatgaaccacagggatggctcagaaggtcagagcactgatggaccctcaagtgggttggaagtcccttggatgctagtaagtgaggagtggctgttcctctcctggagagccgctgggcggcaattgtcatgctaggaggaggcctcagagttctcatgggcaaagattccaaaggcgccccagacatcatcagctccttgctgtgtgtatgattctccaaaggtctgcccagtatcatggtctcagccagctcttggctccatttttccatcggtggtggtactatgccacagcaggtgttattatctcaccaccttattctattagacgtatgtttatcacttcgaagaaaaacaattttactatgatctcagttgccaggctagtacacatgtgcttatcattctttgtttgcttttcttttgagtcaaggtcttgctctgtcacccaggttgaattgcagtggcacgatcatcgctcacttcagcctgtaattcctaggctgaagggatcctcccacctcggtctcttgagtagataggactacaggtgtgcaccaccacacccagatttttttttttttttttttttttgtagagaagggtctcactctgttgaactcctggtggcctcaagggatcctcctacctcggcctcacaaagtattggaattacaggtgtgagtcactgcagctggccttcacttatcactgtgaggagtaaacagctgcatggtgggcttaatgccatctaacacgagtgactccatgttcagacagtaggatcacaaatgattattatatagcaatgaatggccacaggtacatagactaaggagccacatccctgctcctgggatatcctttagtcaaagggctagaagggtcctggaggtttgccacttctccgtgttgaggtacagagttcctagactaagggactggctgcattgttatgtgtgagtgctagtcatggtgctgcctggcacccacaaatgccacagcagacccatggtcgagggagaggagcaggaataccagttaccatgccggagtaacagttacggcactgatgcaccagttaccatgccagagtaacagttacagcactggtataccagctaccatgccggagtaacagttaccacactgatataccagttaccatgccggagtaacagttaccgcactgatgcaccagttaccatgccagagtaacaattatagcactggtataccagctaccatgccagagtaacagttaccacactgatatactagttaccatcccagagtaacagttaccgcactgatgcaccagttaccatgccagagtaacagttacagcactggtataccagttaccatgccggagtaacagttactgcactgataataccagttaccatgctggagtaacagttaccacactggtataccagttaccatgccggagtaacagttaccgcactggtataccagttaccatgccagagtgactgattttgaccaagacctttgggttgtacagaaggggtgagaccatacctgtcctcaagcatttccaacctagtgtagagaaaaacaggagcaagataagaacaacgtactgaaaaggaaattggatgagggcctggaaaaaggggtaaagtgagctggttgggattggtgagtgccacagcttcctgccccttaacagatcagtgccatggtggctgtggtgtccctggcccagaccttctcagacagggcctgggtgccctttacagagcagttgggaagagaagggaacctagccttgtgaccttttgctccacagacctagtcctttgttgtggtgcgaggctcagtcgtcagcccaccgagtcatgtatgttctctggttgcccctggttttggctgaactcaaaggatggctgtctgtgaggagtactggtactttttgccacttgtgtgccctaactgtggtggatgccattttggggattatgctcagcagtgagtcacgtgagatgcacacgtagcttttcggtgattaatccaggtcaatgcccttacccacatacttctgagatgtactgatgatgactacatttaaagctttttctccattggctagaagttgagacccatttcaacaaaagcacttccacctctcctgaagtgcattgggaaaactggaggccattactagatttacagatgatgggccgtgcttaaataacccatcttagctagactccaggtttcgtcacatattccctacctgttgctgccattgagggctttctctgtgctaggcactaccaaataatgctttggtaactttggtaatttggtaaacttggtaatttggtaaatttggtaataaagagcctttattctaaagtgcaaatctaagtttggggttcagtagctcaaaactctctggtggttcccattatatagagtaacagtcttcattttaaaaaaggtcatgtacccttattagaattttgtgagcaaacaaatatgtgtgtatcgtatgtatgtttatatgtatatcagatgtacgcacattagtatgtgctattaagatactttatattatataatatatactgtataataccgtatattataaagcattcataaaatgaaaatgaagatgaaataaattgcattgtaaatatttaaaactttaaaaaatgcgttactggtacaaaatttttttgtttctaaaaaattattattaatgagcaatgggactgaatttgcttcaccgtttttttaaaatcttgatttaacatttgtcatacagctattttaacatcttacactaaagttgattcttgttttttggagacagagtttcgctcttgttgcccaggctagagtgcagtggcgtgatatcggctcactgcaacttccatctcctgggttcaagtgattctcctgcctcagcctcccaagtagccaggattacaggcttgcgccaccatgcccggctaatttttgtattgttagtagagatggggttttgccgtgttagccaggctggacttgaactcgtgacctcaggtgatccacccgtcttggcctcccaaagtgctgggattacaggtgtgagccaccacgcccagcctagtttattcttttaatagtgcttgggggaggtagcctctaagatgacccccagtgattccccacctcctggtattcctggctcttttgcaaatgtcaattctaatttggtcctaaggtctctctcttgagagtggctatagattctagccctgcccaggaaaataggtttgaatgcattggtcaggtgagacacagagcagcacagcaagacacatgaaatagcagaagtatttttattacttactgatcccagagaggagagagagagaatcctgggccaaaacctttattgggagtccagggagtttcccaagtgggtttcctagggctattatgttaccgaagccaatagttctaattgatgggtttaaagggagcaggcacaagctttgtgggggtcacgctgtgattgagacatggtcactgtagcatattcatctagtacttgtggggtcggggaacaagaggggtgagccacataggccctatgtagctgtcctgtaaagaggtaggggaggtggccatcaagaggcatggtgttaggcagatgtctggagtggccacattgagggattggaagcgggtgtgtttctatgctcccttaaggatatttttggaaacaacatgcttgctgcatacaaatattcaaacattttatctttaaaacaaattttagtactggtaacatttattaacttttttttttttcctgttccctaatttgctacccagcttttacatcaaagctcctatcacaacccttcttgtttttttctttttttccctgagacggactcgctctctttcgctaggctggggtgcagtggccacaatctcggctcactgcaacctctgcctcccgggttcaagagattctcctgcctcagcctcccgagtaactgggactacaggcgcatgccaccatgcccagctaatttttgtatttttagtagagatggggtttcaccgtgttggccaggatggtctcgatctcttgacctcgtgatccacccgcctcggcctcccaaagtgctgggattacaggggtgagccaccacgcctggccccttcttgtttttgtagcttgtcacatgatgaatgctttttaccctgggggagaccaagactttgagtaatagtttgcttttataagccagaatttgttctacacatagaaggataaaactgtcttttctggccaggcgcagtggctcacgcctgtaatcccagcattttggggggccgaggcaggcggatcacgaggtcaggagatcgagaccatcctggctaatgtgatgaaatgccatctctactaaaaatacaaaaaaaaaaattagccgagcgtagtggtgggcgcctgtagttccagctactggggaggctgaggcaggagaatggcgtgaacccaggaggcggagcttgcagtgagccaagatcgcaccactgcactccagcctgggcgacagagtgagactccgtctcaaaaaaaaaaaaaaaaacaaaactatcttttctctctggtttctttgctgttccttttcaggagagaaattacaataggattggtggcctaatgatgtaagtgccaaagtttcattcgaggttttggggtagaatgtttttcaactgtttgcttttatctgagacaaagtgggcaaggaataaaggtagagtggtgagaagggtgttatcccttcctgggaacctttttttttttttttttgaggggggcagagttttgctcttgttgcccaggctggagggcaatggtgtgatctcggcttactgcaacctccacctcctgggttcaagcgattctcctgcttcagcctccctagtagctgggattacaggcatgcgccgccacacctggctaattttgtatttttagtagagacaggatttctccatgttggtcaagctagtcttgaactcccgacctcaggtgatctgcctgccttagcctcccaaagtgctgggattacaggcgtgagtcactgtgcccagccctgggaaccttttaattgtcaactgtgtaggtgttcatgctggcctgcataatagagcgcctgctgtttgattttcagttttctgtagaaggaaaaaaaaaaatcaaaccaacaatagcaaaactcatgatacctcctggtctctctctccctctcctctgcttgcatattctggtctataacaggaaatggaacctcctggagtgaggggaaaatgaccttcacatttaggtttctcactctaaagttatttcttaaatattttagcctgagttcttttaataacagacctcagctctagttctttgaaatgcatgtgggaaaatgtttatcagtgttgaaatctgacatttttttaatctcatgaactccacaattgtctgattattaaagtcctgcttacttgactgtgactaaaattctactttcagaagagtagaatgtacccctaccaaattgaagatcaaataaataaagtggacctggaaaagtaaggcttgccattgtgtgtcaaaccagcccttcccagctgtgggctttgtacttaacggactcagaacgtgaatggaagtacagactctggaacatgtaggagctgttatcccttgccagtttcatgcttcactgtccatctcctggccaaatagagagacaagggtgacattaaaatcatgggtttatctgaattcaaatctcagctgctcacttactaacagtatgaccgcagacaccagcaaaacgtcccactgctgcttatttccaagcctttccaaggtcttctggtcagggcagattcttctttcttgttcctaaatttaaagtttcaagaatttaatgcgtttttttttttttaatgaatttaatgccttttggggggtaggttttcctaatttaactttatttttttaaattttatttttaaattagtgaacagtaaaattgactttttcaatgtatggttttatgaattttaagacatttatagatttgtataactaccatcgccaccacaggacataaaatatttccataatcccaataactttcttcgtgctattctgctctcctgcctcctggcaaccactgatctgttctcatcactattgttttgtccttttgagactgtcacagaaatggaagcatctagtatgtaaccttttgagattggcttctttcactgagcgtaatgcctttgagatccatctaaatgttgcatgtgacaacagtttgttccttttcattgctgagtagtattccattgtatgaatatggcacagtttgcttattcattcatctgttgaggatgtgtttgggttgttgcttggtggggcattggtgattacgaatagagttttaagcatttctgtactgtttttatatgaacataattttttaattcacttagcatatactcttcctctgtctgctgtaataaggtaccacaaaactgggtggcttaaaacaacagaaaattattcttccactgttctggaggccagaaatctgaaattagtatcactgggccaaaatcagggggacagcagggccttgcttcctccagagactccaggagagaaatacttcctggcctctctggcttctggaggccacctgcattgcttggtttgtgaccccttgtatcactctgaccccttgttccattgttttatttcctgttttgtaatcaagtctccctcaggctgggcacccctgagggagcatggctcatgcctgtaatcccagcactttgggaagccgaggagggcagattgcttgagctcaggagtttgagaccagcctgggcaacatggtgaaaccttgtctctacaaaaaatatttttaaaattagttgggcatggtggcatgcacctgtagtcccagctacatgggaggttgaggtgggaggatcacttaagcctgggaggtggcggttgcagtgagccaagattgcaccactgtgctccatcctgagcaagagtaagaccctgtctcaaaaaaccaaaacaaaatcaagtctccctcagtcttcctctttttttgtttgcgtggggacagagtgttgctctgtcgcccaggctggagtgcagtggcacaacctcagctcactgcaacctctgcctcctgggttcaagtgattctcctgcctcagtctcccaagtagctgagattacaagcatgcgccacaacaccctgctaatttttgtatttttgtagagacatggtttcaccatgttagccaggctggtctcgaactcctgacctcaggtaatccgcccacctcagcctcccaaagtgctgggattacaggcatgagccactgtacccagccccagtcttcctcttatagggacacttgtgattacatttatgcccactaggatgacggaggataatgcccccatctcaagattgttaatcacatctccaaagacccttttctcccatatagggtacattcataggttccagtaattaggactggcatatcttttggaggcccattttttagcctactacacttggctaaagacctaggaatgggtcactaggtcatatggttagtatgtgtttaatttcatgagaaattgccaaactgttttacagagtggcagtcatttcacgttcctaccagcacccttgaacgccagaattcctggtatcctcggctgaactggctattgtcggtatttttaattttagccattctagtgagtatctcatcatggttttgcttttccctgacagctaatgaggtggattgagcatctttttgtgtgaaaacctcatatcttttaattttcctcctataacctgcataagtatgaggaagaaaagtgtgaactgaatcataactaaaggaaagaagaacattgctgtcttaagcagatcacgcctttgtcgttatacagtatggtacaataatccattacacatctctttgattcatcttgtctgttaaatttctttataaaatttgtttagttgatgacacacctgactctaatataagagttgaatgttgtatcacttttttttttcctttttctgagacagagtctccctctgtcacccaagctggagtgcagtggttccatcttggcttactgcagtctccacctcctgggctcaagtgatcctcccacctcatcctcctcaatagctgggactacaggcgtgagccaccatgcctagctacttttttttttttttgagacggagtcttgctctgtcgcccacactggagtgcagtggcgtgatcttggctcactgcaaccttcgcctcccgggttcaagcagttcttctacctcagcctcccaagtagctgggattacaggcatgcgccactgctgcccggctaatttttgtatttttagtggagacggggtttcgccatgttggccaggctggtctcgaactcctgacctcatgtgatccacctgccttggcttcccaaagtcttgggattgcaggcgtgagccactgcgcttggcctctatataagcttttaatgaataataaagactctaaattatgcttatttactaccaaataatctttttaaatgaaaaatttgttatccctcccagccctcagccatgacccgaagtatgaaataggcatatctttttgctgctattaggctgtagttcatactggtttagtattgctgttgatcacttttagggacatttaatgatattttatactagatcttgagcaccagctatttattttctcttgaagcagtggtttatagtaatacattgtgctcagttcttttttggttctttgtcaagttcaacacagtagcttctgttgattgagttcttgtagttatgaggggaaattaatgctggtgaccagtatttgagaattaaaaacctctgttcagaaaggcaatgcagagtagaataatgaacggatactataaatgacatatcttgacactgggggtttagtataaataaacagtatttcaatctctggaaattgtaaagcccgttatttaacctaaaaacgttaatggctcagaaaacagaattacatggcatttccttgctaacctcccagagcctatcccctccaaagatgatagggctaaagcctggtccactaagttgttgtcagtcgtacgggctttagagtatgttgacttgatcaaacatttactgtttacaaatatttgcttctagctcatatcctgacacttaaagccacgtgatcttgtagaagtcacttagctgatgaggtaaaactgagtctgtttctccatctgttgaatgaggctggtgatagactctttctttgctctctcccaggtgggtaggagatcaggatgagctgatgtctgtgaaagaactttggatactataaagtgctttaggaatgtatggggttattattttatgaaattgttgattcgtcttcataatttgagatacaagatctccattccattgctaatgcttatggaagattttgtcactttcttaaaaaatattgccaaggccgggcacagtggctcacacctataatcccagcactttgggaggctgaggcgggaggatcacttgagcccaggagtttgagaccagcctgggcaacatggcaagactccatctctacaaaaattgaaaaaaaaataaattatccaggtgtggtggtgcacgcctgtgttcccagctacttgggaggttaaagaggaaagatcacttcagcccaggaggttgaggctgcattgagccatgattgtgccacggcactccagcctggacaacagagaccctgactcaagaaaaaaaaaatacatatatatatatatatatatatatatatatatatatatatatatccaagtataagtatatacttagaggtgggctggtaaaggctttttcattatggatttttcagtttatttcttctaagttttgtcagttgaacagtagggataaattaaagaggaggaaaaaaaatccccatcatccttccttccctccttccctccttcccttcctccctccctccctccctccctccctccctccctccctccctccctcctttcctcactccctttcttttttgacagagtctcactgtgttgcccaggctagagtgcagtggcgtgatcttggcttactgcaacctccccatcctgggttcaaatgattctcaggccttggcctcctgaatagctgggattacagacatgagcacctgacctaacatggttctttttcttttttctttttctttcttttttttttttttttttttgagacagagtctcactctgttgcccaggctggagtgcaatggcacaatctcggctcactgcaacctctgcctcctgggttcaagtgattcttctgcctcagcctcccgagtagctgggattacaggtgctcgccaccatgcctggctaatttttatatttttattagacacagggtttcaccatgttagtcaggctggtctcgaactcctgacctcaggtgatctgcccctcagcctcccaaagtgctgggattccaggtgtgagccaccacgcccggcctacatggctctttttctattcagcttttttggtaggattgaggtagttgtagaggagtgttgataggatagtgaagaaattttaacctttgctaaaaacatgcaagacagtgtcataatgtttaagaatacataaatgttatcattttgtacatgtccttttgaaacttgttttttttattcagcttttttttttttttttttttttttttttttgagatggagtctcactctgttgcccaggctggagtacagtggcgcgatctcggctcactgcaacctctgcctccccggttcaagtgattcttctgcctcaacctcccgagtagctgggactacaggcacgtgccacgacacccagctaaatttttgtatttttagtagagacagcatctcaccatgctggccaggctagtcttgaactcctgacctcaggtgatccacctgccttggcctcccaaagtgctgggattacaggcatgaaccaccgcgcctggccaaacctactatttttaatgggaaggggtttattatagatattatatagctaacagttatggggagggctgaaaaagcaggttcttggttgggcttcatgagtgattcccagatggaacggcctcatagacctgggccactgaggaagctgcagcctcttcaggaattgggaaggtgtcagctgtagaatctgccacaatcaaagccttactgctcctggctccagagccaggtatggtcagccagcaaaattgatatcctgcactctgctcctcaacacccatgaagccagtgcctggacacaggactgctcgtcctgcctcagaaaaccaaatgctttccagccgggcttgcccacagcaacggcagaagcaacagatgtgtgctgggcctcccatctgctttccaaatctcatgtaattgtatccaacttgcagaccctaaatcacatttaaactgtaggtgcaggggaggtggtgatgtgtctgttagattttcagcctccgcactattagaaaagaagggaccctggaaggaggatggaatggctatggattatccatccaccatattcgctccaaattcttaacctgatatgaagatgtatgggtataatgtagggatgctttggaccctgtaattttatgcacacttgggaatgtgcaccagaacatttttctttcattagattctcaaaggggacgatgacccgacagaggctaagcaccattaaccagataagttaagtgatgaagtgcccagattctgaaggcaggcaggcctagatgtgaatcctgtctctgcttcatagctgttgtgagatcttgggcatgttatttcacttctgtaacccttaactttctcatctttaagatagggttctgaggatacttttatggaggtttcatggtaccagcatcctactgggaactgtaactcctgctgcctaccaaatatctataatatctttggcttggcactcaaggtcttctctgaagtagcccaaacatgctttcttgccctactgcagggttgctatgagggtgaagtatagaatgcctctatggtgaatgcctggtatagtgcctggccccaaaaagcaaccaataagtagtcttctcttcccaaagctagtcactgcatgtatgtatgtattcattcattcctcagaagaacatggccaacatgaaaattagggtgtgctgctgccatctctgttaagaataccccttggtggctgggtgcagtggctcattcctgtaatcccagcactttgggaggctgaggcggacagatcactggaggccaggagtttgagaccagccatggccaacatatgaaaccccgtccctactaaaaatacaaaaaatagctgaacgtggtggcgaacacctgtaatcccagctactagggaggctgagactggagaatcacttgaacccgcgaggcggaggttgcagtgagccaagatcgcgccattgcactccagcctgggttacaaagcgagacttcgtctcaaaaaaaaaaaaaaagggctgggcgcagtggctcacgcctgtagtcccagcactttgggaggctgaggcgggtggatcacgaggtcaggagatcgagaccatcctggctaacacggtgaaaccccgtctctaccaaaaatacaaaaaaattagctgggcatggtggctggcacctgtagtcccagctactcgggaggctgaggcaggagaatggcgtgaacccgggaggcagagcttgcagtgagccaagatcgcgccactgcactccagcctgggcgacagagcggactccatctcaaaaaaaaagaacacccttggtagctcctacttgtgctgcagaggtgaacttggctatcacttcctctgttcccactgcatgctgtgctattgctgtgctgtttatcacagtggtgtttactgtcttatacttgcctctctctcatctcttctttttttttcttttctttttttttttttttttttttgagatggagtctcactctgttgctcaggctggagtgcagtggtgcaatcttggctcactgcaacctctgtctcctaggttcaagcaattctcctgcctcagcctcccgagtagctgggattacaggcatgtgccaccacaaccggccaatttttgtatttttagtagagacgggtttttaccatgttggccaggctggtctcgaattcctgacctcaagttatccacccacttcagcctcccagagtgctgggattacaggcgtgagccaccatgccaggcctcatctcctcttaaatgtctttagagcaaagattgtgtcataaccccggcacctagtatcatgcctattacatagtagattttcaataaatgttaaatgcatgaatgaataatgagtaaagaaactgggtaatgtttttagcttggaggagagaagcctaagggaagatgtgtttgctgttttgaaaatatttattgtcgctgggcgcggtggctcacgcctgtaatcccagcactttgggaggctgaggcgggtgtatcacctgggtcaggagttcgagaccagtctggccaacatggtgaaaccccgtctctactaaaatataaaaaaaattagctgggggtagtggcgttgcctataatctcagctacttgggaggctgaggcaggagaatcgcttgaacccaggaggcggaggttgcagtgagccaagattgcaccactgcactccagtctgggcaacaagagtgggactctgtctcagaaaaaaaaaaaaaagagagaccaggcgtggtggctcacgcctgtaatcccagcactttgggaggccgaggcgggtggattacgaggtcaggagatcgagaccatcctggctaacatggtgaaaccccgtctctactaaaaatacaaaaaattagccaggcgtggtggcgggcacctgtagtcccagctactcgggaggctgaggcaggagaatggcgtgaacctgggaggcggagcttgcagtgagccgagatcgtgccactgcactccagcctgggcgacagagcgagactccgtctcaaaaaaaaaaaaaaaaaaaaaaatttactatcatgtaaaggggagttggtctcaccctacactgctttggaaggcacaattaggagctgcggatggaagtcacaaaataaggcacatttggactcagtatgaaaagagctttcagataatgagagcaatcaagtaatggggggggcttggaagccagtgattattggtcattggaggtattaaaggagaggcaagataggaagatatagatggggtttgaataccgtgcggggcttctcagcactcttccttttctgagtgcttttaacaagcggactagggaatagatagggcctctgctctcagggagattattgtctgctcagggagagaagatatattcaggtgggaaagggcaaagggtgttaggaatggcttggctaggatagtcagaggagtacgtggagtaaggcaggaaagcatgtttgggcttcctcaaagatgaccttgagtaccaagccaaagattttggagatatttggtggacattgggcattatacatacccagtaagatattagcaccatgaaagctccacaaaagtgtcctgagcgcctagaacagtacttggcacatggtagatcttcaataaatagttgttgaaggaatttgttaaaatatcagagctatgatttaagaaaattattctgtaatctgaatttaggttgggagtggaaaggagtacccttaagtaggacatgagaagagcctgaagaaaggcagaggacaccagtaggcatcttggatgtgggattggtcagaggggagagaggtaaaaatgattccatgactgtgagtctggcgactagaaatgggggtgacattcacagagtagggtggttccctgtagttcctccttgtgcagaaggtgaggctttgcttgtcgacctgcttcagtagtagcattgacagaacagtctctgtgtactctgtcccctcagtgctttctgcatatgtgttgctcactcatcactatctgcatgttcgtggtctctggaaagaatcaactataatgatcagaataattgcctggtaggacgtatttcctttgagttcagcaagacgtgccccctcacatggtgttcctgttcattcataaggctgtaataatgtatgagttaggagacccttttgaccaattcccctctgttttccatcttggaaaaaccagaactctgttttcttgagcaaatgacgttgccaccagccctgaagctccttttcctgggtttgtaggggttggtggaatcctggcagtctgccgctcttcctggcctccagagatcagggctgtgactttccatctgcagatggcagttctagctgcgaggttggtggccgaggaggacgaggacacagctcagggcctgtccttcaagggcttccgtgtgcagcagcagcactctgtaatatcatagatgaatttttgtcaaaacacagagaaaagttgattacacttctcatttattaaaaaaaaatgacttgatagcatagtagatggccccttatgtaagccacttagtattatttcaaaggaagcatgtctgtgagaaaaggggcaaccacttttctcatagagaagaacaggtttttaaatgaaaagatcaacaaatccaaatgctgtggtatttatactgatttagaaaggcagttgactttgggaggctttgttttctcatttcccttttctccttgacatttgacagacgtggttagcagagagctttctcattcggttttcctggagagagctctgcctcttgggcttcctgcatttgtatggaagttttaattttttttttttttgtcaaatgaaaggttgccatttcatttgttcagatttcccacacactgttgcagcaatctttagatttcaaattggctaattcagtgggtcacttaattcttaacttttacaacattttgagtctaaatacagcaaaattggtgcctttttcagctatttttcggcgttgctatattccaagccactgagctctgttttactctgacattttctcttcacttttgggattctgctcactgtgtttaaggcagctcgatagcattttgccaaaaaagagaagttagggctagtgtgagttgaggggaaggggatgtttctgttgttgctccttgctgagtatcttcagatatctaaaagaaacttgtaacacagcgtcagcctgacactggcctttgcagcatcagccttggttgactgtgttctaatagggatgcctgatctgtatcctctttaacttggctataagaaggttttggagaatgtatgtctgagggtgttttaaaagaaaatggaaacaaagctcctttttgccttgagctcatggtttggaatttgggcatttggaatccttcaagccctcctcctgggcagagctggagtccccttagggcactgcctgtcatcttcactacacagctgtgctccagagcagggagccgatggaaagggggacccagaacattccattctgcagaattcccttccagccgtctgtgagaaggcagtttgggacccttttagaagtttgctttataagtgaagaacctgaggccggctgtgttcatattctcagaacttggtgagaatgaggtactttaagataggctctaagatcagcagcatcagcccactcgggaagagctcctctgactcctggaggagaaagccagatgggggaagcattaagtcctgttttcctattgaaaactgaaattggccagccacagtggctcatgtctgtaatcccagccctttgggaggccaaggtgggaggattgtttgagcctaggagttcaagaccagcctgagcaacacgatgaaacctggtccctgtaaaaaatacaaaaattagctggggcatggtagcgcatgcttgtagtcccagctactagggaggctgaggtgggaggaccgcttgggcctgggaagcagaggttgcagtgaactaaggttgaaccactgtactccaggccttttttttttttttttttttgagacagagtcttgctctgtcacccaggctggagtgtagtggtgcgatctcagctcactgcaacctccgcctcctgggttcaagtgattcttctgcctcagcctcccgagtagctgggactacaggcacccaccaccacgcccggctaattttttttgtattttgttatagagatggggtttcactgtgttagccaggctagtctcgatctcctgaccttgtgatttacccgcctcggcctcccaaagtgctgggattacaggcatgagccactgcgcccggccaggcattttttttatgtgtgtctcaaataaaaagaaagaaaaccaaaattttacctgaaagacgagaaagttgatgaagattttgagaaagtgaggaagcaatggcccctccagggcacacccaggtgctgtcccttcttttctcctcagttctcttagctataaaatggggcttataataatcccttccttgaagagatgttgttaatagtacttagatgatttgctaacttatatcaagcacttactctgacccaggtatcggactgggtgcttgacatatattatctctattgtgttttgcagagtggctaagattttttttttttttcttttttgagacagagtctcgctctgtcacccaagttggagtgcagtggtgcgatcttggctcactgcaacctccacctcctgggttcaagccattttcctgcctcagcctcccgagtagctgggattacaggcgtgtactaccacgtctggctaatttttgtatttcagtagagatggggtttcaccgtgttggccaggctgctctcggaactcctgactccggtgatccacccgccttggcctcccaaagtgctgggattacaggcatgagccaccagagacggagtctcactctgttgctcaggctggaatgcagtggcgcagtctcgactcactgtaacctccgcctcctgggttcaagcaattctcctgcctcagcctcccaagtagctgagattacaggcgtgcgccaccaagcccagataattttcatatttttagtagagacggggttttgccatgttggccaggctggtcttgaactcatgacctcaagtgatccatccacctcggcctcccaaagtgctgggattacaggtgtgagccaccgcatccggccccaatttattcaactttggaagcgttggttgtgagatgtgcagttgggtgttgtcatggagaagaattgggcccttcctgttgaccagtgccggctgcaggcattgcagttttcggtgcatctcatcgatttgctgagcatacttctcagatgtgatggtttcgccgggattcagaaggctgtagtggatcacacaggcagcagaccaccaagctgtgaccatgacctttttttggtgctagtttggctttgggaagtgctttggaacctctttcggtccgaacactgagctggtcattgctgtttgtcgtataaaatccactttttgtcgcacatcacaatctgatcaagaaatggtttgttgttgcgtagaggaagagaagacgacacttaaacatgattttttaaaaatttttgctgatgtgggacccgcttaacttcccaatttgcttcaaatgccaaatgatcatagaatggtcaacattgagtttttcagcaacttcttttatggttgtaagaggatcagcttctgtgattgatctcccaactggtcgttgtcaacttctgatggccggtcattgcactcctcatcttcaaggctctcgtctcctttgtaaaacttcttgaaccaccactgcactgtacgtttcattagcagctccttggccaaatgcgttgttgatgttgcgagttgtctccagtgctttacaatccattttgaccttgaataagaaaattgctcgaatttgctttttgtctaacatcattttcacagtctaaagtaaacataaacagcaaggaataagtcattagcaaaaaaatgtaaagtgagaaatgcccattaaaataatgtataacataaccacatttatttaagaatgtactcgaatatcaaatgacaaattccaacagtgtaaaaactgtgattccttttgcaccaacctcatactagccaggcatctttctactgaaactggctggagaccatgtctcagtggtggagccggtataggaggcttcacatttcttcccctaggacacgctgtcattgtttaggtttcttgttttgttttttcctgaaacagggtctcactctgttgctcaggctggagtgcagtggcacagttacagctcactgcagctctaacctcttaggctcaagtgattgtcccatctcagcctctcaactagctgggactacgtgcttgtgccacacatttaggtaatttaattttttttttttttttttttttttttggagacggggtcccactacgttgtccaggctggcctctaactcctgggcttaggcaatcctcccacttcagcctcctaaactgctgggattacaggcatgagccaccacacccagccagttgtttagttttaaagatttaacctggttgaaatgtggctagtccccttatgcttgggtcacagaccaatttgggttaactttgccattgccttgcctgcagatcatggtgctgttgggatgtcattttgctgtaccaagggtaaacagtagctccctccttaacatcagtcctttagtgtaggacttctctattaagagctgggacactgttggccattaggattcctgttccttttgggtttgtaatagaagctactgtccccctgatcattactgattgaaacaagaaatctgttgttcctggatttctttcagttatcttaacatagacccttccaagtcttacagatgtcaagggtttttgaaagtaggatgtattctgatctttttcaagtggctacatcactgaccctcataaaataacggaaaatattgggagatgacttttctgcttaaatgttaggaaactaaattctcagtatactgcttctctagttgttaaggaagaaaatttctcttgtaaactttttgggagactagatttatttcctcccccactttttttttttttgaaatggagtctcgctctgtcgccaggctggagtgcagtggcgcgatctcggctcactgcaacctccacctcccaggttcaagagattctcctgcctcagcctcccgagtagctgggactacaggcacgggccacaacacccagctaatttttgcattattttttggtagagacggggtttcaccatgttggccaggatggtctcaatctcttgacctcgtggtcagcccccgcaaagtgctatttcctcccccgcccctgcttttttttttttttttttttttgagacggagtctcgctctttcgcccaggctggagtgcagtggtgcaatctcggctcactgcaagctccgcctcccaggttcacaccattctcctgcctcagcctcccgagtagctgggactacaggcgcccaccaccacggctggctactaatattttgttttcggtatgtttttgtatttttagtagagacagggtttcactgtgttacccaggatggtctcgatctcctgacctcgtgatccacccgccttggcctcccaaagtgctgggattacaggcgtgagccactgcgcccggcctatttcctcccctttttatgaccattcacagcctttggcataccattaaaatctgatcattgacttctaggtgggagaatggcatctctcttttctcctcatgataaggacttagtctgtaaaccttccagtccctccctaccctgaagcctcccatggtcttttctctctcccttgtgaaggaaaggtccctcttttaaagcattattcagaccggaaggaggacaaaatcaagacatgctgaaaaacccctgttttaatcaactccccttttaattttttcaaaagtcattattaggcatcgaaagctgttgaccttcatcaaacaatgagcacaggatttcttttccgcatcacgcgtggtgccactccagtgctatggtgtgatcagaacacccacattaataagaacattacttctctgaagtaatttgaatcttcatttagtaagactaaccatttcttcaaattttgttttttagtatacaggaaagttacaggttttttttctcttttatttgacaaatgaaagtgattttatattcatcacattacaaaataaataaatgctcattatttaataagaaaattcacatctgggctcagtggctcacacctgtaatcccagcactttgggaggccgaggcgggtggatcacctgaggtcgggagttagagaccagcctgacgaacgtggggaaacccccgtctctactaaaaatacaaaattagctgggcttgctggcgcgtgcctgtaatcccagctacttgggaggctgaggcaggagaatcacttgaacctgggaggcgaagtttgtggggacccaagatcacgccattgcacttctgcctgggcaacaagagcgaaactcccagctcaaaaaaaaaaaaaaattcacaagtacagaaagagatgctgaagaaggtaacagttacctagaaccccacccccagagataaccaccttgtggtaacatttatttctctgccgtagccactcttgtctgaaggagggttcatagtagataggctgtttttgttcatttgcctttaaaaatatatatattgtaaatattcttctgtgccattgaatataaaacatggtaatttttaaatttgtgtggtgtgcatgtgtgtgcacttttgggaaacttgtttatagtgactttcaaactgagcatttacaaagaaattaacagttgttgggtgtgttgaatgtgcagggttttgctgaacactttacaggggtgtctgatcgagtccatcacttcctgtgggcttgtgcaatagcctccttactgatactcctgctttcagtcttcctcctctgctagttatttttcatatgaaaacctgaataatctggctgggcgtggtggctcacacctgtaatcccagcactttgggaggctgaggcaggtggatcacaaagtcaggagatcgagaccatcctggctaacacggtgaaaccccttctctactaaaaatacaaaaaattggccgggtgtggtagcgggtgcctgtagtcccagctactcgggaggctgaggcaggagagtggcatgaacccgggaggtgcagctttcagtgagccaagatggcgccactgcactccagcctggtgacagagcgagactccgtctcaaaaaaaaaaaaaaaaagaaaaggaaacctgaatagtctttcaggaatgcaaatgagatcatgttgctcctctgcttaaaacctaatagcttctccttccatgtcacaaaaaaagccaagcatataaccaagatctggcctaggtcccagcatcgcttcatgtatcattggcccatctttctgtttcttcagtatgacatttgtttcagcctcagggcctttgcacttctttctggttcccctgccctgggacatttggataattgctttttttttttttcatttcaggttctagttcaaattgaatccaagtgaagtgaccccataatacatgttaattgtggaaaaaaatttaaatttagcaaagtaaagaatagagcatgtcactctaccatccactcaacatttttgtggttttttttcatttaattaattccatttattcattctcttaacacaatgcctacaatatgccaggtatattatattggtgttaggttgggctataatattaaaaaggacagtcatggttcttgcccttgaggtctgttagatcaggaattcagaagtgggttagctgagtggttctagcttgtggtctctcatgagattgtagacaagatttcagctgggacttcagagtcatttgaaggcttaactggggctggcaggcctgcctccaagatggctcactcacagggctggcgagcagtgctggcagttgacaggaggccacagttccttgccacacggacctctccacatgcttcttgcgtgtcctcacaacatgtcagcagctttccccagagcaagtaatccaagagatcacaaggcagaagtgacatgtctttataatcacagatgctaccctgctgttctgcagtatcctgttggttccccagtctaccctattcagtgagggagggcactcactcagcaaatgtgccgggaatcagtgggggcattttggaggcttgccactcgctgcctgtaaaatgagcatcataatggcacgtgtaccgctaccaccccctgccagcacaaggggaacatgaacctaacataatgggggcagggaacgggcagaagaggcttcccagaggagacacttaggcagagactgggccgctgagtgggcgtttgggaggtgagggtgttccaggctgaggggaggtttgtaggaaggtcctgagtgggaaggcactgcctgcagtagcgcatggcctggaggagacagcaaggcgggccagggtcagagaggccaggacacacacatcactgtgtccttgagggagatctttcttctctaggaatatagctgagcttaccccagaaaccaggggagaaaataggagccgagttttctggagtgcgtttcttctgtgaagtgaggtttgtgtgtaggaggcatctgtccagagcttttcaagttttatttcattattgctggagggaactagctctggtcctgttggttgggactgaactgtattgctgaccctttcccatgttcaaagttcccgcttccattgggggactgtgctttgtgcttcttcttgtaacaatgtgtttagcttatttagcagcatcagattctccttctgatatatgcattcgataaacctggacacctgtgcagatttctttttcgtggtggcactgtgttttcttttgcttgttatgcgtaaggtcagatatgttgtgttttgggtccctgacaccttgggcttggatgaataatgtcacttaagaggaggcaagtaaaaggccaggcacagtggctcatgcctgtaatcccagcactttgggaggccagggcaggtggatcacgaggtcaggagttcgagatcagcctggctaacatggtgaaaccctgtctctactaaaaatacaaaaattagctgggcgtggtggcgcatgcctgtaatcccagctaattgggaggctgaggtgggagaatcacttgaacctgggaggtggaggttgcagtgagccaagattgtgccactgtactccagtctgggtgacagagcaagactgtctcaaaaaaaaaaaaaaagaggatacaagggatacaagtagaatttgtagtgtgctgattaaccaaagacaagttcctccacccttttctttttggccagagttgatcattttcagaattcatcattttgtcaagatgatttttttgttgttaaatatgaataatttgctttcctctggacttctaaggcttcctgaaattacatgcaaacatttgtgcagtctcatgtttggttattggtttttgggtttgctatttttgggcgaggaggtccatatccttcatcagcttctcaaggggttttttcagaggtacaaggggaggctttggtttggttatgacagtgctacagccagcaacccgggggccacctgggtgctgctcccccacttcaaaacgtgtagctagcaggatggaaatcctgtctacatggaaatccttgtggtgttggataggccatgattcatttccctaagcctcaaatgcttctattgtttgtagtttttctcccagaatcttcatgatccatttttgtacattcttatggccttacgataaattcctagaagtggaatttctacatcaaaagaatagaaacttttaaaggtttttgatacatattgccagttgcccttctggaaggtctactgggtacgtcagtgtacctgagtgttaacagtgacggatcagtattcatttctcttataaggaaggaaatgaaagtcatttggtaacgtagaggcacaattagacctgacagcctttgtgtttctcttctgttctttaggccccccagttccctttgctgctttcttctttatgccacagatttaatgcttgaacacatattgaaattttggaaagttactgtgaatctaatggggcataataggcaggttttcttaatcctggcaatgaccaaactaatcacttgtctgtggtggcttggtggaaaaacggtttgtcagcagaatttggtaaagaagcagtcacaaggacagggtgttggtctcatatttgagtgcttccctgaggaaagaaaagataaagggaagaattgggtgaattcatcagactgtatttggcagatggagatgaagtgggtgcaggtcatcgcccacgacctgtttcccaggcttgcagagaaactgctgctcaggagcttgtgactgtgagggccccgggccgtggcatgcgttggtgcgctctcaagaatgcggccatggcactcacagacacataccaagaagcctcggcccccagtgcccccgccagcctgctcaggggcatgcggatgactggagcctggaaggcgggtcttgctgggcaggacagatgccttactgtcaggacagatgccttactgtaggcccaggaagagatccatgaccgcagacagacttctgcgtagggccctgaggaaagagtggtaaacatgcagtgaagggcggccccaccactggtggcttctgacagggagctggagggtgcaggtactggatgtgtctcattgggatacaaatgagtgtgccccgtggttaggaagatgaggaagtgtaggcacttgcaggggccttttcttttgacttagtgagttcccaccaaacctggccttgtctgtttttgatgccttaggacttggggacaaggccacagcctgtgaccccagcatcatctccccccagggccttgccaccctctagctttcatccttgcctcctcctctgccctctctttcttgtccgatacagtcacaagtgcctagaataaacctcacaccacccactgctctgctgtcagggctaccaccccggccccaccctgccttgccccggctctgatctcaaagacttcccagcctcctgttgccatctgggtctgtcctcctcctgctagcagagagaccctcccttagaaacttacatcagatcttttcactacccagtttcctgtccctcgatgggtacccatctcagttagagtaatgttcagcttctctccacagcctgcgtggtctgggcctggtttccctctcgaatttccctcctgtcactccctttgtttactgccagtgctttttcctcttagggttccctgggccctgcccttcactcagcttctggtgcctggctctttcagacccatgcaggccccagctcacatgacatcttttcggaaagaccttccctgatggcccaggccacagtacccacaccagcatcagctctttgtcctcttccccttttcatttctttgcagctcatgccatctgaaactacctcattcaattattgatagatctgtttggaattccaggagtccctttgcgatcccattcttctaaagattcacatggcctcagaatgccatgttacagtggagagtctgacttcttgttttctgagacggagtctcactctgttgtccaggctggactgcagtgacaatctctgctcactataacctccgcctcccgggttcaagcgattcttgtgcctcagcctcccgagtagctggaattacaggtgcctgccaccacgtctggctaatttttgtatttttagtagagatggggtttcaacatgttagccaggctggtctcgaactcctgacctcaggtgatccacccgcctgggccctccaaagtgctgggattacaggcaggagccactgtgcccggcctgacctcatatttgaataccgagttttagttctggaggagctgcaggttttatgaaaagggaacacatttgattcctcagagcagccacaggccagctctctgaagtaaagtgcacgtgtgcatgtgtgtgcacactcacacacacgtacacacacattcacaaataggacatctcttttaaacagaaatggccacctgcatttgagaaaataaagtttcatgcagaagaaagtgacatgttaaattcaatcatcaagatttagactggtgggaattctgcacaacaaatgacttggtttaattaacatggaaattgcgaggaaaaaaatgaagtggaacctatggatttaaaaattaggaaattttaagatttccatcgtaatttttttaaaacaatatattttacttccaaaaccctgcgttttcacatggtagctatctgctggagctgagtagccgctgctctcttgaacagcatcacccagatgggagagcccccttccccccaacccccatacactcctatgtgtacaacttcctgaaccctgtaagcattagagcttgcagcctctgctttttctgtttccttcttgatgggaagactggcagcaggatttacttggttgctacatttgtgaatttgtaaaataattcatgctctgctaggtctgtaacttgggaggcttggtgtgcacgggcatttagcagcaactcagagcgtatggaagactgtcactggcaagagcaaagtccccccaggacagagccagtgacgactagctgtgtatcctcagtctgatggcggtggaagtgaggcagcaccaaggagcagaaacaggaagtttccactgatgaccaccctgcccccagctaggctgaaaggcctccccagagcccttgcatcagcctggctttgcactggtctgggggatgttgcttgttagagccagtgaagaagaacggtagtaagttacctgatggccaaggctctgtctgaccctgtctgctgtcgtgttcctggcacagaatagtctttgttgaaggaacgaattagtgcatccttccaagccttggaggacctgtctataataggcccactctatagggtctttgtgagaattaaattaaaacccctatgagaaacctaactagagacaattggaagtaacttaaatatttgttcattgggaacagctacataattgtggctgtcattctgtacaacactctgtggctgttaaagagctagaggtagttttatgtggattgatgtgttcaatgtgttcaatggaaaagcaagggtaatataatcccatttatactacagagaaaaatcgggtctgtaaatatgttgagaaaggtctgtcgatagtggttatcttttgagagtggaatggatcggggtgggtatggcctggggacgtgagggggaatttttcactctttatttcacatacatctgtcattggcacagaaaattaagcagtaaacctaaagaaacagaatagtgcttgttgtatagttagatcaataacttgtaactattataaaaggtagttataaagttagtaagggccaaaggtctaactagagtaggtcggttatagaggaaaacagtttaatcagttgttgtttaacttttatggaatgcaacttctttagctttaatttggagagccaaactatggccctagtcttttttttttttttttttttttgagttggagtttcgctcttgtccaggctggagtgcaatggtgctatcttggcttactacagcctccacctcccgggttcaagcgattctcctgcctcagcctgccaggtagctgggattacaggtgtgcaccaccatgactggctaattttgtatatatatattttaagtacaaatggggtttcaccgtgttggccaggctggtctcaaactcctgacctcaggtgatctacccaccttggcctcccaaggtgctgggattacaggtgtgagccaccgtccccggcccctagtcttttattgtattgtattgtattattttttagtcaggtttattgaggtataatttacatatcataatattccccttctttattatacagttctatggactttgacaaatacatacacttgtgaaattgccaccccttttgagatacagaacagttctatcaccccctagaattcccttgtgcggcccttttgtagtcatcctttctctcttctcccagctgctggcaaccctgatctgtttttttgtccctgtagttttgccttttccagaatgtcatatcaatggaatagtacagtctgaagcctttgaatctggcttctttcattcaatataatgggtgaggagtcaaccacgttgttgcatgttatccacatttcctccttttgtgtctctgagtagtattctcttgcatagatgtaccacagtttgtttatccattcaccagctgaaggacagtgctccagggtcctagagcacagaactctggctttgttgtctttatttctaccagttgtctctctctctgtctctctctctctcttttttttttaaaccctagaagattattaagatttataagactgggtatggtggctcatgccagtaatcccaatgctttgagaggccaaggcgggaggatcacttgaagccgggagttcaagaccagcttgggcaatgtagcaagaccccatctctacaaaaaattgaaaaattagccgggtgtggtggtgcacacctgtagtcccagctactcaagaggctgaggcaggaggatcacctgagcccaggagtttgaggtgatagtgagctatgactgcaccactgcactccagcctgggccacagcataagcacttgtctccaaaaatgtttaaaagattgacaatacagtcttcttcagagtctccataggaaaggagcggcacgaaatgcaaattatttggaggttttggaggtttcaaacttttaattacttggcacatatagtgcttactgtgtgcaggcactgttctaaatattgctttcaaatatttaaaagtgcttagaacagttacagcacatagtaaatgctatatatctgcttgttaaataaataaaaatttaagtttccaaataatctgtatttcacataaaagagaagagatgtgggacaatataaataggcaggagaccagggttgtagacccggtactatcacattcccagcctaccccttaacctagtcccttgggtgaattaccgactctgggtctcacttactaacatgaaaggaggttcataatctgaatcctcctgaaggaacagataatatctcaactcttaatagttgaactctaaaatttggtcagtataaaagtaatgttataaaatgtgtctatatctgtttattttacattgtattgggcctggataattggtttcttcctttttacatgtatataacatcctattgggatctgtattaaaagtgtactaaaaacattcaccacatggtggtgctcccttcaaaagccaaactgaaaattgtaggccagcattgagtattaggcatggagttgataggggcagctgtatgtatgtatgtatgtgtgtgtgtgtatgtatgtatgtatgtatgtatgtagagatggggcctcactatgttgcccaggctggtcttgaactcttggcctcaagtgatcttcccacctcagccttctaagtagagtgccagtttatattctacatttgtgctttaagttttttttagggaagtagggtcctgtcattttattagcttgataacttatacagatgccaaaatacaggaacatttgttctttcttaggcattatgacatattcatgtacattaactgatgttatactttttaagtgttccaaatatcttcactcagaagtttatgtgcttgacaggaaaagaaaaaatacatctgtaaggaaagtatcataggtatttatccttcaaaagctgatgtttttatttatttatttatttttaacctaatgtgttcttaagtcatactgggatagcagcagtacccagcctaagagaagctgcagtatagtttccttggtcaaatgactttttctttctttctttctttctttttttttttttttttttgagacagagtcttactctgtcgcccaggctggagtgcagtggcagaatcttggctcactgcaacctcctcctcctgggctcaagcaatcctcccacctcagcctcctgagtagctggggctacaggcacgtgccaccacgcccagctaagttttgtattttcagtagagatggggtttcgccatgttgaccaggctggtctcaaactcctggcctcaggtgagccgccagccttggcctcccaaagtgctgggattacaggcatgagccactgcgcccagccaaaagttggtgtttttaaaaaatgcttcctggtaactgccttagggagaataatgttaacatttcagttgtgattctcttgaagcacagtatttccctgccttttagatttgaaatggatacttctaagcagttgtgactggctggatttcagtcatttacatcggaacactggtctggtcagctcacctgcatctttggtagagagatatctcccaaacatacactctccctgaaggattttcatccttcatatgcttatcaattcccttgccaagtatttactgtttgtccacatgagtacaaggcattgagcttgtgctactgtagactcacagatggtcatgattttcaggaattgaatagagaagatgaaacactgagacactggattcaaatgctagaccttactgggttgacgttagtaatagacatgtgaagaattatagcggttgagaggaaagagacatctcctcactagggtgactggtcagggaaaaagatgggagtggtttttggtgggagaagaggaggagacgggatctgggcatatgaagaggcctggggtactgaggtggaatttcaccacaccccaaatctgttgaaaagaggaaagtgtacaggcaggagacacagaatctggccagagtgaatgtcctgagcaagggcatgggaagaggaaaacgcagggcacagggattaggtgaggatccaactgaatgcttgcccaaggggcttcactgtcgaggattttgactgagatgggggcaaacatgatagacaaactttagggacaatttagcattgtcttcaaacacaggtatgagggagacttttgctggtgataggacagattatcctgaaaattgacctgacaaaaatacttagacctgatccctaaaatataataaacatctttttaatgaatagctgaacttgcaagaaaaaaggtaaatccccaaggcctataaaataaaagatgagctggccgggtgcagcggctcacacctgtaatcccagcactttgggaggccaaggcgggtggatcacctgaggtcaggagttcaagaccagcctgaccagcatggagaaaccccatctctactgaaaatacaaaattagccgggcatggtggcacatgcctgtaatcctgctactcgggaggctgaagcaggagaatcacttgaacctgggaagtggaggttgcagtgagctgagatcgtgccattgcactccagcctgggcaacaagagtgaaactccatctcgaatttaaaaaaaaatttaaaaaataaataaaaaataaaagatgagctgaaaataagaaagacaagccaaaactgtaaacgtcttggcattgtttgctaatttcagtaatcaagatgcttttttcccccaatgttttgtttttgttgctattgttttgaaatagggtcttgctctatcgtccaggctggagtgtagtggtgcaatcatggctcactgaagccttgacctcctgggctcaagtgatcctcccacctcagcctcctgagtaactgggactataggtgtgggccatcatgcctggctaactcttttttttttttttttttttcattttgtagagatggggttttggggttttaccatgttgcctaggctggtcttaaactcatgggctcaagtgtccttctgtttcagcctcccaaaatgctgggattacagacatgagccattgtgcccggctccccaatagttttattgaggtataactgacataaaataaactgcacatatataaagtatacaatttgataaattatatgtatatgcccacaaaacgatcaccacaattaagatagtgaaaagcccatcatcctcagaagtttccttatgattctttgtaattcttccctgatttacctccttcccggtccaatacttacctgttttctgtcaccataaattagttttcatttatataaaattttagaaaatacagtcatatactatgtactcttctttgcctgacataattatcttgagattcatccatgtttttggatcaataatttgttcctttttattgctgagtactattccattgtgtggatggaccataatttgtttattcatctgctgatgggcatttgtttccctttttgggctaatacaaataaagctgctagaacacatatgaacatatcttttttacttttattttttgcctttttcctgcagtatgagcaaagctttgtgtggacatttgctttcttttcctttgggtaaataggagcaggatcgctggtcatatggtagctgtcgatgacacttgagtcttaagggctgctgtttggggaactggagacataatcttgggcctatgagtagacagggacttggaattcagactgccctataaagctaagatcattgattggctacactttgagcaaaatgatagactagaaagaataagctgttggcagaatatttaaaaaagaaacttgccaggcacggtggctcatgcctgtgattctagcactttggaaggctgaggtgggcggattgcctgagctcaggagttcgtgaccagactgggcaacatggagaaacctcatctgttaaaaaaacaaaaacaaaaagcaaacaaacaaacaaaattagccaggcatggtggcgtgcatctatagtcccagctacttgaggggctgaggctgaagtatctcttgaacccaggaggttgaagccgaagctgagattgcaccactgcactccatcctgggtgacaaagtgagaccctatctcaaaaaagaaagaaagaaaggaagttagaaagtgggggagggagggaaggaggaagtgaggaaggaaagaaaggaaagaaaacaaagagaaagaaacttgtctgatttggtctgcactttgagtgagaggaaacaaaaacctcccgagataacttttattctaagcatgccttcttttaaactttgtttgaatttacctggcctctgtagtttgtgaaattccaagaagagacattattttagagagatactaggttgctagagttcctagattactacagttcctagttagctggcagaagtcaatgcatatcctcttggactatatctatctttttctcagtcttaacaccagattcccaaagataaagcttctccaaacatgatctcacaatccaaaactaagaacatgagaaaacaaacaaccttgcatcacagagcaggaaaatgaacagtagaactatagtactttatagctttagatataaaaactgtcagattcagaatataaaatactggtttaaaaacatttaaagaaataaaatgtgaaatagaaaacaagtaaggactaaaatcctatgaagaaaaatcaaataattgaaaaagaactaaaaaagaaatgaaaactacgatcagtgaaattaaaacttcagtggatgggtttaacaagttagacacaactgaagagagatttagtaaactgagggataaagctgaagaaattatacaaaacgcagcatagagagacagaagtctaaaatataagcctataaggagagagaaaagaagtcaatagagataacagatgagagacaatatttgaggagatattgctaaataatttccaagaatagtgaaaaacaagaatctttagattcaggaatcagagcaaatcccacgtggaattaaaaaaaaaaagtcttctccaaatataaggccaatagaacaccaaagacaaaaataagatcttaaaagcaatcagagagaaactgattacctcccaaggaaccctattaaactcaaaggagacttctctacagcaacgatggaaaccagaaagaagacagtggaacagtatcttaaaagcgctgagagaaaaattattgtcaacctagaattttaaacttagctaaaatataatttagtaatgagagcatgataatgacattttcagataaacaaaaactgatgtctccagcacggtctcacaaaggaacttttatactttcaaaaaagagaaaatgatccaaaaaggaagaatgtctgcaatgcaagaaagaatagtgagggaaaagaaaaagtggaatgaatagagaattagtcatgtggtatcacatggcagctcactcaggaatcataaagctggccttgggataacagagctaaactttagagtcctgagtcctgttaatactcaatcctctgtgaaattcaattaagtgagcttcaagttaacctaaaaagctgtggtgaggctgggcgcggtggctcatgcctgtaatcccagcactttgggaggccgaggcaggcagatcacctgacgtcaggcgttcgagaccagcctggccaacatggcgaaaccccgtctctactaaagatacaaaaattatctgggcgtggtggctacttgggaggctgaggcaggagaatcacctgaacctgggaggcggaggttgcagtgaccagagatcgtgctactgtactctagcctgggcgacaaagtgagactctatctcaaaaaaaaaaaaaagcagcagctgtggtgactcttttcttgaggtctttgggggctgcctgttggtggacaggctggtgtgaagttggtagccctggaggagctggggggagttgcagggctagtgtagacaagctacagaagccacaagggaggtgctgcttagagggggctctttattctttgtttggttttaatttgagacgggttcttcctatgttgcccagcctggtcccaaacccctgggctcaagcgatccttctgtcgcggcctcccagagcgctggggatacaggtgtgagccaccatgcctggcctctttactcttattaatttaatgctggttttcctagatctttgtctttttttctggattttgggagatttctttccttgagtatttttcacttattttctattaattttttattttggcagtcatactttttaactaccacagctcttatttaaaaaatccttctcctagtatcacattcttgatttctgggcatataatctttatgggtctctctgaggatatgagttacggttttttgtagtttggattatctccagtttcctgaattatctgtttccttcaggataatctgttcatcttggtctttttctgtgatgctctaggctttcctcagcagtctggtaatcctggttgtccattcatgcttaagaacatgggaatggaaggggtgttgggagtcctatatatgtggatggggttgtccattggctggtttcagtattggactaatgagtagaggaatcaaggaacctctcagggctttgtgttgggacgctgacacactgcattagtaccttctagactatgagcaggggaatcgaggaacctctcagggctttgtgttgggacactgactcactgcattagtaccttctagactatgagcaggggaatcgaggaacctctcagggctttgtgttgggacgctgacacactgcattggtactttctagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttctagactgtgagcagaggaatcgaggaacctctcagggctttgtgttgggacactgactcactgcattagtactttctagactgtgagcaggggaatcgaggaacctctcagggctttgtgttgggacactgactcactgcattagtactttctagactgtgagcaggggaatcgaggaacctctcagggctttgtgttgggacgctgacacactgcattagtactttctagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactttctagactgtgagcagaggaatcgaggaacctctcagggctttgtgttgggacactgactcactgcattagtactttctagactgtgagcaggggaatcgaggaacctctcagggctttgtgttgggacactgactcactgcattagtactttctagactgtgagcaggggaattgaggaacctctcagggctttgtgttgggacactgacacactgcattaatactttccaaactttatgttcttcagagaagacccctccttgctgggggtgaggaggtggagaagtgggtcaggcgtgtgccttggctggctgccgcttcatatacagacgtatgatccctggttttcccccgccctctgtgtctcactcccttcctccactgcacttgccatcttcatgtttggggctcttctgggcagatgggcttgatcctcacctgtgaattcctctgctctcctttgccaagcaatgcttgcccatccactttcagatcccccagtttgttgaaatatctagtatgatgacagcttctctgttctcaccattgtcgtggtttataccttttttactccttggctgtaatttaaaggggtcacaggcaggagggggatgagtgcatgtgctcagtccaccatcttgaccgggagccccagaggcatcatttcaattcctgtgatattatggattcctacgggtaggaaaaacacagcccattcaaccaaatatactttaacccctagagatttagctttaacttgtttagaattgtttaaaagtcccttgtattttgcagttttttcattttctccttgaaagtaaaaacatttgtggcaaatagggaagaaaaactttccagttaatcgagaattaggataagtgagatttaaatattatcagatactgataagaactatggcttttaaagaatgtcgtcttagaatcagtttctaattacttgtgtgcagaagagtcctgcagctgtgaggtgatcacagtctttggcctaagccactgccaggtgagtgaaagccaatctggagtcacagagtggcagcgactgcaccggagatgtgtgtgccatttgttaagatgagtcaaatggtagttagggcaacgaagatccacagagggagaaagaaagatactggaaaagcagcagcacagtttaataacagtcatcgttcatgatggcaaggttgtttactataaaaattccatccttcttgcctctgtgctgccccccaccatttttttatttgacattagggcttgctgatttatggcataacgcagtacatttcacctctgaaacaaagtctgtaaaatcttgagatatattaaagtctttattccccaacgctaaagacctcatactgtttagtcctctatacatttagccctttatgcttggggagggggaggttataaatttctagagggaactggattggcaatggtatgtttgatggtgaaatgccttgactaaacaaacaaggctgctccagaaacgcacacacagcaaacctatatgccatataagtaacgtgttatgtggggagttactttaggtttaaaacaaatgtcatactcttgatgcttttaggtagctattatcttggtaaggataagacagaaatatggtgaagttgcatctgattttgagggatactgcgggcaaacctgacagctagcttggttactagaggtttaattagttacagctgctctgccattgtattaatagagccactctgctttcaggcaccatggatgccttttataatttggatgttcttaaaaagagcactgtgtgaaagtgagcagccctgggccgggcgcggtggctcacgcctgtaatcccagcactttgggaggccgaggtggctggatcacgaggtcaggagttcaagaccagcctggccaagatggtgaaaccccttctctactaaaaactacaaaaaaatactccgggcgcagtggcaggcacccgtaatcccagctactctggaggctgaggcaggagaatcgcttgaacccaggcagcagaggttgcagtgagccaagatcacaccactgcactccagcctgggcgacagagtgagactcagtctcaaaaaagaaattgaacagcccattttgtgaaccacttcaaaaaaaagcaaacacattttcctctggcttttggctgttttaggaagaagccatacggtgaaccaggtgatgctgaggttatctggatccaggccatgcagatgaagccatatttacctttgtgatattggggctgatcttggagctgtctggatctgaccagtctccagatgaaaactcttgcaactttcgtttttggatagtgctcacctcgtatctgtactcgtacctgctatttctaggcgaattgtcccctttctcctccctcttccctcatctccctctctcctctgcctggctgacaccaggaaggaggagttttcttttatttagataaaaaaaagttgagaggagggagctccagaaatgtgggatactcagcactggagacatttgggctggaattcttgtttccattcttttcttaccatatgaccaagtaagtccaagaaagtagataggattctgagtgggcagtgaaggtggaaatgtggtcctaaagagaacgggcaaattaagaaaagattgttttaagacagtcaaattgttttgcctgttgaagaaggtgatcagaccctaatgaaactgaaaatgaggagagtgttcccatctcctgcctggttctagcgactctgcaaatgggtgcctgattggtctgttggctctgaagccagcctttgctggatatattcagcctgttttgaagttgtgcagagaacctcacttgcgtcattctgaagacgcagtgagtcaacgcagtcccaagagagcagtaatggccccaaacagaaacttggaatgaaaaatagccatggatttaaagacatagcacattcttcctatgacttcatttggtaatggtaagattaattcacagaaaacccttcttgagtggcgtaccttaaacacatgtagaatgatttttttctttgcttttcccatttagccttttgaaacaggatacacagtagggtgattggtttgggagggcactggtacagtaattctccacctctcacttgcccgtgtgggtgccccatccccaccctcaggcacacacgcactcttagctgcttttggactcctcccgcaatgtcacaatagttttctttgaacattcttgaccctcagtcatgttgacatgcgtttggattttcagtggagaagaattgccagagaagaatcttcctctgattttaaccattgaccatatttatatatgcagtttcagcttgacttttaaattgataatcttttaatagaattccagataacatcttactgtaacaaacaccaaggggattatccaaattcctatttgaaaatatgtcttttatattaccagatttgccagctgcattattatctattagtgtgtactaaaagtatattattttggcttattttgagattagataattcccagtggaattctccccttaaccatctaaatctgtattttttttttccccatttagtttcctaaacagtgaggcttctgggcaggaaatgagagaagaggaggaggtaatatagaataatgcagtggctttcaagcattgtgacccatatgaggaatacatattcagttatgacttagcattcacatatgcacacatacatgtacgtatatacatcacattcacacatatgcatatatgtacatatacagctgaagaaggtctggattagtacttttccttattgtggagcacagtgagtgatattttctttttctttttcttttttttttgagacagtcttactctgttgcccaggctggagtgcagtggtgtgatctcggcttactgcaacctccaccttccaggttcaagcagttctcctgtctcagcctcccaagtagctgggactacaggcatgcgccaccatgcctggccaatttttttgtatttttagtagagacggggttttgctatgttggtcaggctggtctcaaactcctgacctcaagtgatccgcctgccttggcctcccaaagtgctgggattacaggcgtgagccactgtacctggccgatattttctattttatttcattttgaaaaagataggctgtgactcattagtagtggatctcatgactaagaatggatcctgacccaagtttgaagagactggtaggggtaaatttagagcctggggctccaaagtttgtctacccagttttaaatcctggctttccccttaacttgggtgggatcacaccattaaccgtgttacccctctgaagctttggctcccacacctgtgagatgtgaatgttgataacacacacccacctcataggattaatgagaacatgccaagatataatgcgctgaaggtcttagcatgcctgcgcagagccccagcatctgttagctgctgctgctgccgctgtggtggtgactgtccttgctaagatgctgcagctggattggcttcgtgggaagttgtggaattctgttccctgaggatgttgggaaggacagattgtacttaccaagagcatttattgttgtttttattttcttaaacatttccaatgaaaatcatcaaacctataaagttgaaagaacaatgcacctagattcatcaactcttaacacttgctatctctcttacatagaaacatttcccttttaccagtccacttggaaattggctatatactcacgatagccaagaacaagaacactctcttacaccatcacatcattgccacacttaaggaaatccacactgatccaggaacattatttgatatacagtccatattcagaatcctccaggtatcagtaatattttaattatgacccatttggtgaatttaagatggattagatggcctgtggagttattcatggagctgaagacttctgtgaagtaaaaaataaccacccagtgttaagtgtaactctcgtgtggaatattaaatcaattgtgtgttttttttggcatccttgatgtgaactctggagacctgatgagatggaggctgtgattgtttactctgtgttagcttggacacttagcttggcagtaatcacaagagctttagggagtgcatcctttgctagttcataaagatgtattctgataacgggggaccaaaaggatatatcctgaattgcaaagtcgagcagtagattacatttggatttgaatgtaagtggctgtgaattagaaatatttgttggaattagaaagtgtctaggtaggaatgtaaggtctcccctcaaattgagaatgacaaggctgtcttctaaggacagaatttaaggtgaacactgtggaagtttgtgcatgtgttttttgtttgtttgtttgtttgttttttgttttttttgtgacagagtctcgctctgtcgcccaggctggagtgcagtggcgcagtctccactcactgcaacctctgcctcctgggttcaagcgattctcctgcctcagcctcccgagtagctgggatgacaggcgggcatcaccacgcccagctaatttttgtatttttagtagagacggggtttcaccatgttggccaggctggtctcgaactcctgagctcaggtgatctgcccacctcggcctcccaaagtgctgggattgcagggattagccacagcacccagcttgtgcatgtgtgtttttaagaaaacgtccacaaggtaaggaaattcaagcaaccaagaaaagacgcttgataaacagtaagtcccatcttgctagtttcttctgtatttctccagggccactttaattgattctaaaatgtacattatttctcatttttaaaaaaaatctctaaaatcagggtacatcttaaaagcaatataatgccatggtttaattggcacatgatttagtgatacataaaataaaggcacctcttgcagtggcatcttcgatttgaagaagtataatattctacgaatatacaaatttctgtgtttttttgtccccccaacccctgcccttttaaagacatatagtaatatagtggggttataggtttatatactgctacttagctgtgcagagaaattacagcatttaaaaaaatcaccaatctgtcttcctcataagtcatcatctagaaatggggagaagcaaagagtggtattttggccagttaataaggtcttatattcttttggcttaaacagtatcttttgggtaaattctggattttttcatatatcctgccatcccccattaaaaaccagcatctggtcttgggggattgtgagatttttgtggaggtgagggaggccctggcctatgcttgctgcctttgctcatctagtctggtctggtctggtccctgggcctttcgcaggtatcccctgaagtgtggttggtggtcttgaatttttttcttttgtctccatcagggccagggaactgtccttgcttccttttggtacattcaccctgcagcagatgtcatggcttccaagtggaacttcactctctttcttactagttaagctacaggaggcttagagtgctaaaaccgagatgcttcccctgcataaggccatgcaacacggccattttattctgtagccatccgtgttgggatgagtggaaggttgcatctgcgaggtggtcttctcctagagtttcaattaggaagtggggcaaaagccccagtgccttcccttcaacctgacgaccagtctaccctctccccacctgtgctagttatcaatttcttgcttgttatctccaaatccattctgctttgccatgtttcgtgacatgggaactggactctgtcaacagttttcctttgcctgctggcgaggtgttaggctttgtcaacagagtgctggagggacatggcaaggtcatggtgggaggagggcgtcctttcccagtgtgctgattttcactggtgagtgagtatcagtggactggcgtgcaagatgcccagaaacacatatcagccatcatagacagcccagtgggtggtaccgtgcaccagctccaaccacacacaccctgcagggagtttctccaccacgtggtgggctgctgccctgggccagctctggatcacgccctctgacaagcatgtttgccaccggcatgctgtgtgttcctgtggagctgtgccctttctgaagagtctgaatctcagctttggggttgggggaggctctcctaagttcttagttcctccctcttcactctacctgccctttttaagacacatagtaatatagtgggctctaagtagtagacactttgttcatttgctacttctgtacccctgggtcctcttttactcttctgtcatttgttaaaaatctcggccgggcgtggtggctcacacctgtaatcccagcacttcaggaggccaaggcgggcagatcacttgaggtcaggagttcgagagcaacctggccaacatggtgaaaccccgtctctactaaaaatacaaaaattagctgggcatggtggtgcatgcctgtaatcccacctactcaggaggctgaggcacaagaatcgcttgaacccgggagatggtggctgcagtgagctgagatcgtgccactgcactccagtctgggcgacattctggaactctgtctcaaaactaaaaaaaaaaaaaaaaaaaaaaaaaaatctcctgtgggacttcagtctgtggaggttattgagtgatggcacagaaaggccaatcccaataaaagaaaatggaaaatgtttattacttccatttccaagaggggagcatgccacgccacaccacacaggcacatggggaagcaccatccacagggcagaaaggagctgggggaacgcccaggccagagcctttgttgggcttctgtgggaaaggccagacagggccagggaaacatctgaggattggctattttggataattctggggggccctggggcagagggccgtccctcgttgtctggttcctagctctgggtgatttagggtaggagaaatattggctctgtgtgtgagagttagataaggaggtggttcagagaatgggctctgggtggcaggggagacggaaacagctttggctgtgtgtgagtttgaccctgtgattagactaatggatgccaaatagatgaatacagaatctcagaaaacacagaacgctctcttagcagtatctactttttgttaataattcttttattaaattttccctattgaaatgactggtgtggtttctgtctcctgactggtacatcacctcttcctcggaatttgcgggcagggaagtgatgatacatgtttgactgcctcctactctttgcaccctgatgtgagggaagggctggacccttctacatctttctgtctggatgaagctcctctgctgtcatttcctcctccttccctagtgcggcaagcagctctgccagcttgtcatagaagggcatttaagtgactttgccaacacaaacagtactgcaatgaagatatgccacactttgcaattagttattcactttaaagttctgttatgatatagtaacttaataagtgaaaaaaacatcttggaccaataaggatggaagaaaagtatcggaaaactagtcagaattaaaataaggactaaatcacgacttttatttctgtgatttctttttgtatttttgaagctcttttcttaggtcagggccaccatggctttttgttgcattgatctctttatcattatatgctgtttctccttaggctctgcaatattccttgctctgagtctactttgtctgataggcacttcagctttcttttgatcacgcttgcataatacaccttttcccatccttttactcgtagcctgcccgtgtcattgccccagtggggaactgctgttgctctttacttggagccaggctcatggtaagaggatggggactttcttggttctcttagtctgactccatcttaggcaggtactgtgtgcctggacttcaggatagggctttcttagcattgtgtgctttcaccctccatgccacctggactctgccttctgtgtgtgtgtttgtgtgtgtgtgtggtgtgagctcccgtgtgagagagaatttcccacgtttccccccaaccccacccgaagctgacttttgcattgtatcagtgcagaatccagcagacgatcatatttgctggtacctcacccccaggagcagcagatctttgcctgggtcccggggacagggaaggtttcttgcccttcccccagtggattacggcttttgcattaggtctgagagaggggctcaggaaggaggcaagattttacccgagtccggtattgaggggtgctctctccagcctcgtgctctgctcccagtcgtcgtcacgagcacctggtagtggcccatggaaaagggtttgcaagtgagttcagacaggaattctagtgttacaccagcccatgctcagctccataagaattcattaaaaattgagatgttttcccgtcacctgttgacatggcagcctcatcttcctcctgtgctctgtgaagggtcacagggtttgcgtgtcccatttctccttggagggatttgtcactgattagaattcagttcacctgatggccttgtggcctcagctctctgattagctcaagaaaagttaggattttgttgattatctggctttttctttttgttgggttgaaagttctcttatggctttctgcatcttaagcaaggggagtagaactctatttcttcacctgtccctcagcagaattatgtaagtaaaataaaatttaggttcctcacagatcagtgcagtttgctaatacaaatactgtatgtatagttactctgttttccacatccaccattggtttaagtttgaacacccctgttttactttgtattttgaaataatttcaaacttacagaaaatttacaagaatagtacagagaattcctacatgtcctttacttagttcgagtcatcaatttttaacgtattgctacattacatttgctttaccatttccccccttctatatgtgtatgggtataaaatttgtttttcggaatcatttgggagtaggtcacaacattttgtccttttatcccttaatatttcaagtgtatgttgtaagaacaaggatcttctcttatgtaactatagtataattattaactttaggaaatttaactttgatagaatatttttatttaacctaaaatccgtattccaatttcctcaattctcccagtaatgtcctttctagcaattacccccttgggtgtaggatccagtcctggatcatggattgcattaatttgtcatgatctttaatatcctgtaagctggaacagttcctcagtctctctgccttgcatgacattggtatttttcaaggacatggagcagttattgtatagaatgtttttcaattttggctggaacatttcagtttcagtttgtttgatgtttccttactattagattcaagttacacatttctgttttagaatattacagaagtaatgctgtatctttctcatggtgttacatccatttgcataccttgtctttctgcctgtcgttaatgatattaattttgattatttagtcaaggtactgtctggttccttcattggatagttgctagttttcctcttgcatctatttgcttttcggtttttgttttttcccttaactttttctccctgtgatttcctgaaacctcttgcatctaaaaagcaatctgtggggagacattttgtgaccatataagtaacctgctcctcatgaaacataaaatacaaaccttgggttctcttagagtggagaaagggatcagtgatccaagaccgtttctcataaagctaatacctcagagaggctacaccatcagagagaaaatgtacgggggagaagcacattacacagtatcaatcagaaaggaatatttctgtctgagctttcactttgagtggagggcaaagaaaaaaaatcacatgagaacttgtggctgctgaccagctgctcccacatgggtgtagaaactggttttatcctatctgtgtgacctccaatagctgcaagttggaaatcttgatttagagtggacctaggtttttaccatccctgggtgcttgacaaaagcaagtttaagtcttccctaactcagagtttccatagatcattgcagccaatatgaacacaccaaaaaaggacatacacacacacacacacacacaccctgaaacaagatatcatgcgcaagagtcagtagaaacaatagttgttcctgacaatttcagatattggaaatattgaatatagactataagttaatttactacctttggggaagcaaaagaaggaattgaaaatatgaggaaagagagagatacatcaaaaacaaccaggcagttttatttttaaaaatcaaatataatgttcagaagtaaaaagcataatcattgagataaaaaatttatggattggttaaatgttagaatagaaacagcagaaaccagaattagtgaactagaagataagtctgaagaaataacacagactgaagctaatagaaacaaagggatgtaaaccacgagaggctcagagatatagtgagaaggtccaacttatgtctaattggagttccagaagaagatactacagggaatggcaaagagagaatattgaaacagataatgagtgagaatcttcacaattgatgaacaacaggcctttgtctgtcatttgtggaagctagcacaacagtttaaacggaggcccataggccatgtctaaatatttaaaagttacaaatgtgacagactgtgaaataaaatatgtctatactcctaccttgacaaatatgtctctctgatactctagaagatgaggtttaaatgtagagttcttgaactccacagagctctatgctggcacatagcagcacagagtgagccagaccttcgcctgtggcccccacccttttgtctttcttcccgcagctttatccatgctgtgaggggcctcatgcacacatgtgtacatacttcagcctgcatatctaagctgtgttcacgctcctcacaagcatgcttgtaggtggcaactctggcctatgcccgtatgctggtgcattctactttctttcatttttattttatttatttatttatttatttatttatttatttagagacagggtttcattctgttggccaggctggagtgcagtggtctgatcatagctcattacagccttgaacttctggactcatgcagtcctcctgagtagttgggactacattaattaccacacctagtattttttttttatttttattttttgtagcaacagggtctcgctgtgctgcccaggctgggtttgaactcatggcctcaaacactctttctgcctcagcgtcccaaagtgctgggattacaagcatgagccactgtgtcgggccagcattccactttgataatagacctgtggaaaaggcccatgcaagtcctgaatgtgggcatggattcaattaagtagggaattccaggatcctggatacctagaatatggtgatcagactcagggtgggtgcatctccttgggccttcaggccccttgccctgtggggagaggtggagtcttttaaattatagaatctagggtaggggcctctcttggaacaggttctaagggtggtaatgagagacaaaaattctctggttcaggaagcccatcaaattccaaagcggcaaagaaggaaaggaaagaaattcatgtctaaacatatcagtaaacctgtgaacctatagaacatcaaaaccagaaacgattcttaaaaataggaagagagaaaagacagattacctacaaaggaacaacaattcatatgccagctggcttttctataccaagagtggaactactgaaacagtgttttcaaagtaggcagtgaaaataactgttgatctagaattgtgtagccatgaaacagcctttaaataatgagaacgaagtgaaataaagacattagataaataaaaacaaaaagaatttactgctgagaattcatcactgtgatggttaatattaggtgtcaacttgattgggttgaaggattgtttctgggtgtgtgtgtgagggtgttgccagaggaaactgacatttgagctgggggactaggagaggaagacccaccctcaacgtgggtgggcaccatccagttggttgccagtgcagctagaacaaagcaggcagaagaaggtgggataagcttgctgagtctcctggcttccttccttctcccatcctggatgcttcctcccactcctcctgcccgtccacataagactccaggttctaaggcctttggactcttggacttgtaccagtggcttgccaggggctcttgggcttttgccacagactaatggctgcactgttggcttccctggttttgaggctttcagactcggactgagccactacgagctctctttcccggcttgcagacctcatatcgtgggactttgccttgtaatcatgtgagccagttctcccaaataaactccctttcatatatacatatatcctattagttctgtccctttggagaatgctgactaataccatcactaaagaacatcctcaagaagaagggaaatgacaccaagaaggaaggtttaaaatttaagacaacattaagttgatccagagagatgcattaacttgcctaaagatcacacttggttcagaaccaagcctagacttaaaccgagacaggatgcaagaaagaaatcaagttaacgacagaatttcattttcacccaggaagtagacacagggtcccttggggctcattttgggagaaggcctacctttttcccaggacacaccaccatttacacgtcgagtcttacagcctccaggactttaagcttcccactgctaatgtgtcatttttcctttctcttgccactgagttgtttgctcaactagaggattttactttctgcccttcaagttcacatggtagctcgcatggtaacataagtgagtcttggcagtgttgccagggacaggatgactttaatttcattcctcctcatcttgatgctttttttccctttccagttcccatcagctacttccctacccctagtggtcctatgagtccttcagttctccccctttctccatgacacaccaggagccatgtcagatgtgatttctgacctgggaccctgaatggcacaaggagaagaagtacggaattgggggagggtataagagggtttaagatgcgtgaaaaatgttgagtaggacatttcaagagatagttcaaataatatggtaccttttgtttacgtcaccacacttggcaaatttgatcgtatgacatctcatttgatgtctttgagatgacagatgttgtccctactgtagagctaagatcctcagagaggttaaatgacttgcctgtaatcactaagttagaaagtggcagagccccagaactaccccatgcagctgctttctagtttctaatcaggtgctttttcactaacaccatcttgcctctacaaactgacggcttacaaaatgctaccaaagggtaatactttttatttttgagatggattttcactattgtcacccaggctggagtgcaatggcacgatctcggctcactgcagcctccgtctctgaggttccagcaattctattgcctcagcctcccgagtagctgggattacaggtgcccgccaccatgcccacctagtttttgtatttttagtagagacggggtttcatcatgttggccagactggtcacgaactcctgacctcaggtgatctgcccgcctcagtctcccaaagtgctgggattataggcatgagccaccgcgcctggccaagggtaatactttttaatcagccaataagattcacatggaatttgcttatttttagtattcctgtcagtattgatggatttctttaaaagttttttccatagatctatttgcccatcacctctccaactcctccagcatctgccccctttcttccgcatacatattgtgatgtctaactgggccttaattatcatgaattttaaattggtggtatccatactaatcaggatttcctgtaattggaacattcttcacacttttgatatttgctgattgtcctctctatgcattttagaagtttcagactattttttctgagaaataactagagtctgtgcaagctgtgtcgtacattttgactgcaattttagtactgagtgttgcttgcttgaaaagaggcaggtaaaccaagttattgagtgcagtttcaaacacaagccaccactgttccatagatcaggggtccccaatccccaggccacagactggtcatggtctgtggcctgttaggaaccaggccgtatagcaggtggtgagcggcaggtaagcaatgaagcttcatctgtatttacagccgctccccatagtactcattactgcctgagctccgcctcctgtcagatcagtggcggcattagtttctcataggagcatgaaatctattgtgaacagtacatgcgatggatccaggttgcgtgctcctagtgagaatctaatgcctgaggatctctcattgtctcttatcactcccagataggactgtctagttgcaggaaaacaagctcagggctcccactgattctacattacagtgggttgtataattattatatattacaatgtaataataatataaataaagtgcacaataaatgtaatgcacttgaatcatcccagaaccacccctcagtggccccatccccagtctgtggaaaaattgtcttccacaaaagcagttcctggtgccaaaagggttggggactgttgccattggatcatgacacattactatcttgttgaattaaacgttgcaaactgcaacgtttgtaactgccagtaggcagtttttattttatttttcattttttatttatttttttacctgtgagcccacatccataaagttagcagactatgtcatagtcaagagactttgctttatgaactagctgatttagtttgctcacaagctttgaaagagtctttttttaaaggccaagtttaagacaccttagaccatagaaatatgtgtatttcctggccattcgatcatttgaaggccagattttatcaaaacaaatgaatcactgtttctccttccttcatcattccctaattggtttccaaaataaaatgattagtggctgcatttctcaactgcattgttttgattacagtcttactggctgtattgggtgagacattgggaaatgctttcataactggtgatcactgttgacggggttccctgacttcataaaggcccagattatgttaccccgagaaagtctttgaaggagcaagctctttcttatgcttttgttattaagttagggaaaatgactttaaataatggaaccttagttacaatgtaggttccactcttcttgagatttgtgttactttttagacatgacaaaagtgtgcattttagagttcctcttaccccaggaacaatggactcacttggctttcaaaagggcagaatatactgagtatttctgactgcaggtttcttctttctggtaccctcaaaaatacaccataaatagtagattaatctcccttttgctgtccgtgagtcccttcccgtttcttcagcactgcttgatatgactggtatggaggcctaaagctggctggcctagttagtgttacccaagtggtttcttgtgagcatccatttgcatgcagttgggccttttgtccattggtgaactgctccttgccttgaggtcctgtagctagtttgccactgagtatttccttcaaaaaacaggaaggatgccctgatattatgaagtgggtggttttagaattccacttcagatggcactgacctttccttaatacagctggtttcacttaatacattttgtttaaacaaagcctgttcctggaagtggttccagaatagtctgttccttgtagctgttcctttgctcttaattttaaaagtgttttcccgacagtatcatatgtgctcgcacgacagattagaaacttctgcttgaagtcatcacacttatgaattacgttgtgtccagttatgatatattgatgattgtattcagtagcttgaaggtttaagtgataactttattttgcaaaactgaccacattcttttgttgcttaggtgtctcccctttaagggattctgatgtctagcagtctcaatggacaaaacagataaaagagagaatgagtatttttcactttgtaaacatgaacaattcttaacaaaaaagccagagctggactaattaaataatcaacatgttttaaagtgggatagacatttctattttaggtatgataccacaatatttaaattttaggaaagactggatagaaatataaaataagatactagtagtcctgctctgacttttctaaaacaagtttatattactttatttaaaaatgtttatgagagtgccttttaaaaatagggatttataggctgggcgcggtggctcatgcctctaatcccagcattttgggaggccgaggctggcggatcacctgaggtcggagttcgaggctaaaaccctgtctctaccaaaaatacaaagttagctgggtgtggtggcatatgcctgtaatcccagctactcgggaggctgaggcaggagaattgcttgaacctgggaggtagaggttgcagtgagccaagatagtgccactgcactccagcctgggtcacggagtgagactccgtctcaaaaaaataataataagataaaaaatagggatttataaaacatatatgcaactcattaagaactttttggctggccaccatagctcatgcctataatcccagcattttgggaggccgaggcaagtggattgcttgagcccaggagttcaagaccagcttgggcaacatagcgaaacctcatctctacaaaaagctgggcatggtggtgcgttcctgttatcccagctacttggaaggctgaggcacaaaaatcacttaaatctgagaggtggaggttgcagtgggccgagatcaatcacaccactgcacgctagcctgatgaaggaaggagaaacagtgattcatttgttttgataaaatctggccttcaaatgatcgaatggccaggaaatacacatatttctatggtctaaggtgtcttaaacttggcctttaaaaaaagactctttcaaagcttgtgagcaaactaaatcagctagttcataaagcaaagtctcttgactatgacatagtctgctaactttatggatgtgggctcacaggtaaaaaaataaataaataaacaaaaaacaatgtctttctctgccttttgttaaaaaaaaaacaaaaaaactttttttgcctgtaatcccagctactcaggaggctgcggcaggagaaccacttgaacccgggaggtagaggttgcggtgagctgagatcacgccattgcactccagcctgggcaacaagagcgaaacttcatctcaaaaaaaaaaaaaaaaaaaaaggcactttttttttggccaggcacagtggctcacgcctgtaatcccagcattttgggaggctgaggcgggtggatcacgagatcaggagttcaagaccagggtggccaagatggtgaaaccttgtctctactaaaactacaaaaattagccaggcacggtggcaagcgcctgtaatcccagctacttggaagggcgagacaggagaatcgcttgaacccaggcggcaaaggttgcggtgagccgagatcgcgccactgcattcgagcctgggcgacagagtgagactccatctcgaaaaaaaaaaaaaaaaaaaaaaaaaaaaagaactttgaataaacttcgttgtgtcatattctatcgtaagatttattcttgtctttggagaacttagcttataattaattatattttaatgaataggatactttttgtttgttttgtttttgttttgagacaagtactcgctctattgcccaggctagagtgcagtagcatggtcttagctcactgcaacttctgcctcccaggttcaagcgattctcgtgcctcagcctccccagtagctggtactacaggcgtgtgccgccatgcttagctaattttcatatttttagtagaggcagggttttgccatgttgaccaggcttgtctcgaactcctagcctcaagtgatccgccctcctcagcctcccaaagtgctgagattacaagtcaccacgcctggcttccgtatttaagtattaggtggtgactccatacaaaatatttaacagcttgctggttaacatttaaatctttgttgctaagaccttttctatgtttgacagttattccaaacacgttccatataggaatagtttgccaaatagaagaacacgggatattcttctcccatggctgatgtgttgtgattctaggtgcatatttctgtttccaagaacacggacctgttctcaagttcaaacactgcatcaagagactgtgccccatgtcttttcacttttttccctctctctttctctccccttcccctccttgatttaatttcttcagcaggtcagaattgatacagcttccagaagaaatagtagaagtaggcaaaagattagtttttaattcttgttctgtcaaatactttttgattgaaattgtttttattacaaaggtagcatttgctttttgaaaaacaaaataagaaaaatctttttaatcacttcactattaagtttgttgaatattccctcataactttttctcctggctttttgagtatttgagacatttctttccacattgcagttttgaaacattctaccccacactcatacatgaaagtgaaggctctgcttctcagagtacagtttaatttactttgtggacatcattaacaaaaggcagagaaagacattggaccatactaattgtgggacttagaaaagctatattagtgatggttattaagtatcgcttgcagtggagtctgtaacatattcctatgaagttaatctaactactgagatagtgggagtgcagaggaggcatgctgtgagatggagtggtattttccagcatggcttttctgtttcttgaaaaccctacagcactttgccatggtttctcatctggatgaaataaagcacctgtaccttagtatgtcctgccatgcctttgtatggcatacttggctttgttctccaggcctcttcccacagtaacaacggattctttaggaattggaagggggggccgggcatggtgactcacgcctgtaatcctgggactttgggaggctgaggcgggtggatcacgaggtcaggagtttgagaccaacctggccaatatggtgaaaccctgtctctactaaaaatacaaaaaagaattagctgggtgtggtggggcatgcctgtagtcccagctactcgggaggctgaggcagaagaattgcttgaacccaggaggcggaggttgcagtgagctaagatcgtgccactgcactccagcctgggtggcagagactccgtctcaaaaaaaaaaaaaaaaaagaattggaagggaatggaggaagcaaggtggttaaacaaaaatcatctttacacacaccacccactctatgatgtatatgagttcagaagagcactttgctttatccttaatagaaatatctgtaaagccaggggagtcataaagctgtaggctaagtaaggtgccatgagaaaaggaggcttcacttacgccagtatttggagcagcgtttggcctcttggaggtgtttgcacccatcggagatgctccatagtgagatttaggataagtgcaaggtgagctttgcttttgtaaaatgcatgaagtgtgaccacgaaagggccatgggaaagaattattgatgggttacaggtgcatcgtttcaggcagattgacactaggaaagagcaaagagcaggtagaggtttgacagtttactcctttaaagtaatccatgtccaataacccatggaaagtcttcatgtacttctaaggggtagacataccctagtctaggtgctaatctaggttctatcatgtgttagctgtgaccctgggcaaataactttatcctatggcctcaatttcatcttgcaaaaaaatacggattagataatggcacttccttaaaaggtttgatgggatttcaatggaatattgcatagaaagtgcttgaggcattgtaagtacacagtaagtgaagtgttgaccattattaatatcatgatgataaagtgtgtaacttattttataagtaccatataattgaaatttgccaatagtaactcctcggagacttccagggaactctgtcaatcaaaaaaagctttgtgtaataatggacgctaccttgacagagtgtgttagtcaagagaggatacttatttataaattttgggatatttatacttttttttttttctttagagatggagtcttgctctgtcgccaaggctagagtgcagtggcgcaatctcggctcactgcaacctctgcctccccagttcaagtgattctcctgcctcagccttccaagtagctaggactacaggcacctgtcaccaggcctggctaatttttgtattttttaggagagacggggtttcaccatcttggtcaggctggtctcgaactcctgacctcgtgatccacacgcctcagccttccaaagtgctgggattacagacgtgagccaccgcacccaactataaaatgtatttttatagatacttattgaattttaggatgtgggctgggtgattattttttaaagtacttttaaaaaaattaaggtattatttacatataatatccacccatttttaagtatacattttggtgaattactgtgtgtcaatcatgtaacctcaaacacagccaagattataaaacagttctctacgctgctttggtgatggatacaccaaaatctcagaaaccaccactacagaacttattcatgtaaccaaacaccatgtgttccccaaaaacctattgaaaaaaaaaaagaacccaaaaccaaaaaacagttctctcaacattaaaagttttcctgtgcctttttccagtggattccttccctcagcctctggccccagacaaacacttatccactttctgtgtctgtagttttgtcttttcaagaaattcctatgaatggaaccatataaaagttatataaaaatcatagacttttgtatttgatttcttttactcttagcatcatttttttgagatttactcctgttgtatgtatttacatttcctctttttcttggtgagtaatattgcattatatgaatatctcacaatttatccattttactagtggataacattagattgcttccaacttgaggctattatagtacagctgctatgaacatttgtgtattcaccattgtgtgagcatatgattttccctaccttcttttctatttcactttcttttcctttttctttcctttttttttttttcttttttttgagacagtctctctgtgtcgcccaggctggagtgcagaggcacgatctcggctcactgcaacctctgcctgctgggttcaagcaattctcagcgtcagcctcccaagtagctgggattacaggggcccgccaccacacccagctaatttttgtatttttagtagagacggggtttcaccctgttgaccaggctggtcttgaatgcctggcctcagtgacccacctacctcagcctcccaaagtgctgggattataggcctgagccacagtgcccggccctttttcctttctttttttgagataggatcttgctcaatcatgcaggctggagtgcagtggcacacttggctcactgcaacctccacctcctgggttcaagcgagtctcctgcctcagcctcccgagcagctgggactacaggtgcgtgccaccacgcccagttaatttctgtgtttttagtagagacggggtttcaccatgttggccaggatggtctcgatctcttgacctcgtgatctgcctgcttcagcctcccaaagtgctgggatgacaggcgtgagccaccaagcccagctgacaatggattttctttgttttctccttcatctgaagatgtcttccctttgccttcatttttaaaggatattttctctgggtatagaattataatccgagagtatagaggttgacaagttttttggtattggttttagttttgggttgtgtctttttgttgttggcttttgttttgtttttgccccttatagatgtttcactgtcttttggctcatgtgttccgatgagaagtcagcccttcattgggtccttgttctcatctgtttaatacctgttcccatacctgccctttctctctcactgcttttaagatttgctctttatctttggttttggagtatttgactatgaagtgcaagctgctttgtttcttcttggtgtacattcagcatcttgcatcttcaagtatctgcgtatcattaagtttgggcagtttttggctcttgtttcttctaaattttttctaccccattctccctgtccctctccttttggtattgtagttacccactggaacacgtgacattatgtagcaagtctctgagtctgttcatttttttccttcagtctttttttttttttttgaaatggtctctctctgttgcccaggctggatggtacagcggtgtgatcacgactcactgcaactttggcctcctgggtttaagccatcctcctgcctcagcctctttgagtagctgggaccacaggcacgtgccaccacgcctggctaattttttgatttttactagaaacagagtcttgccatgttgcccaggctggtcttgaactcctgggctcaagcaatccacctgccctggtctcccaaaatgctaggattacaggtgtcagccactatgccagccttttcaattttttatctctcttcttcatcttggttaatttctactcatcttttttgaaatgcacatactgtccttttctttgtccattcagctgagtatatccagtgaattttttatttcaaaaagttaatttttttcagttctagaattgccatttaattattttttgttgttcctatttcccccattgagatttcctacttcttagctgagattttcattcattggaaacatgccttatactgcttcattgagatgattataatagctgcttaaaatctttgtctattccagcattttgttgatctgcaggttagactggcagttgaactaatttgtcccactgtcttgcttctttgtatggtgggtagttctggattgtttactggactgtatgaatgtcaaattctggatattctggattctgttacttttctctaatacttgtttggttttatcaggtggttttcttggctgggtttgaacacaaatgtgtttctctctgagatctttagtctgtagctgagctgctttgtgtctgtcccatgcatgagtggctcaagggtcagtcagggatgtgattgtacggggattggagatcttcccctgcctttttcccttctaggattacttcagtctatttatttatttgtttatttatttagagacagaagtcttcctctgtcacccaggctggagtgcaatggcgcgatctcagctcactgcaacccctacctcccgggttcaagcgattctcctgcctcagcctcctgagtagctgggattacaggcccgcaccaccacgcccggctaatttttgtattcttagtagagaaggggttttgccatgttggccaggctggtcacgaactcgtgaactcatgctctacccgcctcagcctccccaagtgctgggattacaagcgagagccactgcgcccagccggctctctttgttattcatagtttcctggcttctcttttctgagccacccagccaaaaatgctttgactttttctatgcatgtttctgtcatgtctgtgcatgacataaatcataatatcctaagacacaaaattgttaaaggcaataatttggaaacatacaacaataaataaaatggttatagagatgtaactttaaaaagttgaacattttgttaaaacgattcctgaatatgctggaaaattcagatagttaacaaaatattttgaggataaaaaggaaaggaatctgttatctggaggtagaataacttggccattttacagaaaggaaacaaattctgatttcactttttgtatatcatccatttgacaattttcaataaaaggtttattgaaaacggaatacataaggctggtgtttggacctttttcctaattagaaattgtccatgtctccaaagattattaactcagtttattatcagctaaagagatcttaaagttgactaaacacctggaaattaaaacttaggccaacacatcaaagtctttatgacttgaagtgttttaagaattaatgaggcaaagcacacacctgtggtcccagctacccaggagactgaggcaggagaactgtttgagcccaggagtttgaagctgcagtgagctatgatcatgccactgttcttcagcccaagagactgagtgagacctcttaagaaaaaaaaaaaaatgaccggacacagttgctcacgcctgtaatctcagcactttgggaggctgaggcgggtggatcacgagatcaggagatcgagacaatcctggctaacacggtgaaaccctgtctctactaaaaaaatacaaaaaaattagcagggcgtggtggtgggcgcctgtagtaccagctacctgggagcctgaggcagaaaaacggcgtgaacccaggaggcggatctcggcagtgagctcacaccagtggctcacacttgtaatcccagcactttgggaggccgaggtgggcagatcacctgaggtcaggagttcgagacaagcctgaccaacatggagaaaccccgtctctactaaaaatacaaaattagtgggcgtgtggcgcatgcctgtaatcccagctacttaggaggctgaggcaggagaatcgcttgaacccgggaggtggaggttgcagtgagccaggatcgcgccattgcactccagcctgggcaacaagagccaaactccgtctcgaaaagaaaaaattcatgagactaaatcattttaaaaagatgtcttttattacaatttctttcaattaaacagttttatatttttgaaattttaaacaatttgtgcaaacgagatcctactggacctataaaactaatgtagttaatttagaaggtttaaatcacgagaagttaagcccaaatcttgggttgatttaattgttgtgttaacattgtttttatatcataataaaatcagaaggatgcatagacttgtttttaagctaatattaacttctatttctagcccaaagagtcatctatcaaaagccagctcatattaagtagggggaccaagagggaggtctctcagttaaacaaagttattgacttgtctttagacaggcaagacagagtatctcctcataaggttttcttttaacctttttgttctgaagttaatatgtcttttaagtgaataatcttgtttataacaacattttcttttctgttttgtttgtttgtttgtttgagacagagtctcgcactgtcacccaggctggagtgcagtggcacagtcttggctcactgcaacctctgcctcctgggttcaagtgattctcctgcctcagcctcccgagtagctgggactacaggcacatgccaccactcccatctaatttgttttgtgtttttagtagagacggggtttcacaatattggtcaggctggtctcgaactcctgacctcgtgattcacccacctcggcctcccaaagtgctgggataacaggcatgagccactgcacccagctataacaacattttcaaagtggcacattttaatatgaataaaccttctacaatcacaggcctagaaagtttttctttttcttacggaatttcttgactgtttacttgtactagatatttcttcggtatattcataatgacagaacaattgtttatgattgattgatctccaaagtttcccaagaaaagagaaaaagtaggaggggaaggaagaaagaagtgagcagaagttggcttcagagagataggaagggccagttcccttctctgtttaaggaggggagaagacttagatgcagggaaactcattttgacatgccaactcaaaccacagaagccagagtcagttcagctggtttcagtagtaactcaggaccttgacaattctgttaagccatgtcctttaaaagccagctcttattaagtagggggatgaagggggaagcccttcagttaaacaaagttactgacctgtcttttagacaggcaggacagaggatctcctcatgaggtttttttaacctttttgttctgaagttaatgtgtgttttaaatgaataatcttatttataacaacattttcagcgtggcaactgcagtttcagaatggtggaattataccagtcagagagagatgcaaatgatttaaaataggaagaaagcaggtgtctggcccagaggaccagattaagaagaccccatgagagttacaatagttagtgaaaatggtgcttctgcaaacctcatgtctacagaagctggtcaaagaccagatgccaccaggtagaatcccagcaaactcttcaatggtagatatctgtcaccatccttaggaggtaggtctgtggaagctcactataataccatttgcttaacagatatacaaacatggatcagatataatttcaacccacaaggagctcacagtctggctcttcttttgaggcaaaaagactaaagctgttgcctttatggtaagataaatctgccttggagtcaatccaaggtgatttaattactgtaggtagttgtaccaataaggcttgtatcccagagaactccatattgcatttaagcttgttagtaagccaggccagctctatttcctgtgaggactttaaaaaaaattgcattcacacatttaaaaattagcataagcagggtgcagtgatgcacgcctgtagtcccagctacttggtaggcagaggtgggaggatcacttgagccccagaagttcaagaccagcctggacaacaaagtgaagtgaagactgtctcaaaaaaattaattatgacataaaatgttatatgtcttaatttacacaaatataagtatatacttttaaatcccattcttacacacaaaagctagcatactgtgtaaagtattctggacctacacacctttatttttttaacataacaatatgtcttggatacattttcctatttgtctatagaaagtttcatcattattttaaaaaatttgtttttggctgggcacagtggctcatgcctgtaattccagcactttgggaggccgcggcaggcgaatcaggaggtcaggagtccgagactagcctggccaacatggtgaaaccccatctctactaaaaatacaaaaacttagctgggcgtagtggcgggcgcctgtaatcccagctacccgagaggctgaggcaggagaatcgcttgaacccgggaggcagaggttgcagtgagccgagatcctgccacagcactccagctggggcgacagagtgagactccatcttaaaaaaaaaagtttgcttttatatttcatacctgcatggtattctattgtgtgagtaggccatcatccagtggtcttcaaactttcctgtgtactccgtaacagaatttgttgttttgacatgcagtctcactctgttgaccaggctagagtgcagtgccacaatctcagctcactgcagcctccacctcctgggttcaagagattctcatgcctcagcctcttgagtagctggcgcatgccaccatgcttgactaatttttgtatttttagtagagacgggatttcaccgtgttggccaggctggtcttgaactcctgacttcaagtgatctgcccgccgtggcctcccaaagtgctgggattacaggcttaagctaccacgcctggtcttctaatagaatttttaaaaactgtatttacccccttgcacatttaaattgacatctaagatttttattataagtttaaatagttgtaaaggatgtattttccattatattttatacattccttaattttatatatatatatatatatatatatagttttttttttttttttttttgagatggagtctcactctgtcacccaggctggagtgcaatggtgcgatctcggctcaccgcagtcactgcctctagggttcaagagattctcctgcctcagcctcccgagtagctgggatcacaggcacccgccaccatgcccggctaatttttgtatttttagttgagatggggtttcaccatgttggtcaggctggtctcgaactcctgacctcaggtgatcccccccacctcagcttttcaaagtgttgggattacaggcgtgagccactgtgcctgccctcccttaattataatttaaaaaatttttgcagatgtagatttatataaattggcaagccagttctctttatcaaattaactgatcaaaaaaaaaaaaacagattaactggtcaaacatagatttactttctgtcagtaaaattttgacttcatttttttaaatcaaataagcatgttaacccggtattgctgtgacaacctttatcctaatttcttttcttcttcttcttcttcttcttcttcttcttcttttttttttttttgaaatggagtcgtgctctgtcacccaggctggagtgcagtggcacaatctcggctcactgcaacctccacctcccaggttcaagcaattcttctgcctcagcctcccgagtaactgggactacaggcatgcaccaccacgcctggctaatttttgtatttttagtagagatggggtttcaccgtgttggccaggctggtctcgaactcctgacctcaggtgattcgcccaccttggcctcccaaagtgctgggattacaggcatgagccatcgcacccagcttttttatcccaatttcaagatgggtgggcaggtaggtaggtaggcaggtgggtagatagatagggccttcagacttgcctcgcattcatcttttacataaaataagacagtttcaccttgaacacttctgtggtgagactgtttagtcttgtagctctaaactccagccatactctgatgactcccacatttataaatcccagatttgtatactcaactacttatctaacaggtcaaaactgaactcttaaaattcttacatttgtgtccacacatgattggctaagctaatggggctcagatttaccctgtcacctgaaacaactgtaaaactggagaaaatatgtcaaactctgaagttattaggtctaaggtgattaagaacagcgaatcctgagacctgagaaatagagccctatgattgctctgatttaatgctcggagaaagtttccagaccgcggtgcggggagaaggaacatcagcaggccccagcagtctctcctcattgaagaggtaaaatgaaaatccagggcagctggggcagctagagttcacaggcagagaaacaaagaggcaagagatgcacagagaagagaacactggcctgcagatgcccagggagcccactcgagtattcggttgagtactgatcagtgcacccatgtgaggaaaccccttagttcagggaaggagccactcaaaaggattagagagaaccatttacggagttcacacagggccagaaatagttcctgttcccagtagcagagtagaacatttcatgattcaggggtattgattggagtactaagaagagttgtattagtgaaggttcttgagagagagagagagagagagagagagagagagagagtgtgtgtgtgtgtgtgtgtgtgtgtgcacgtgtgaagaaatttattgtaaggaattgccacgtgattatggaggctgataagtcccaaaaatctgcagggcgagtcagcaagatggagacttaggagagccaatgatgtggctatagtccaaaggctgacaggctcaagacccaggcagagccaatgtttcagttcaagtccaaaggcaggaaaaaagttgatgtcccagttcgaaggcagttaggctggaagaattctcttttactcaggaaagggtcagattttttgttcaattcaggcctttaacagattgaatggggctcacccacattagggaggccaagctgctttacgcattttgccagactaacgtttgaccaaagatctgagcacgtatggcccagtcaagttgacacataatgttaatcatcacaaaagtcttgcctcaatagttgggaaaaattaatcctagaataaatgctattctggtcttgcttagcaaaggttaagagcaagaccaaaaagatcaaaccttttccaaacaaaagctgaagaatatttttagggatacaaaaccatctaggaccgagtgtggtaaaatgcacaatgtttaccagccattccagaattactaggtatgagcagaagtagtaacatacaaccaataactgaccagaaatgagacagattatataagtagtacattacagacattagtcattataattgtattccatgtgttcagtaagctaaagaaaagatttaatatgttaagtaaagacatgaaagatgatggctgggcatggtggctcacgcctgtaatgccagcactttgggaggccaaggtaggtggatcacctgaggtcaggagttcaagaccagcctagccaacatggtgaaaccccacctctactaaaaatacaaaaattagctgggtgtggtagcgtgcacctataatcccaactatacgggaggctgaggcaggagaatcacttgaacctgggaggcagaggttgcagtaagccaagatcgtaccactgcactccaacctgggcgagagagcaagattccgtctccacaaaaaagaaagatacagagatgaaaaatacactgaagactgtcagaataaacattgcacaagtaaagatttgtgattttgaagacttaaccatagaaactatccaaaatgaagcagaaaaaaaaaagaaaccctgaaaaaaatacatgaacacaacatcagtaaagtgagggacaacatcaggtagccaaatgtgtgtggaattggagtccctgaaggaagggagggtatgagggaccaaaaaatatatatagagagagaaaaaaaaatggctgaaaaatttccaagtgtaatgaaagcagtaaacacacagatccaagaatttcaaggaactccaagcacaggaaacatgaagaaaaactatatactaaggcacatcttaagcaaattgcttaaaaccatggtttaaaatggccaaagaaaaagatacattatatacttaagatcagggtgacaccagatttctcattggaaacaatgtaagccaggttaacagtggaacaatacatttaaagcaaagaaagaaaacagttgtctacctagaattcttttctcagtgaaaatacctttcaaaaatgaaggcaaaataaggtctctttcagactttaaaaaaaaaaaggaagaatttattaccagtagatatgcagtacaagaaatatcaaaggatgtaattaaagcagaaagagaatgataactggtagaaaactggagccaccaggagtcccaggctgcagtgagctatgatcgcaccactgcattccagcctgggtgacagagtgagaccctctgtctaaataaacaaacaaataaaagaaaactggagctataaaaataaatgaagacaatgcaaagggtaactaagtggataaatacataagatattttttctttttgtttcagtctcattaaaagatatgtcttagaggtaattacacattgtagcatttgtaacttacatagaagtaaagtttatgacaatagcagcacaaagactgggagtgggagaacaaatatactcttgtaagctttttacactacatgtgaagttgtataatgtcaattgaaggtagactgtgataagttaaagatgcatatgataaaatctatagtagcagagttatagctaatgagccaacaacaataaaaagttgggatataatcccaacactttgggaggccgaggtgggtggatcatgaggtcaggagttcgagaccagcctgaccaacagggtgaaactttgtctctactaaaaatacaaaaattagccgggcatggtggtggcacctgcccgtaatctcagctactcgggaggctgaggcaggagaatcacttgaacccaggaggcagaggttgcagtgagcggagatagtgctactgcactgtagtctgagcgacagagtgagactccgtctcaaaaaaaaaaaaaaaaaaaaaaaaaagttgggataaatatctttaaataatccaaaagatggcagaaaaaaaaactaaacaggaaaagcaaacagagcagatgggacaaatatgaaacaaagagcaagatggtaggttaaaattcatatcaataattaattcaccattaagggccaggcagagtggctcatgcctgtaatcccagcattttgggaggtggattaggaggatcacttgaagccaggagtttgagaccagctttggaagccaagtgagactccatctctacaaaaaaaaaaaaaaaaaaaaaaattagccaggtgtggtggtgtagttccactcaggaggctacggtgggaggatcacttgagcccaggagtttgaggctacagtgagctctgatcacaccactgcactcctccagcctgggtgacagcgagattccatcttaaaaaaaaaaaatcctcattaaaagcagacattgtgagattggataaaaaagcaagacctatttatatttatatgctgtctacagttatcccactttgaatataaaaatacaaatacgttaaaagcaaaagagtggaaaaagatgttaatatgttaacattaatgaaaagaaaaccttagtggcatattaaacaaactatattttaaaatgaatgtcaccaaggataaaggagaattatttcataataataaagagatacattcatcaagacataattctaaatgtttatgcatgtattaacagagattcaaaatacaaacttttcaaggagaaataaatctgtaattatagttgaaggtttaacaactctctcacaaaaactgatagaacaagtagacaaaaatcagtgaggatatagaagatttggacaatataatcaactgacttgacttaattgatgttcagtagaacattcgacccctaaacagcagaatacacgttcttttcaagtgcatatggaactgtttccaagacaaatcattttctgggccattttaaaagcctcagtagacccggcgggttggctcacgcctgtaatcccagcactttgggaggccaaggcgggcggatcacctgaggtcaggagttcgagacaagcctggccaacgtggtgaaaccccgtctctacgaaaaataccaaaaattagctgtgtgtagtggtggatacctgtaatcccagctactcaggaggctgaggcaggagaatcacttgaacccgggaggcagaggttgcagtgagccgagattgcactactgcactccagctgggcaacagtgagactccgtctcgaaaaaaacaaacaaacaaaagcctcagtgaatgtaagctgattcaatttgtagaaagtatgatctctggccaggtgcggtggctcacgcctgtaatcccagcactttgggaggctgaggcgggcggatcacgaggtcaggagatcaagaccatcctggctaacatggtgaaaccccttctctactaaaaatacaaaaaatcagctgggcatggtggcgctcacctgtagtctcagctactcaggaggctgaggcaggagaatcacttgaacccgggaggatgaggttgcagtgagccgagatggtgtcactgcactccagcctggctgagagagcgagactccatctccaaaaaaaaaaaaaaaaaaaaaaaagaaagtatgatctctggccacaaggaattaaatgaggaattaataacagaaaggtatctggaagatctttcaaatatttggaaaataacataattttaagtaaatcatgggtcaaagaaaatcaacagcgaagtaagtaagtatctggaactgaatgaaggtgaaagtgccacataaaatttgtgtgatggagctaaagggaaatttatatagtgcagatggtccctgacttatgacgtctcaacttacatttttcaattttatgatgggtttttcaggatgtaacccaattttaagttgagcatctgtatcagaaaagaacaaaggtcccaaatcaatgaccttggggtcccacttttagaaattagaaaaaatgaagactagtgaaaccccaattaagcagaagaaaaagccagtgtggccaggcagggaggcccatgcctgtaatcccagcactttgggaggctgaggcgggcagatcacaaggtcaggagattgagatcatcccggccaacatggtgaaaccccgtctctactaaccatacaaaaattagctgggcgtggtggcgcttgcctgtgtaatcccagctactcaggaggctgaggcaggagaatcgctttaaccagggagtcggaggttgcagtgaaccgagatcgcgccattgcactccaccctagcgacagaacgagactccgtctcaaaaaaaaaagaaagaaagaaagaaaaagaaaaggccagtctggaaatcaatgaaacagaaaaccagtacagaaatcatgaaaccaaaagctagttatttgagagagcaatgaaactcataaacctctacccagactgatcaggggaaaaaagggaagacaataactgtaatatcagcagtgaaagagatgacatcacacagattctaaagatattgaaagtgtaataactgaatattgatcagcaatctagaagaaacagattccttgaatgacacaaactaccaaagttcactcaagaagtaaccatctgccgggcgcagtggcttacgcctgtaatcccagcactttggtaggccgaggtgggcggatcacgaggtcaggagaccgagaccatccttgctaacacggtgaaaccccgtctccactaaaaatacaaaaaattctccgggcgtggtggcgggcgcctgtagtcccagctactcaggaggctgaggcaggagaatggcttgaacctgggaggcggagcttgcagtgagccgagattgcaccactgcactccagcctgggtgacagagccagactctgtctcaaaaaaataaaataaaataaaaataaagtttagtaaaataaaaaaaatcagtaaaatacaaataaaatttagtaaaaataaagctgattctaaaatgcatgtgcaacagaggatctagagtagccaaaataagctcctctgtctgacttaaagtcttaattaaaataatcagacaggccgggcatggtggctcacgcctgtaatcccagcactttgggaggctgaggcaggtggatcacctgaggtcaggagttacaaaccagcctggccaacatggtgaaaccccatctctactaaaagtacaaaaattagtcaggcgtgatagcacacgcctgtaatcccagctactcaggaggctgaggcaggagaatcgcttgaacccgggaggcggaggttgcagtgagctgagatcatgccaccgcactccagcctgggcgacagagtgagactctcaaaataatgaaataaaaataaaaaactgaacttcatatcttgtccccagatctgatatagtcacttcttcctttgttcagttaaacccagcttcatgtttctgcttgcccagggccaataactttgggatcttccttgactcttctttttctgtcaaaccccgtaccagtctttcaggtaaccgtaacttcagagtctatccaggtcacctctgcttgtccaagcccctgtcatctctcacttggatgatttcattagcctcttggccagggtccctgcttctgctggtatttccttagtttcttctccctacagcagccagagctaatcattttaaatgtcatatttctgtctcgcctcagctgcaaaccttccagtaccttcccagctccttctaaataaacaccagaggccgggtgcagtggcttatgcctgtaatcccagcactttgggaggccaaggtgggcagatcacctgaggtcaggagttcgagaccagcctggccaacatggtgaaaccccctctctactaaaaatacaaaaattagctgggcgtgatggcgcctgtaatcccagctacttgggaggctgaggcaagagaatcgcctgaacccaggaggtggaggttgcagtgagccaagactgcgccactgcactccagcctgggcaacaagagtgagactctgtctcaaaaaatataaataaataaacaaacaagcaccagagccctggcagtcacctgtgaggcttcaccccgtctccccacccactataacctctgacttacctccttttacactccttcttgctgactctgttccttccacattggcctctttgctcttgcttgaatgatccccagtcatcctccctgcccagggcctttgcacttgctgttctctgccaggaaggtgcttcctccgtagttcactcttcacctcctttgggtctttgctcagttgtcatcttcagtgatggctcttctgatcaccttatttaatttttattttttaattaaaaattttttttgtggagatgtcttgctatgttgcccaggcttatctcaaactcctggactcaaacgatcctcctgcctcagcttcccaaagtgctgggattacaggtgtgagctaccacacccggccccgatcaccttatttaaaattgcagctcccagcccccaaccccagcatacccattcctctttttttttttttgagacagaatcttgctctgtctcaaattccctccagccatgagccctgaaatgaaacaagttatctatttccaaaacacaacagtggggcaggcataggatagacattcccattccaaaagggagcaataggcaagaagaaaggggtagctggtcccaagtaagtccaaaacctgagacagagtcttgctctatcgcccaggctggactgcagagtggtgcgatctcagctcactacaacctccgcctcccgggttcaagcgattctcctgcctcagcctcccaagtagctgggattagaggcatgcaccaccacacctggctaatttttgtagttttagtagaggcagggtttcaccatcttggccaggctggtctcaaactcctgaacctcaggtgattccccccgccttggcctcccaaagtgctgggattacaggcgtgagccaccgcctggtctccctcattccttttgttatcagtcatccctcccagccctggcaactgctgctcactttcctgaccttagaattttgcttattacagaatgtcatataagtagaattataaagtatctaagcttttaagtcctaatgcatttaagatctgtaaaaagtaaagtagaggttcctcttcaaagactttcctccccatctaattaggaataaatagtaacttctcttagaagaaaaatttattcaaagacctgtgctaacattcttaaatatctgctagccgtaataaagaaatcaatgtactttatattcttagctctcacaatttagcctaaatatttgccctggcatgcttatactggtccaagcaagcattaggtcatggcctgttcctcttccttatttgaaggtgtttttacctttctcagcactccacaagttacttcctccttcctttgttctcctctgcctttgcctcttttaaaaagttctaagttcctagccaatcaggacaaatacagaatgtgaggtcctgttccagccaatggaaactggacacagcagtagggtggacgcgtcaggttgtaaatgaccctgtctcctttgttcagtgtactctcatggcaaaactgctggtgagtgtaccctttctgcagaaagtaaaaaatggccttgctgaggaaattaaatttatgttcaagtgctttttcttcagggcaccagggaacaagcatttctaacagatccatatgtgtcgctgcatgtaatcagtggttcattcctttctattgctgagtagtgttccattgtatggatgtacccgtgtattgatccatccatccactgaaggatatttgagttgtttccagtttttttgtgattatgaataaagccactgtaagcattcacatagaggctttggtgtggacataagttttcatttctcttcggtaaataattaggagtagaattgctaggtcgtaggataagtatatgcttaacttaggagaccctgccacagtattttacaaagtaagggtgctattttgcattactaccagcagttcacaccatatgtattcacaccagttgctccatttggtcttcgttctgtgacttgtctctattctcttaacagtatctttagaacagcagaagtttttgattttgatgaaattcagtttatcgggccaggctgggtggcttatgcctataatcccagcactttgagagaccgaggagggtggatcacttgaggccaggagattgagaccagcttggccaacatggcgaaaccctgtctctactaaaaatataaaaattagccatacatcgtggcgcatgcctgtagttccagctactcaggagtctgaggcaggagaatcacttgaaccctggaggaagaggttgcagtgagctgagatcatactgctgcactccagcctgggcaacagagcaaaactccatttcaaaaaaaaataaaataaaatttcagtttatcagtgatttctcttaagtttcatgcattgggtattgtagctaagaaatcttcacctaactcaagtttacaaagattcttctgttttttttctagaagatttataagttttaatttaacttttaggcttataattcatttcacattaaatggtgtatgtggtgccaggtattgctcgagagtcatcatcttgcataggggtttcggatgttctagcaccatttgttcaacagatagcctcttttcattaaattgccctttcacctttgtggaagatcaattcagcatgcatgtatgggtcacttgtatgtttttaattgatttctaaattctgaaaggaaaatgataaaaaggaagattctttcactatatctgcatttccaatttctcccccaagaacgctttcctaacacctgcaggcagaactaaccactctgggcccctgtagctgttgtgcgtatgtttattattgagtttttctggcctttgcagttctttcagtgtctgattctccctctctctcagcttctttctcaagactgtgcatccttggaggtcagaaattgtctcatcctgccgggcgcgatggctcatgcctctaatcccagcactttgggaggccgaggcggttagatcacaaggtcaggagttcgagaccagcctggccaacatagtgaaaccctgtctctattaaaaatacaaaaattagctgagcgtggtggcacatgcctgtagtcccagctactcgggaggctgaggcaggagaatcgcttgaacccaggaggcggggaggttgtagtgagctgagattgtgccactgcactccagcctgggcaacagagcgagactccatctcaaaaataaataaataaataaaagacaaaataaattttctcatccttttttgtcatcttcatcacagctgcctctctaatgttcgttgaatgaaagggccattcccaaatctctgataagtcaagcatttttaggagagctaaaccagccaaatgagaccaggaagtgaagaaaaatacctttttttttttttttttttttttggagacggagcctcactttgtcacccaggccggagtgcagtggcacgatctgagctcactgcaacctccgcctcccaggttcaagcaattctattgcctcagcctccccagtagctgggactacgggcacacaccaccatgcccggctactttttttttgtatttttagtagagatggagtttcaccgtgctggccaggctggtgtcaaactcctgacctcgtgatccgcccgcctcagccttccaaagtgctgggattacacgcgtgagccaccgcgcccagctgaaaaatacctactttttttttttttttacagcaggaggtgtttctgcttctactttgctgtgacttctgtttctccaggcattcctggtatggacatttataccaggtgttttggtcattggtgggctctcagcttcagaggacacttggcttctctataccctatctttggtgacttctgcttgttggacttcagtcactgcagttcacaagtttcacactcatgaaatatttattgttaattaattccaatatttaattgattgcttctctttctcagcactttggaaacatgtttactacctagacattttcctacagtagatttttaattcttaacattttgatcttaagcaatttaccatgatacttggtttccatgagagatttaacagttggaactgtactgcccataagatgcaggtggggtcatggtatgtagttgggaactctacaaatggcagcccttcatgcctttgcaaaggctgcaggttggaaagctgccattacttgtgagggcgtccaaatgcttcctgtgaatggaagatgtgtttctgtgcctcactgtcttcactgtgctggattgctggctttctcagatgtctttatttgagtcaacctgtattccatctccccactcccacccagtcttgatcatctcatttgtgtgtatacaaccttcccctcacacacacctctttgcagagtttcgttgcactgggcgttgggaggagaggcgtcagagttgggtggaatcatttcaggctgactgtccagacatagctctcattagaagcatcagtaaataagctgaaaaccaacaacacgtacagcacagtctttctgtgtttgcagcttggaactgagcagccctcactgggtgcatttctaatcctttgtctcatcatttatatgacatccacttagaaaaaggtgttaaaatcatataacatattgctttttccccttttttattagcagttttactgaggtgtaatttatatgccataaaatttaccatttgaatgttcaattcaatgatttctactaaatttatagagtgtgcaccataaccacaatccagttttattttttatttttttttcgagacagagtctcactctgtcactcaagctggagtgcagtggtgcaatctcggctcactgcagcctccacctcccgggttcaagcgattctcctgcctcagcctcccgagtatctgggactacaggcacgtgccaccatgcccagctaagttttttgtattcttagtagagatagggtttcaccatgttagccaggatggtctcgatctcctgacctcatgatccgccagcctcagcctcccaaagtgctgggattacaggcgtgagccaccgcacctggccccacaatccagttttagaacatttccagcatccccaaaagatcccttttgtccctttgcagcagtcctacccccacttccagccccaggcgaccattcatttgctttttctatagatttgtcttttccgtacgtttcatgtaaatgaagttttatacaatatatgaccttttgtgactgttttttttcccagcatgtttttgaggtttatctgtattatagcacgtctcagtactttgttccctttttatcactgagtattattccattgtacggacatacatttttctctattcactagttggtgaacatttggattgtttccagttttggtcatcattaacaatgctactatatatatccatgtataagtctttgtgtggatatacattttcatttctctagggtagatttctagaagtaaaattgctgagtctttttttttttttttgagatggagttttgctcttgttgcctgggctggagtgcaatggcataatcttggctcactgcaacttccgcctccctggttcaagtgattctcctgcctcagcctcccgggtagctgggattacaggcatgtgctaccacacctggctattattattattattttttttttttttttttgagacagagtctcgctctgtcacccaggctggagtgcagtgcgcgatctcagctcactgcaagctctgcctcccgggttcatgccattctcccgcctcagcctcccaagtactgggactacaggcacccaccaccacccccggctaattttttgtatttttagtagagacgaggtttcactgtgttagccgggatgctctcactctcctgacctcgtgatctgcctgcctcggcctcccaaagtgctggcattacaggcgtgagccaccatgcctggcaaattttgtatttttagtagagacgaggtttcaccatgttgatcaggctggtctcaaactcctgacctcaggtgatccacccaccttggcctcccaaagtgttgggattacaggcgtgagccaccacgaccggtcaaattgctgtcttatagtaagtttatgtttaactttttaagaaactgccaaactatttcctaaagtgactgtaccatttacattcccaccagcaatgtgtgagtgttccagtttttccatgtccttgccaatagttggttttgtctgcctacctatccccgcccctgcttttttttttttttttttttttttaagagacagggtcttgctgtgttgttcaggctggcctcaaactcctgggctcaagtgctcctccctagtagctgggactataggcacacaccagtgtaccaggggttgtctgtcttttgattatagctattggaatgggtgtgaagcagcatctcgtgattttagtttccatttcttgaatgactaatgatactgaacatctttttatgtgcttattagccatttgtatttcatctttggtgacctgtcaattcaaatcttttgcctatttttttttattaagtttgtgcactgtcttattatcgagtggtaagagttctctgtattgtgggtacaagttcttttttttttcgagatggagtctcgctctgtcacccagggtggagtacagtggcacgatctcagctcactacaacctctgcctcctgggttcaagcgattcttctgcctcagcatcccaagtagctgggactacaggcttgcaccaccacacccagctaatttttgaatttttagtagagacgggatttcaccatcttggccagacgggtctcaaactactgacctcgtgatcctcccacctcggcctcccaaagtgctgggattacaggtgtgagccaccgtgcccggccttccaagttctttatcaggtatatgatagcacatgtagctttttatcttccttacaccagtgcaagtttatagaaaggaaaagggatagttaatagtaatcataataatgtttaatatttgaatgttttttaggagctggacactgggctgcatgtttcacggggatgatttgggtcactcttcaattttctaaaggttacaggactgtttcaaacacctctccttctattaacagttttcaatggagaaagaaaacaaaagattgatttggggaattcttaggttaatgcgagttagaactgaccttttaacattattaccataaggactaaatggctgttacagacccaaaataggagcaattcaaacaagcgagatgcttctctctgtaacaggctgacagtcgcggtcctggaggggcacgatggctcctcagggtcagacacctcctgtcccttactctgtaaggcacagcttctacctcaggatccaaaatgcccacgccagctgccatggcccctcacaggcagtggacaccagaaagaggagagggagtgcgtgcctgttgctttgaagaacctgacccagaagtcttacacagcacttttgcccacataccatcacttagtcatgtggtagtgcctggccacaagagagactgggaaatggagtctttattctggggtgatgtgtcccatctgcaactgaggggttaaggcctaaaacttagggattgaaggcaggagaaaaaacagatgtcgagagccagtgttgggattgcagggtcctgtgtgggattcctgttcattttcatcaaagaaagtctagttgatatgcaattgttggcctaagtgttattgaggagttaattttactgttgaattacaccagaacatttgtcatgtgaaataactataaatacgactgattattgcctagtgtattacagttctctccagagacacaggaaacaatagggtctgtctatcggaatagatatcctaaaagtgtatcttttgaagagattgattataaggtattggctcatgagatgatggagcttaagaagtcccacagtctgctctctgccagatggagacccaggaaagctgctggtgtagtttgaaggcctgagagctgagggccagtgatgtggattccagtctgaaggtctgagaacccagagggctgagggcaggagaagatccatgtcccagctcaagcaggcagagggagggtaaatccaaccttcctttttctgtttttttgttctaatcaggccctcaacggactggaggatgcccagccaaagtggggagggccatctgcttaggcagttcaccaattcaaatgctagtctcttctagaaacaccctcacagacacacctggaaataatgtttaagatctgggcatcctgggggtctagtcaagctgacacatacatttaaccaccacacttagggaatatgaaaataacttagacattaaatttgattttggtgttgctgtaaagaatacagatcttaggcaccagctcgtaggaggggtggtaaacaaggaggacagcttttaccaggttgcctttggaagcaaaactctgctttgctgttttgttttcaagcggctgcatggccactgagcgagccctttcctgccatcaccacagtgccacttagtgaacagtttctccaaggttaactgtagctgctcttgttcagttaatatgtagttctggattaatatgccacatctgtcactttaaggaagaaaaagagcagttccgtttagagatcccattgctcctctaaggacagcagtcatttctaacaagcagagggaagaaatcttctggttccatttgtcctttgtgtgtgttgaaaaccttgacaacaaaacaaattggtactgaatggtttgaagaaataaacattaactcccctttagtatttcatttctagggtttccagccttggtaacaattaccaagaactttgctgtcatggggtacagctctaggctgctgacaggatcttcatactggaggagactatacttttatagccaattccaactgccccagagataacttggataaacactggctcctccactacctcctaatccctgctgggttttacactgtggggaggtttagacaacttgttttctttcccttttagcccttctctctacactcccctccagctgccttcttcccccacccccaaatgtaacgtgatctcctaggcctgctctgctgcttttgcagattcttttagtcttagagaaagagaggaaaatattaaccattggtttaccaattcaaagttaacaacattttaaacaaaaggagcttgtcaataaccagggcttgggcttttcttttatcagttcctcctacttggctgagtttacctcatcataaatcttatcacacagataataatttgacagctttagggtttttgcagcattgctattttctattgcaacaaagctgtaacattgctatttttgatgtatttgttttatagatatcttaatcttcaatattcagattaaaaacaaacaagacttagtgatttaaaattatttggtaaaaaggtaaagggacagagacatctcatgaaaacatggcaaaatctctttaagtttaattcaagcacttagagtttaataagaatatcccaaaccatttttgcttaataatatttctgtttataattaaaccttaaggtacagtgttgtaactggatttaagaatttagagttttgttgtttcttcgccatcagcgaaattaagatttaaaacctatagtttgcaacaaattttagtttttcagcctagtgtcctaaaacttgtctgtcatgggtacctagtaggtgtcatgtcacaggaaagggatctaacaagggagtttgaagataggggttttccttgctctgccactaacttgctatgtgacctagggcaagttatataacctatctgtgtcacagttgtctgaaatgcaatatggggaaaataaattcttaaaatgacaataaaaagatttcttttttttttttgagacagagtcggcgcaatttcggctcactgcaacctccacctcctgggttcaggcgattctcctgtctgagcctcctgagtagctgggattacaggcacacaccaccacgcccagcaaatttttgtgtattttgtagagatggggtttcgccatgttggccaggctggtctcaaactcttgagctcaaacgatctacctgccttggcctcccaaagtgctgggattacaggcatgagccaccacgcctggccaaaatatatatatacatattttaagtgaagatgtgtaaggactaaaggagcccaaaggagacagtaggggataagaaaggcaaagagagtggtaatagatttagcagaatcaaggatgccaaaacctcttctgagagagaccttgattaagagtgagctggtttgcctgtaagaatctgcggaaaggtcagaaattagagacattagtaccacagaaagcaggggatgaggcctgaagctgaaatcaaggggatcaattgagagcctataaaaggagggtttagattcttcaaacccctcccaaccccacagagtcagatgaccacctctcctaaccacctacaggagaccagaggcattatattgagaaatgcccggccgggcgcggtggctcacgcctgtaatcccagcactttgggaggccgaggcgggcggatcacaaggtcaggagatcgagaccatcctggctaatgtggtgaaacaccatctctactaaaaatacaaaaaattagccgggcgtggtggcgggcgcctgtagtcccagctactcaggaggctgaggcaggagaatggcgtgaaccctgaaggcggagcttgcagtgagccgagatggcgccactgcactccagcctgggcaacagagcaagactccgcctcagaaaaaaaaaagaaaagaaatgccccgtagaggctctgcactcaggagcctgacccccagcatgggtccgggtaggccattggccgaaaatagtggagtgggcaaagagcagattttttaaaagtctgcatactgaatagtaagattcccagccctcttctaatacctgctagccaggggcctaataaggaagagattgaaatattcttttctagggggaaaaagttgaatgaccctagagaaaagccctacagataccaacatttagggattctcttgaaaaagcgagtttaccatctcctttcactgaagcttaccagtggctgtgccccttccacgcatacaaaactaacagtcatcttttagttgctcattcatagagagtgagtggcctgccaaatctctctaggcattagaggaaggtctctaacctgatattaatagataaagggtaaaacaaatagcagaaaacaggaacttggtggaaataaagacaatgcagtcaacagaggaagagtttaaaagaactattcagcttgggcaccatgactcacgcctgtaatcccaacactttgggaggctgaggtggacagttcacctgcggtcaggagtttgagaccagcttggccaacatagtgaaaccccatctccactaaaaatacaaaaattaactgaacatggtggcaggcacctgtaatcccagctattgggaggctgaggcaggagaattgcttgaacctgggaggcatagcttgcagtgagccaagattgcaccaccgcattccagcctgggtgacagagtgagactctgtctcaaaaataataaataaataaataaataaataaataaataaataaagctatgcatttcccacaaatactgcttaaaaaaaaaagaactattctttgctatccttggagagagagattgcaaatgtcagaaaacaggatgcttttaaaaacaataacaatcagaataagaataaaaatgaattatttttcttttatttatttatttatttatttttgatacatggtctctgtcacccaggctggagtgcagtggcaagatcacagctcactgcagccccaacctgcctcagccccccaagcaactgggactacaggcacgcaccaccacacctggctaatttttaaattttttgtagagagatggggtctcactatgttgcccaggctggtcttgaactcctgggctcaagtgatcctcctgcctcagcctccccccaaagggctgggattataggcatgagccaccacacccagcaagaatgaattgtttaatattaaaaacattatagcccaaatttaaaatccaacagaagatgtggaaaattgtctcagaatgtattgggttggtacaaaagtaattggggcttttgccattttaatgacaaaaacgttgattacttttacaccaacctaatagaacataaagacaaagacatggactgttgagagaacaataagagagaacaggtaagaaaattagaaactctcgggaggctgagacaggataatcgcttgaacccaggaggcagaagttgtagtgagccgagactgtgccattgcactcctgcctgggcaagcaacaagagtgaaactgcgtctcaaaaaaaaagaaaagaaaattagaaactcaatcccagggctttaatatcctttttgtaggaattccagaaagaaaacaaaaaaataatgataataacgaagaaacaaatggaggagaagttaggagacgttaaatgtaaggaaaaatttcagagtttagtgaagtgagtattttccaaaacagaattatataaatctctggatttatgagtgcccagaataatatatgaaaggccatatcattgtgaaagttcagaacaccaagaatattagaagatcctaaaagtttccaaagagaaaaaaagcaagtcattttaaggggtcaggaaccagaatgggattgcatctctaaacaatacttactggaaactagatagtagcagataaataaatgccttcaaagttcatttgggaaaattattttcaacctagaattctatacccagacaaactgtcaagatagaagaaaggtatttttttagacatgcaccctccctccccacctctgtgaagctactggatgatgaattccagcaaaatgaagaagtcagtcaataagtagaactgagcccgggcacggtggctcacacctgtaatcgcagcactttgggaggccgaggcgggcagatcacgaggtcaggagattgagaccatcctggtgtaacacagtgaaaccccgtctctactaaaaatacaaaaaaattagcagggcgtggtggcggtcccctgtagtccgagctactcgggaggctgaggcaggagaatggcgtggtgaacccgggaggcggagcttgcagtgggcggagatcgcgccactgcactcccgcctgggtgacagagcgagactacgtctcaaaaaaaaaaaaaaaaaaaaagtacaactgagaatatttgaaatgttttagtgattggaaaaaatatcactagatgtttgacagatctttgaagtatttgagggaaaatggtgataggtatatagaagactaaatgaaaacaaggcaatatctctaggataaacaaagatgtataataaaggaaacattcatagtatattattggctaagcagtgaagaatatttatatcatcctaataatgtaaacactaactattgatttatcccccaaattgtgattttattgttttggggggttatggatggtgatagtataatactgctgtcataagttaatagataatggataaatctaatgaattcagaaagagcaagatgatgttactagctaaaaatctgaaggaggctgtctctgcggaaacatacaggggaaagggattgctgttttttattaccagatttttacaagactatttttagccttttttacaagacttttagtactgcttgagttttaaccatgttatgtatattactttgattaaaaagaaaaattaatttaaaaaaatgagcatactaataccattaattttctccttctagagaaaaatgtttaacagttaggtttagacttgttaattataaaaatatagtagtcttactgtaatgagattttctagaaagcggatttactctaaggcagttcagatttggtccccagctgagaattatagcctggaaataccaacagaaaaatcagtgtcatttgaaggacagtcatctgtgcagcctgtgcatgaaatcatgggtctgaattaggcccccattcaagatgcgggggtgtggggtttgtgttttgctgaagctgtggttgcaaatctttgctttaggatgaaaggtggggctctctgttacatttgaaccttagttgctactcctacctcacagctagtgtttctttctcttcataaaataaattgatttcctggtcccttggaaaacctccagactgctttctggaatcattttcatatagcatgtttgttaatttgagctcttgactgagtcccagtgagatgtaggcaggaacacagacctgatacagaaatagtcctcttttggaaataacaatagctactgtttatcgagcaccttctgtgctttgggcactctccctacatgattcctaatcttcataataaccctgtgagataactactcttatgactacctcccatttttcagatgagaaaattgaggctctgagaggtgaagtcgttgcccatggccccacagtgagtggcagatctgagactcagcgctagcctttgtgacacataactcgtgaccagcaggtagtgctacccgattgaaaaaatgtgagacttaaagggatgcatgtgtccctatacagtggcaaaaactggtatgacagaagtgatgttttaagctatgttatcctttagttggacatacactggacccacagagctagagtacctggcaggctcttgctggacaatgtttgctgaatcagagaaagtgggctttgttggcatttgcatgtgaaatactgtgcacatacctcaagatctttgctgttccccccctaaagctactagctatgctggaaacagtgaaggggtcagccagacctggggtcaccttgtcctggggtcccaagccaggcctcctgtcaggttcatctgtctctgttccacctgcactcacacccagtcttgctgctgagagatggagcatccacatcctgaatcctgcctccttcccttgacacacttctatggtgggtgcctgcccaactttttcttaataggactaaattccaaattaaaaaaaaaattcagtctctctcctctaatcatccaagaagagtcctcttttggtaacttgttctagaactatgcctatcttaaattcagaaattgctttcaaatgaattaaattttagaaatatccattcctgttcgtcctattcccagtgaaaataagcaactcttccctcttccaaaacagtggatttcttttctttttttctttttttgaaatgtagtcttgctctgctgcccaggctggagtgcagtggtgcaatcttggcacactgcaacctccacctcccaggttcaagcgattctcctgcctcagcctctcgagtagctgggattacaggtgtgtaccaccatgcctggctaatttttgtatttttagtagagacaggatttccccatgttggccaggctggtctttaactcctgacctcaggtgatcgcccaccttagcctcccaaagtgctgggattacaggcgtgagctactgtgtctggcccccaaacagtggatttccatcttacatatgcatacagatcatctgggagcttcagatccagcccattacacatattctgattctagactagaaaccaagactccgcattttaagcaagccccacattattcaaaatagattgtccatggattatgcttttagaaacattgttcagatcccatgctttaatgttggggagtttatcctttccttctaaatattttttttttttttgagatggagtctcgctctgttgcccaggctggagtgtggtggtgcgatcactgctcactgcatcctccacctcccaggttcaagcaattctctgcctcagcctcccgagtagctgggattacagatgcccgctaccacgcccagctaatttttttgtacttttagtagagatggggtttcaccatctcaaaaaaaaaaaaaatcttaaatagctctagttccctgaattattttctcctaagacatgttttcccaacagttaatgttacttatttcatcttctgatcttactcatattatccacctttcacttaaattggaaattttctgccattttacaaagttcaagactttcctaccttcctacctcctggctgtgtgaacttggacagaatacttccccctctccctccagtcagttttcttacttgtgaaatggaattaaactatacaaaatcattaggttactgtgaggcttaagagtgcctggcacatattacatgcacattaaaaatgtatttcttcccaaactaatgcaacatagcaaacaagttagttcacagtctttaatttctttccttttccctttctttttagctaatagcttttgggtcttaggctgattagaaggaatccttcttggggtgttcttctggtaagaagattgaagctctcctttatttgcttgtaacagaatgctcttcgtatctttcaaaagcgtcaaaagctggatatggaaagtataggccaggtttgatacagaagtgtagtttggcagttttttcagtatccattgccactaattcagtattttgttagatctgttgatgtatggttttataactaaaattaaaaagatttgggtacagtttataagcattattcattttaagaggatttaagaggataagatcattttagactcaagagcagaatattagtaataataattagcttaaaaaaataaacatataccaatataaagaacagcacaaggcaagcaaatatctgggcctatattaacagacggtattcaaggatatggctagaatttccaaaatgcctaataatgtgtaattcttggcattaagccgccaatttgaatatggccctttaatatgaaatgctatataatgacagactttattatagtctgatccaaggcccctgaactttccaaaagggcaacaaaacagacagatactgtattttttcactagttggtactggtggcacccttttgagtgttatttttggcattacgtgtagaggttgacagattcaagacaacactaaacatgttagcagtcaccacacgcaggctgtccagcagaatgacagcgcttcccagatcctagaaagcatccagagtcactgcacccatcccctgggggccctgtagtcctgcatctccagatgatgggagctgcaaacttccctgatggtgccctcttggatgctcatgaggcctgatctggtaccacgactctagcagtaggtccattcaatggcagtaaaaatacatgttgtatgttgatcagaatttggcaggacacatgtggaaagttaatgacatcctggccgagaacccctgtgatatacactggttacatcctgtccaactggagtttttatgtgctgtttttggcagagccaagtgaagatcttgttacttagccattcctgaggtactgaagatacccgggtttttgtcattacaggataggctagaaagtagccagggtctcataaccaaggctttctctgaaacatataatgacaatgctagttatttgaccaaagatatccaatgctttaatccacttggaatttattcttgatgtgaagggtcagcatcatccactggtcgggagcctgatccttggagccaggcagacctgggttgagtccatctccgcctgtttccagctgtgggcaaggtgtctgacttctctgagcatctgtggggtttgtttgtttttaaacctgaagaattgggataatctgtttcctcacagaatcattacgcagatgcaatacagttaatgaaggtaacatggcacataggaagagcacaatacacgtcagctcttactcttcatggctagaagatgtggactaaacttccccctttacagttttgtgattaacaccatttatgaaagaaataaatgaaataaattccttttcctgtcatgaggggaacttacctgattttattgaattatttggtgccattgagttccttattgtttccctctgacctagatttctgggtgtgcgccagtaacacgactgtgattgttgctgctttataacattgtctgtggtcagtccaaacaagagtttaaaataattgaatgaaatggattttaaacaatggtccccccaccctcaccccgtggcactcggccaaaggaagaggaaaagttctctgttaaagaaaatgaatcagagaagaggcccagaccgtgcctccgaaaattctcattgtagggactaagtcctctcactctgaactcacacccgtctgttcgcagcctgacctcatatcctggtctggatgtgcggcctcaccggggtgtcgtgcgcacgtgtggttgtcctgtgggtgccagctctgacttcctccccagacacccactgcctcagccttaatcacaggacgcgcgttgagtagaaatgagaccagttagtattggtaactgcagaggaatatgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaaggtaagcccgggccgcacgggttgggctgagtagccgcgcgccctcccgctgctgctgggcccttcctaggcctcgccgcccgcgcgctcccgcctgcgccctccccgggtcttgtcttttttttctttcttccctcttctcttctcttctcttcagttctcttatattctgtctctctttctttctctctgtgtctgtctcttttctcttctcttgtctctctctttttctctctctctgtctctttctctttctcgcgatggcccctaggcgccgccggcggagcgtggcccccagccccggcaccagccccggtagagccacgccggatggtgacggcggcgtccggggccccacagtgcgggctcccccgaaaaagtttgagaaagccaactcgccaggccttaacatccctgggatcccacgttgtggaatttccaccgttaattgggactgtgtgttaaaaagatcgacccgtgtttgtgaaaacatgcgatttccattaagcatcatgtacacaaggagcaccactctaccatttatggatacagaatttcaagtgatctttccatctcccccacccccatcttatctacagaccacgaagaggtcttaggaattcgctctcttttcaggggaggggagcccatttaagaaggcgtttccaaggagtcccccagagtactggggtgtcatgttcgtttccttaagtgaagctcagggccaggagggcttcacttttgcgttctttctacctactctccttctctaattacatctgttttattttatttttctttcctgttgtagtctttagttttataaatggaaaaaaagtaaattaagggttatgggtcttcactttcgtagcttctaggtgggtatgaaattgatctgatttgagactggtgctcccagaccattgccttcagcagaaaggctatctgtgcttcagagatggagtggcacttggacttctctgttgttttcaactaagaatataagagtaaaaatgtggccgggcgcggtggctcaagcctgtaatcccaacactttgggaggccgagacgggtggattatttgaggtcaggatttcgagaccagcctggccaacatggtgaaaccctatttctactaaaaatacaaaaaattagccgggcgtggtggtacacgcctgtaatcccagctactcgggaggctgaggcaggagaattgcttgaacccggcagggggaggttgcagtgagccaagatcgcgccactgcactccagcctgggcgacacagcaagactcggtctcaaaaaaaaaaaaaaaaaaaaaagagtagaaagaaatgtgaagctcactttagatcaagtaggatttctgctagaatgccatgtttttctttttaaaaaagcaggagaaataaacaggcctcatttattttctaacctatttttctttccttaacctctgactctaccctgaaggcctgcttggagtcacatatgcagatcgcactagtgatgtgggtgaaacctgtttgcccttcttgccacagtttgtgtacctcactcctcttctgtctctgggattccagggggctgaatggcccagagaaggctcatctaggtggagtgggctcacagagcctagcatttggagggtggagattgtttatttgtccctaaaagttgatgtctgagcattccaaatcatcttcaattaatacatcgcttattttttccaagttgctcaaaattctgagcacattctcatttacatctgtatcgagttagtgttaggcatcatcatctccactttgcagatgggtgcctaaggcggggatgaatggacttttgtaagtgcagagctggagcaaagtttaggtcacagctttgccaagtcattgttttgttttcctgggagtaaaccggagatttagtatggacctggctggtttaattattgttttgggaaaaaaatctaaaactcattccaacatgtcttgaaatgaattataatgttgactctaaagtctcaaaaaaaaaaaaaagttctagtacagcagactgccttgggttaaaccttcttctaggaaggtgtcactctaggaattctttcttactgagttttcttcttttcgttgttatagttaattagagaaagtaaatggaattatcattttgtagttggtagactttaacaagcctcagcgatagtcttttaaagactggaagtgctatttgtcttttgggaaaaatagttcctaacatctggatgagtaatccaggctttccactttcactgacagcctaaatcagtcaatcagtgtcgatcagtcagtcagtgtttattgacgcccactcagggtcccaggcattccctgtcagggagagaattgaatgagatcaagtttttcattgttctatcaaagaagcttccaccataaatgtggtttgatggtgcatgctacctgctactcagcctagctgtcaaagcaacactggtaaacataaagatggctagcaattattaaatgcttactatgtgccaaatactgttttattactctatgtgatctgatatagttatatttcatgatagcactatgattatttccattttatagatgaggaaactgagtcaccaaaaggttaggtaacttgtctagggtcacagagccagtgagtgggggtactggaatttgaactcatgctatctggcttgggagagcccacttttagccactggatgctctactgatgtctcttttggaattcactgtgattttcaaaatggtatctccagaaactcctccaattaatccctgaaatgtaagggtagtctctttttcttttctagaaacctgatcctggcaaaatgattagctttaacagtaggattaattttttttaaatgtatataaaaatacttgtatgtaagaaatcctaaaagggtatttagtgaaaagtaattccctctcctattcattttccccacctagaggcaatcaccctggagttttatgtgtgtccttctagaaatactgtgtgcacatataagcatttattataacatgtgaattttgctctccagctttttgtgaatatgcatgtttatagcagtatctattcaccaggaccgcatttagctttgcaatattcggtctactttgaacactgaattttctgattatttctttcccctggagacgtcaaagaaaacatgaacactagccttttgaattcagggttttcttttcattttattttcatttgttcatgtgtttgtatttacatacattgtgcctgaatattgtacatgtatgtgacagttgtgtactgtagaatcaaaaactaatgtctgtgaactgaactcttcttgaactttttgttgttgttgttattgttgcttttggagatagggtcttgctctgtcacccaggctggactgcagtggcacaatcacagctcactgcagccttgagctcctggtctcaagcaaccctcccacctcagcctcccaagtagctggggctgcaggcatatgctacctgactaattaaaattttttttttttttttgtagagacagggtctcactatttttactagtttgcccgggccaagccagtgttgaactactggcctcaagtgatcctcccaccttggcctccccaaagtgcatccctacaggcatgagccactgcactcagcctgaactttcgaaatttattttaagggcccacttttaaatgcttcttttcagcagctaactttccagcggatgcttcatgtggtgccagccatacagatacgcttttagaacttgagctttggagaagcttatgcttgctttctgctctctcctgaggtcatcagatacttcccttgttcagtaacaaagaaagtgagactctttctgttacctaataaaaggccagtctgtccatttcattttgggtgctattaacattgttgaccatttacaatgtcacaggccctggcactgagcacatcatgtgcagcctcacttaattttcacaccagtgccctgaggtttctagaaaagaggaagggccccagtttaggtggcagtacttttcaatttggaggcaggagatcccagttttcctctgacctctctgagcttccgtgtttttacctctaagacagagagaccaatctctgttcagccaccttagaggattgttttgagggtctataagatgattgagggaaagctctgaaactggtaagagttaaatgtatgtttgtgttatgttgatacgagattcctctgagatgctctttagtccaggcaggtttatggctcacacagcgttcctagggtctcattcttctgcacaggcaggcagctcccgagccagccagtctggacccaaatgccacctgtgctcttggctggtcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttaccagtttctgtaatggttgaagtgatgacagaattcagccaatcccacccatagtttttcttgctaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaaaactgaaaatctggtgccacttaccaccttgtaaaatcaagtcattgtaattgtgccagtataatcattgatctgaaataaaagcagaaaataaatcaatgggtagctttcttaaatacataagaactaaagatcaaatgggatattggaagactttaacttttcctccataatggtggatcttaattaaacacacagaagaacaatttataaaataaattcataggtttgtttgttcttttttagtgtcaatttttaaaactatctcttttttaattaaaaaaaatagagatgggtctcactatgtcgcccaggctggtctcaaactcctgggctcaagcaatcctcccacctcagcctcccaaagtgctgggattacaggcatgagccactgcacccagcctaaaactgtctcaaaagtagacagcataatgaactcccatgtacttatgatgtggctttaacaattatcagcttatagtcagtcttgttttcttacataataaagttacagtttcaaagccattaggaagaatagcttgctaattataattacttagttttgatagtgtaactttgtcctcagatgggtagaatcgttactctggaacaggggtgtccaatcttggcttccctgggccacattgggagaaaaattgtcttgggccacacgtaaaacatactaacgatagctgatgagctaaaccaacaaaacaaatcccacaaaaatctcatttctttttttttttgagacaagagtctcactctgtcgcccagactggagtgcagttgcacgatctcagctcactgcaagctccgcctcctgggttcacgccattctcctgcctcagcctccctagtagagggtactacaggcgcccgggggtttcaccatgttagccaggatggtctccatctcctgacctcgtgatccgcccacctcggcctcccaaagccctgggattacaggcgtgagccactgcaccgggccaaaaatcttataatgtttttaagaaagtttgcaaatttgttaggccacattcaaagccgtcctgggccatatgcagcccgtgggccatgggttgaacaagcttgctctagaaattggttttcaggccgggcgcggtggctgacgcctgtaatcccagcactttgggaggccgaggcaggtggtcacctgaggtcaggagttcgagaccagcctggccaacatgctgaaaccctgtctctactaaaaatataaaaaattagccaggcgtagtggggagtgcctgtaatcccagctactcaggaggctaaggcaggagaattacttgaacctgggaggcagaggttgcagtgagccgcgatctcaccattgtactccagcctgggcaacgagcaaaaactccagctcaaaaaaaaaagttggttttcaaatccttctttctttaccatgttacaccataaatatttttgttatattgcgtgtgttgagtactggtgatagggaagacagagagaaataggtgggaaggagatagagagagagagagggagggaggaaggggagacataagggggaaatctatagagacagagactgagagacaaatacaaaaaggttgagacaggaaagggaaaaaaaaacaagctgggagggaaggaagactgagagaagggagacaaagaggaataggatggccagtggggctggggtgggtgggtacagagagagaatgagtgagagcaagagaagcgcaggagacagatgatggacaggcagctgatgtatggatgggtagctggagagagaggccatcagtaacttcacatctctctgtttccatttcctgccctcaaatgccttcataatagagtctacgtaataaggttatagggattcagtgcagatgaagtgctggcacttgatacgggatcagtaagtattagctattattctatcacattaagttgcataaactttaacctcattactcttaaattctctatagaaacctagtctttatctgtcttacaagccctcaaatttagctaatagcgttgttcattgaataccttaaaattgtatttaaagacaggccgtgaatacaattaggcattgctttttgaagccaaaataccatgagggtggggagggtcatgttcatttacccagatcagcaataaaaatactaatggctaacaaggctttctggggaaattgcctgtcattgggtagcccagtgcctctggtgtcagctgaccccggagtccatgaagacatgttaaaagaagaggaaatgtgaatgctttcaaaccagccatggctggcagcagaaggggaggcctttcagtctgttgcaaatggcctgtgacaataaaaatgcctttgtgggtattagcaggctgactgtggacagtctggatctgcggccactgcagggattcctggaacctgttgggaaggtgtccggcgagctcactgtggtgtctgttaggaatctggagcaaatcctatttcttttgaaagcacagagaactgtgtttttacattatacctttaggattttggccatggtttatatttcagtcaaaacaaatcattatgttccctaggcttttatataggttttcctggtcaggttgcatttgtttttcaactttactatctgtcattattgctgctcttattacaggttaacagattattaaactgcacttttcagtaccttgtagctaaagacagacaagtgcagggtgttccacatctgagttcacccagcagtgctgtgttgttgcgttgcactgagcaggcacagaaggctctgagatatgagagacttggtctctaccccagaggagtttacattgttgtggtggcagaagagaaggcgtggcataagagaagacgcggttgttctgtagtgagcatcccagtgtcaggtgccacagttggcatccatgcagaaattctctgcatgcaggattcattgagccctcccgacagcccaactaggttgatgccatgccgttgttgccctgttgtgcagttgagaaactgaggctcagaaacaaatgtcttcaagacatgctggtgctgaggtttgaacaaggcctgtccacccagagcccatgctttttgtactgctggggacatgtgaacagattgcttactgggtgatagatgcagggtggtgatagagacagacaccaggtacccaaatgggttaaaggagaagcatcctgttgtgggcgaggtgatggggaggaggaaggaccggttagagaaggtttatgggagatggggaggccaggaagagcagaagaggctggggaacgaactctagggagagtaaatggcacttgtcacagtgcagtcaggagaggcaagcaacaggaggcctgggggatctgaaaggagtttggagaggctggaatggaaagcaggagtagagggccagatgctcccagtctcaaccctgaagagcctggcatgcctgcttcaggagctcagacttttactatagtggtggaaggaataacaaccccagccattttttgagggcctgtgcatgcctaggccctcaaaaacatgtcccatgttagctgcaaactgccagctaccctgcaaagcacatcatgatcccagcattgcccccgatgacactgccagtaagtggtagctgaccattgggagacagggccacctcccaagcccatgctctcttctgcctctcggctggcagccatctctaagggatttgaagcaagagagtgacctggtcaggtctgcatttgagaaagatggccctgatagtagggagtggaggtggaatggccaaagggggacccagccaagggcgtggtagagcatggaaaggacagaagtgatgagagattgaggaggaaaagtgccaagatgcagggtgggaactgacagaggatgacttccagcctcagtcctgatatgggcgtcaatggcaggtgttcagaatggccttgaagatagtggcatctctatttatgagtgtctttgtactccatttccagtaattggagactttttcaccgtagattcttggaaggtgacacaattttttttttttcctttttggttgagggagggggacagggactgtgtatcttcagaaaggttaatatttgaggccaaggcaggcagatcacttgaggtcaggagttcaagaccagcctggccaacatggtgaaaccccgtctttactaaagatataaaaattagctgggcatggtggtaggcgcctgtaatcctagctactcaggaggttgaggcaggagactcacttgaacccgggaggcggaggttgaagtgagccaagatcgcgccaccgcactccagcctgaatgacaagagtgaaactcggtttccccaccaaacaaaaaaagaaatacctagtttctaccagagacagtcacaggcactgtacttctactctggtttgttacctgtgttcttaaaaaaattaaatgctacattttagtaagaggttagtgaaataaaattttaatttttcccatcagaggacatggagcccttgaattctatcccagactcccagggtcttccaggttaacaagtcctgcactaaggaattggctcagtaaaacctcagcattctcacaggaagagcctaaaaaggagactgggataaattagtgagaggtccaaattatgcaattttcttttaaaataaatgcagttttattactttccacttgtagccattataggcagtagattaaatgagtttctagagaaacctcctttaaaaataaagttatttaattagtccaaggtttaaatatttcccctggaatcttttacatgacaatgtcttagccagacaatttttaagaaacaaaattctccatcctaactcctatccccatcaacagtccaaatcttaacctttctttttttttttttagacagagtcgagctctgttgcccaggctggagcgtggtgatgcaatcttggctcactgcaacctccaccttccgggttcaagcgaaacccctgcctcagcctcccgagtagctgggactgcagatgtgcaccaccacgcccagctaattgttgtatttttagtagagacgtggtttagtagagacgacctcccaaagtgctgggattacaggagtgagccaccacacctggccagaaaccaggtgtttgatatcaggtgacggttgtgatcattgttcgcaccactactttgaaatgacatagttgccactggaccttgttatttaatgtgcgaataaagagacagttatttaaggcattaataagagctatattacaagtttttaaaagtcttttgaggactgtttcaaaaagtcttttgaggactgttctcctttgcaatcctctgtaaatgcaccattgcattccaacccgggcaacaagagcaaaactctatctaaaaaaaaaaaaattcatccacaggacagcgctggccttccgttagacttttgctgttgagtctgtaagttttcagcagctgtgtttctccaaggagcggggctactgctggttctttacgtctttcccccactgccctgcccctccctgcaccctagcagctgacacagtgttttgggatttgaagataacacaaaggctgtgttcagttaaacgtatgtctgtgtgtgtgtgtgtgtgtgtgtgtgtgcttgtgtgtgtgtgtgttttaataattttaacttctctgggtgaaggtgtaaattacaaaataaaggaccatgtagaaatagataaaatgactttcatcaagctcaaaatgtgggaaataatacttttcctctaagctcatattttgaaaagttgtttgagactgttataaaataacttgagaatagtctgagcatgatctcatccgctggaacggagtatgaaataaaacacgaagcctctttttagaaggatctgttttatagatttttaaattacagagattccttgaactggaggataatagcgaaggacccacaaaggaaatatgaataaagcagcacaagtttaaataattgaatgtgagcaaaattaaagggaacgtttgtcacgtctgacatgctccatcctcctgtcccccccacactgaaccgtctccaagaaccttccggagagcccacagtgtgaacagtaatgaatgctccatagctggccgccttgcactctagtgggaactatgatgttgggcacaagtgccagcaggaaggtgggaagcttcccggggatgtttttcctggaggtcaagtccccccttgggctgtgaagtagccggtactggggttcatgggcatttcccttccctgactgttcgccagcgtctggcacagcaccagcagcccctggaagtctaggccagatatgccatgtccgagaatcttttgtaaacatttttcatcagtgactcacagctttgagaaaggattatttttatataaaacgatctttcaattttactttaaagacccaaaccattttcttagaatactgtctaaacaagttaatcatgcacagatccagtgaattctgtggcctggttcttataaaatttccaaataattttatactgtcatagacagagccagagctttttagaggtttgaggcattttttagatgtattactgttctcggtgctcaactagctaattagtgattttttctgagtttagttggtgagtggaaacctttttgttaacattatgacaaaataacaatatggttttaagtggagtgagaggcacttttgaagatccagatcttagatccagatcttaaatctgtttaaagtatgactcagaaaggaggctgcagaaaatgttcactaaaaaaatttaagaataatagcagatgctaaaatttatttcccaagacaatagccaaaaagatctgctggaagaacagaagaagggaactagttggggcatcttttttttttgaatgaagccttcagccttctttaggggaatcttgcttcctgacagagggaccggtggaaagtttgtgtcttaagcaagaaagatttaagtacattctgcaactttggccttgtaagctgtgatcatttttaaggttgacgagcatagttcactatgaaatgaagcaagtaacttggcatttatacattgtgagtcaattttgacatcagcctggattgggaattgactggaaggttttggtgttggactgtggctacacttcagtgtctcggtccagaggcatgcatgagcaatacttccctttgggctttagccattaatttgtggaatagagcaagaactggagaggaaagtcgagagactgccttggatcgcctgacgtcctgttgaatcaaaaagcagtgggaggccctttccttcctaacaaaggcctcatcctcttgcataacattcccagcatctgtcgacatgttcgggaccatcccactttaacccacacttcaagtggatggccacctctgggcggggatctgcattctgcttattccaggtgttttccaggccacttccccgattatgtaactttgatcaaatccagatgcggcagaatgtttgatagaagaggtcaaatggcatttgagaagaaaagcatttctgtattcatgactttggtttaatttcctgtgtgggcctggtctgccaaagttgtatgctcatggccacgaggttgacgcaccagagggaggcactcaagtgccttttcaggacagcctgaaggaagcctccctccccagcatgctttttcatgttaaattatcaattatgtaagtttagggccaggcgcggtggctcctgcctgtaatcccagcactttgggaggctgaggtgagtagatcacttgagaccaggagttcaagaccagcctggccaacatggcaaaaccccgtctctactgaaaatgaaaaaaaaaaaaaaaaaaaaaacttagccaggcgcagtggctcacatctgtaatcccagctactcaggaggctgaggcaggagaatcacgtgaacctgggagctggaggttgcagtgagcctagatcgcaccactgcacttcagcctgggcgatggagtgagactccaactcaaaaaaaaaaaaaaaaaaatttcaattggcttctattaaagcttttttatgtttgtcattgttttctagtaataacaacaatccacattttttgtgagaaatataccataatatagagaagtataaagaaaatgtaaggccagacacggtggctcacgccgataatcccagcactttgggaggctgaggcaggcttatcacctgaggtcaggagttcgaaaccagcctggccaacatggtgaaaccccatctctactaaaaatacaaaaaaagtagccgagtgtggtggcgggcacctgtaatcccagctactcaggaggctgaggcaggagaattgcttgaacccggaaggtgaaggttgcagtgagcagagatcacgccattgcactccagcctgagtgtcaagaacgagactccgtctcgagaaaaaaaaaaaagaaaagtaaatttaaagcacttaaaatcccaccaccctgagttaactactgttcacagtttggtgaaattcctcctcgtcttctattttttcatagttgggaccatgcctatatactggaatgtaatataaacacttaatatattattgcgagtatattctcaaacttaaatattttttccaaaaatattttgagtggcttttaaaatatatcctattttatgcatgcagcataaactaacttatcctgtgttgatagatattttgtacttgcccttttctgtgctgttgtttaaaattagtgtatagaaataattgtgttgatcacttaggataaattcctagaggtaaatcagatattaaattctttatagacttctggttcatattccagttgccctcaatttatacacctactactagcattgtatgagagtgcccgtttctctgaaatcttacccacactggctgtcagcgtcaaaaagatgtatctgcagatttggcaaggaatttgcatttcagtgattattatcaagcgttcacacactttccatgtttaatggtaattttttttgtttttttttgagacgatgtctcactctgttgcccaggcagagtgcagtgccgcgaccttggctcactgcaacctctgcctcccaggttcaggtgattctcctgcctcaactccttagcagcttggattacaggcatgcgccaccatgcccggctaatttgtgtatttttagtagagacggggtttcaccatattggccaggttagtctcaaactcctgacctcaagtgattgcccgccttggcctcccgaagtggtgggattacaggtgtgagccaccgcacctggcctttaatgataatgtaaattttttgtgaattgtttattcgtggctttgccccattttttccatagtggagggatttttctttttcttgttggtatgtaaagtccttgtgtgtcaagaatgctctgcctcacagtttttctaatataatgacagtggaagctcgtaactggcttccacttgactgacttgctaaattgaccggcactcttcacttccttataaaacatgcctccatagtccctgtgccccatggcacatgggatggggtagccacactaccactgtctgctgctgcatatgttcctgtccacaagagccagtcatgtttgtttccaagcctggttctttcagatatagctgttgttgtaattacttggttgatatgaaaccaatgaaatgcaagtgtgaaaagagaattgtttctaggaaaattaagatgaatgctttagaaagactcagtaaaggaagataaatttaacaaattactacagaattaggtgtaagacaacagtaaatgattggaatgaattacagaaatctagaaagctttgacagtgggaatgcgtagtgaatggctctaagttctccctccatctgtaggaaattgaagctggaagtgagatgatatattcattatagggaggacttacagaagaaaacatcaagctctaatcacatgtccacatttcgttttgtttacttattttttgaaatggagtctcactctgttgcccaggctggagtgcagtggcatgatctcagcttactacaacctctgcctcctgtgttcaagcgattctcgtgcctcagcatcctgagtagttggggctacaggtgtgcaccaccacgcccaactaatttttatatttttagtagagacggggtttcgctatgttggccagcatggtcttaaactcctgacctcaggtgatctgcctgcctcggcctcccaaagtgctgggataacaggcatgagccaccgcacccagccccacatacctacatttcaaaggacagtctttggccctacagtcaagactaccaaaccaatgtacactaaatgggggtggggatcacgttgttgttttttgtttgtttttgtttgtttgtttgtttgtttgtttttttgagagagtctcgctctgtcacccaggctggagtatagtggcgtgatctcggctccctgcaagctccgcctcccgggttcacgccattctcctgcctcagcctcccgagtagctgggactacaggtgcccgccaccacgcccagctaatttttttgtatttttagtagagacggggcttcaccgtgttagtcaggatggtctcgatctcctgacctcggggatcacatattttaataaaattgataatccctaatagtgatggcgctaggtgtacttttagagccaatgtaaatagtcgagaaagggggccaaacatatgactaagcttcttctacactctaggagatgtcagtattgcaagatcctgttccttgaaattatctttgccccccgccattcagaaaaattaccaaatattgtaataatgtaatttaggacttaccctttcagagaaacagttcctgaaggttgacttcagttagtagtacagaagcgagacttgaagctcttcatggtttatgttctgttggtttatcccaaagagatgttttagagcacattcatttctgaaagttctcggtcatgtttccggaagtttgatcaggtgggttctttttctttttttaaaagataattttttttttaaagataattcagaatcagtcccacccctgagatggtattattacccaggaaagaatgcgtgaggatcctctaaatccatagagaaggaaaactaaaacaattttgttaccatttgtttggctcaagcatctggtagatccttcagttcttttcaaattagaattttcctctctttttcttttttttttttttttttgagatggagtcttactccatttcccaggctggagtacagtggcacaatctcggctcactgcagcctcacctcccgggttcaggcaattctccggcctcagtctcctgagtagctgggattacaggtacccgccactaattttcatatttttgcctggctaatttttgtgtttttagtagagatggggttttgccatgttggccaggctggtctcgaactcctgacctcaggtgatctgcccacctcagcctcccaaaatgctgggattacaggggtgagcctccacgccgggcctctctttttaagataataaaaattactaaacatcataatgacatgatttgggattactctttcagagaaacagttcctaaaggtttacttcagttagtgatttttatttttattatttatttattttttgagatggagtctcactctgtctgccaggctagagtgcagagacgagatctcagctcactgcaacctccgcctcccagactcaagcgattctcctacctcagcctcctgagtagctgggactagtagctggaactacaggcgcccgccaccatgcccggctagttttttctattttagtagtgacggggtttcaccgtgttgcccaggttggttttgaactcctgagctcaggctcaggcaatctgcctgcctcagcctcccaatgttctagggttacaggcatgagctactgtgcctggcccagttagtgatttttaaattgtagttccttaaatgagtattttggatttcactccacaatgttcttcaactgtaagatctacttgaggttatttgatttgctggtttgcaagaactcgtctacacgttgtctttatcacaaagaaattctggagcgtttgagccctgttcaaaaaaaaaaggcaagaagaaacttcaggaacaaataacctatttgaccctgtaatgaataatattcacacattttctaatttaagagctgttgattgatttccaacttttagaatctgtttcagacaaaacatggaagtttagtaacagttttttctattctgtaataataattgccacaaggttaaaaaaaaaaatttacagaagaacatatttgagggtggtcgtgggggcaagaaagctggaaggacgggtggggtgtgttaatagccttgtcttgtgaagtaagtcctcagagacgctgtcctagttggaagaacaggcagtgaaggtgtgcgtctgttacggagaataggactccagtgatctagctggtacttagagaggtgggggtgatcaccaaaaaaacagctctgcctctgggagcggagaggactgggatagaaagtatttgtctttcattttaagcccttctgtacgatttgacttttctttttttttttttttttttttttgagatggagtctcactctgtcacccaggctggagtacagtggcacgatcttggctcactgcaacctccgcctcccaggttcaagcaattctcctgcctcagcctcccaagtagctgggactacaggcacctgccaccatgcccggctgatttttgtatttgtagtaaagacaggatttcactgtgttggtcaggttggtcttgaactcctgacctcatgatccacccccggcttttttttttgacacggagtttctcgttacccaggctggagtgcagtggcgcaatctctgctcactgagacctccacctcctgggttcaagcgattctcctgcctcagcctcctgagtagctgggactacaggtgtgcgtcaccatgcccggctaatttttgtatgtctaatggagacagggtttcaccatgttggtcaagttggtctcaaactcctgaactcaggtgatccacccaccttggcctcccaaagtgctgggattacgggcgtgagccaccatgcccggctaaagcaagaaattttcattgcatattttaagcaaaggcaaatgcatatgtggatagactgttttaatttgactaaagtcatattgaatccatgaattttagaagctcaaactattggggaacaataattaccaccttggagtgaaaatacttaatttccacaagatttagtaaaggaagagttttttaaaaaccaccttaatgataatagtatgtacagatgttaagaaatgaaataggaatgtgtaatgttggaaacacaaatatttttgcttctgagaataaaactaattttttctcccaattttctcttcctttttcttttttctgttcccccctttctcttccagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtaaaagggttgtgggcagctagtggtggttgcaggagatagaaatctgggaattgcggtttgacctaccaccctttgctcgttaaaggagcagctttgaaatctggactgcagggatatccaaaacaacaactgcatgtttctaagggagtcgactctccttagaggagttcttgtacaatagccctgggcaaaaacagaacttgccctattttttatactgaaaaggacagctggacaaaatactgaacgcaatttttcccctaagaaaaagcattatttccctaaaatgtcttatattaggaacagagcacttgaataaacataattgatttataaaaactgaggctatacacttacctatctgttcagtacaaacaggaagcttcaaatgtaaacgtgaattctcatacacttataaatgcatatctttatgtggacttgttaaaatgaaattggtatttaggaatttggagatttttagtagttacacaagaatcaatgaaaaagaacgaagctggtttccaaagctgatatgtctgatttggttcctttcttctcaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaaggtaggggacccttggcagggggcgctgatgggcccagggcaggggaaccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcattaaagaaagggaggcataaagagatcttgcccgatgtcaacctagtgagtcactgatggaataggcttggatcccacagtttattctactgcaccaggctgtagttgaggtacagtgttgataggtggtcccgatggtgtatgtttgtttgtttgtttgtttttgagatggagtcttgccctgtcacccaggctggagtacagtggtgcgatcttggctcactgcaacctctgcttcccatgctcaagtgatcctcccaccttagccttccgagtagttgggaccacaggcgcacaccaccatgcccagctgttttttgtttgtttatttgttttgagatggcattttcgctctcattgcccaagctggagtgcaatggtgcgttctcggcttactgcaacctccacctcccgggttcaagcatttctcctgcctcagccttccaggtagctgggattacaggcatgcaccaccacacccagctaattttgtatttttagtagagacagggtttcaccatgttggtcaggctggtctcaaactcctgacctcaggtgatccacctgcctcagcatcccaaagtgctgggattacaggcgtgagccaccacgcctggccgtttttgtatttccagtagagacagggtctcgccatgtcgcccaggctagtctcaaactattgagctcaagcaatctgccctcctcggcctcccaaaatgctgggattacaggcacgagccactgtgcccagcctatattttttaaatagtatgtaatgcatgcatatggttaaaaaaaatcaaaagaacaaaatgaattacagtaaaaagtaatcgtctcctaattcacttttcctgcccagaggcaagcactggtactagttccttctagagttacctggacacagatggatggtatatagatgtttatgtggatgtttatattcaaaaaggcacgcaaatgatacatgcacgcgaatgcatcatgcttctcccgtgtgataatacaccttcgagattgttttatggcaacaggtttagagctgcctcattcttaccagtgactgtgtaccgtggatggactgtcacttatttcagtagtcccctgctggttgacttttaggttgtttccaatctttagttattgtaaataatgctgatatgaggtggctttcaaaccttttcaaaaatctggttctgctgtaagaaaaactcattttacaccaccacccagccctcacaatataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaagggcttgtttccccttaacccacaccaacagtttattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattgggccctttgaaagagccttcagaccacaagggtacctttctagtgaatcagaacaccagggtgcaccgcccatggggggtgattttctggagcagacagcttgcttcccatgtgtgctatttatccaaggcaagtcatgctgcaccgagatagtcacttgaggtttgcaccgaacaggataatggtttcttttccctagagctgtttaatcagcaaccttggaacagatgcaggcaggcatgatctagtgtgacagctcattagctaggggttgatctaaaatactgttcaaatgggcaaggaaaggcctgcgtatgggatatgtgatttgcagaatttgagattcatccaaagagggagaatctgcctaagatgcctctgtctaaaagctagtatgtgccaggtgggtttgtttcattccaggtagagcacagggagcttatgtgaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtattgggtgggatcgtatcactggaatgagtgaacatcgttagagggagctcccacagctatgcgtgtgaccgtgtggctcgccgctgaaaaatgctgctcacatagcagaacttcgatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgtgtctctcctcgtgttctgagcttttcagcagcccttgtgggtcatcagccgaggaccatcagctcggggcccagagctggggactgggagttatgagctggactcttgaaggggccaatactaaaccgagccgttgccatttcctaggagccttgacaggctcaaacatctctgggtacccggggatttgactgtcattgttctgatcctttcccaaagttgtaaccctctgttgacatagcggaattgaagattgatttttcttcaccaccttctgcctaaagttcttagttctgaatgtgtccacacctcattgacttctatgagatgcccctgtcacgttcctcgattccttctagtccttaatagagtctttccttttcttgaaagaaatttgcccagttgacatttattttcatcgtctgctgaagtgacagatccaaggccctaagcttcagcagagttgcaggaagggaccatttacacagcctcttagatgtttaaggtttacccgccctgacagtggctcagcaggcgtaggcctcctggtgaaaagccgagcacatggctaacctgctctggtggaggggctttggaccgttcttgtgtactgcgaggcttgccttcctgctggtgtgtgagcagctctcgggggaacttgcttcctggctgagcaacctgtaaacagtatgtctgaggtgggactcccgggcccaaagcagccaaaggttgcacaagtctaagctccgttaggcctgtcagtgtggctgtcaaaagaaacgctgtttcttttctttctttcctttttttttttttttttttttttttttttgagacaggctgtcacccaggctggagtacagtggcacaatctcggctcattgcaacctgcgcctcccaggttcgagcgattctcctgcatcagcctctcaagtagctgagactacaggtgcccaccagcatgcccggctaatttttgtatttttagtagagatggggtttcaccatgttggccaggctggtttcgaacgcctgacctcgtgatctgccctccttggcctcccaaagtgctgggattacaggcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgttagtgggacacggggaagatggctgtgaaccaaatatgcggtgcctttgggggagaatggttttagtatttagtaagtgtcagtatgtaagttttatgttgaaaaatgaactaagtcacaacaaggtctataaatttaattattgaaaaggataaagttgggccattcagtgaaacctcctgtaactgaagtctctaacacagtagccaatgggggaatcaaatgagcccaagaagaaattctgcgtaaactaggacttaggggagcccttagcattccactttggagtgaaggaacccgatccgccagttggggaacgctcctttgaggcccatgtgcttcctgctccgacgggagagagggataatgagacttgctcccaggtgccctgccctggagcccagcaggccacacgggctctttgactctgtactgtgccagtgatttccaagatgggagtggtgctctgattgcaggaatgtcttcttggaatggcttttctcacttctctagagtccttggtagggagcacatcatcagctgagctaacgtgagaacaggggttggagcacttgccaccggcagtgaagtaatcggacagctgacagtcttttccagagggtcggggattgggagctgaccccaggtcccgctccgttttctttgtgtgcagcacttgtgttggtgaccagcagtgaagagagtgcgtggacgtcaccgtgtggttatgaagctaacggcagccctcagcggtgccgacttccgctccccgacacattcctgtgtgcacgttcgtgggtctgagcgtgactcatggtgtgtgtccctagagcagttcactcagaggcttctcttccgtgctctcaagaataaaagcagggccgccacatcctgataagtcttgccattcagcggtcctgtcttgcagagggataagccagtgtccccaggccacagtccttacaccttgagcaagttccccagagtgaagcaatctttctagacaagttttgcgtttctcagaattttattttagtgatattgttaccaaaagattgtaaccccaaaatgtgtgcctttggcttgcctgttttaggaattcacttgtgttatctccccaagcaaaacaaaagaaagagaaaccttcctgttgacgaatcctttttaccttcttgagagttgtcaatgggactaacttgtatatttctttgctaccttcttttaaaaacatttttcttatttactattacagacgtatagtaatggtgcctgacataacccacagccaaaggccttggccttgctgtgtgtatttcaggctttttcttcccttttctttttttttaagtaataagatattacagttatagctgaagcctgatcctgttcccttttctccctctcgtcccaagcatcaccactgtcccaaatctgctccttcttcccacatctttgcagtttgggcaagtcttctgaatgcctagtcatgattttaagtcttctttccaccttcagtgatggttggctaccctgagcaagccagtagattcagttatgtgcctggagtccagatgttttatgtggatttttcatgtggaattgtttttggtaaggaagtattcccttgccacaccaatgaaaagagaagaaaacaggtagctggcacccactgcattgttgctttctgccagcctgctccttctccttcctctccagctctgttgtgtccagatgcaaactctacatgcagggtttgaccctaggtcctcacctgctgtagctctcacacggggaccgaatgctcttgtgtcgtaaatccttccttttgcttcctcgtgttggatgtgtttagtggttttcatcttctggtcactatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgtctttttgcttgagcgagtaacttagagcacacgtagagaaagacagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttgttggctgatttggaaggcaggtgccctgggcatccccagtgggttccaattctgcagctgcccagactcctgcaggcagaggtggaagtgtccccgctagaaaggcatccaggaaactcgcttttgaccaactcagatacagtctggtctttcttgttaactgggactttaccctctccactaatgaatagtgtttgtagtttccaggcaggtttttttcttcttttgaagttctttgaaacccttaggacgccaagggaaggaagttttcattttcagccctttgcattcttcaaaatgtgatccaggcttttccctgtggcgagggtgtcccctagtgttgacttacattatttccacttgttttaaatgaactttgattaccttgacctgtgcacagaaatcaagagaggcagcccctttttagagctgttagaaaagaactgaaacatccacctctgggaaaaatagagtttagtttgtgcatgtgtctcagaagtcaggtgcacacattgagactggtgcagccacatgcctgccttttagggactccttgactgacctgatgccttcacccaaaggcatagtgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggcgattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccagtaaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattaacttacgatctcacagttggtaaagaattacaggatgtcattgcgtggatttctgtgggcagtcacccggagtggtatctaattagggaaaaggcagtatgtccctttctggaagtgtgttaactgaaaatacggtactaagcaactgctaaataaattagccctccttcctcctggccgtgcgcagaaacatccctgcagtatgttgcctatttgtcaaataagattagtgtaaatatggggcatttacctttgctatagaagctgaaattgccaggcacggtggcttacgcctgtaatcccagcactttggaaggccaaggctggtggattgcttgagcccaggagttaaagaccagcctgggcaacatggcaaaactctgcctctacaaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccaaaaaaaaaaaaaaaaaaaaaagctgaaatccttgagtggattctaaatcatggcagtggctaacattcagcttcatcgtgcccttgctgtgtgcctggcagagacctctgtgcttactacatgtcgcatctcattgaatcctcacaaccttaagatccttccaggttgagcatcccggaccctaaaatcccaaatcctaaatgctcccaaatccaaaactttttgagcaccggcatgcagctcagaggaaatgcatactggaacatttcagattttggattttctaatttggagtgctcatctggtaatatagtgtggatattccccaatctgcaaagatctgagctccgaaacacttgtagccccaagcctttcagttaagggacattcaccctgtatcaacattttaatgctgagaaaatggaagagagagaggttaagtgactgacctggcatcacacagccaggagtggcagcatcaggatttgaactggggcactcagctccaaagctcagctcttcttttttaaaattgaacccagattcttatttctcaaataccataaaatatttacataagccacagttatgccttttaaaaaaaaatcaccttttccccccactctcccatttacttcctttgcagtttgtggctacgatctaccttcctcttcaaaacccttgaaaaatccttgcagccttgcccaagcgtccttccctcagccgatttttgggcctcagtttcctcccatccagcctgtttcctatcgctggcttctccaagggcagagccagagtcctcttttgccagcagggggagcaagggcctacttttaaccgcaactccatagtgaacaagtcaagcaaccttgggtcattcatataccttccaggcagaaggaagacagaagagaacaggaaaaaagcaggacactaggctgacccctgcagatgggaagctggaattacagcaaaggctcattgattgggaactgcacccttgaattttgatagtattgggcaggacatagtcttgctatctgtgttaaagggaggacgtgcttaagaaaaccaacagtcaagtacaagaagctctaattttttttgaggtgggggaacggggtctcactgtgttgcccagctggcctcaaactcctggctcaagcagtcctcccacctcagcctcctgagtagcagggatcacaggcttgtgccactgtgcccagctaagaggctgcaattttttaatgaactgtattcagagtttgtacatcagtgtcttttttttctatgaatcagttctctaagtaatagaatttggaaaagaccgctggtgatctagctgtggcatttagattgactcatgagctaactgacaaatttactacttaaacagtggaaaataatgtgcaggatatatttttttgaataggttgtcccaccctcgagttctgtgtctttcctgagtccgcatatgtgaaccttgttttaaccaggtgacagcatcccataggcacggatctctgtcttctgttgtccacatcatgtgtcttggcagttgttccttattgatatacataaggttgtcttgtttttgtatggatatattttaacatgtaccagtgttcagtgggcctttctcttatttccaatattttgctgttctaaacagcagcacagtgattcccctcatttgcatgtatgtgaaactatcctggtgggtccgcttccagaaactactggatcagggaccatgtgcatttatggccttgaccatactgccagagtaccttccaaggagtttgtgtcatcaatttgcactccccagtggtgttgagagagtgcctgtttcctccacccagcacagtgtgtttcggttttatttctcccaggaaatgggtgttagttggggagctccagaaagaagccgagaagaagggcagtcgtacccttggcagttgtacgcagtggctctctggccgcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggataatccctgtggtgtttcactgtgcctgtaacctctctcacctagcatttggttaaccagaaacagatgtggaaactgatctatctgtagataatggccctgctcagggagggggtccctgctgagagcgagacattgaaagcctgctacacagaaactgctggaaggccaagccatttcttttttctttttctttttttttttttttttttttcagacagagttttgcccagtagttcaggctggagtgcagtggcatgatctcagttcactgcaacggcctcccaggttcaagcaattcttctgcctcagcctcctgagtagctggcattacagactcctgccaccacgcccggctaatttttgcatttttagtagagacacggtttcaccatgtggccaggctggtctcgaactcctggcctcaagttatctgcctgtctcggccccccagagaggccaagccatttttaaaaacagtgttctttttcatgctgtagaatacctgtgcttgggggtgagcaaaaaggaggaaactgattagaaaatacctatgagggccgggtgcagtggttcatgcctgtaatcccagcactctgggaggccgaggagggcagatcacaaggtcaggagatcaagaccatcctggttgacatggtgaaaccccgtctctactaataatacagaaaattagctgggcgtggtggcaggtgcctgtagtcccagctactcgggaggctgaggcaggagaatggtgtgaacctgggaggcggagcttgcagtgagccgagatcgcgccactgcactctagcctgggcgacagagcaagactccgtctcaaaaaaaaaaagaaaatacctgtgagatgttgagtctgggagaatgtatctgtgagaagacaaacaaccctagtattcattaaagaaccagcctttgttttctacaagctatctgttcggtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccgtaccgcccagaatgttcatctgcatctgggccagcctcgtcagtccgtgcaaagaggccagttgacccatctccctccctaacaagcacagaagagaccaggctgaaaattcatagctttcactcaaagtgtttccttcacctcattcatctgagttagctttattttactatataaagagaattttcttcagcaaaatgataggaatttttttaatgaaagtaaaggaatgtcacagaattgcgtcagggatatttccagtttaacacaactacaaacgtaggctgttttgttgttgttgttttggttttctattttgagatgaagtctcactctgtcgcccaggctgaagtgcagtggtgcgatcttggctcactgcaacctcctgctcccgaattcaagtgattctcctgcctcagcctcctgagtagctggaactacaggcatgcgctaccacgcctggctaatttttgtatttttagtagagatggggtttcaccatgttgaccaggttgttccggaactcaggtgatccaccttggcctcccaaagtgttgggattacaggcatgagccaccacactcggccagctgttgttaatagttaaaattataaattggacaaggtctgattccagcagggggagacaaattcacattgatttttctataagaaaaggaattatttgtactttcctcccttgtgtgtttgtgtgtatgtaagagagacagatgagaagagggctgcctttgagagccatgttccttttgcatgtacatacctctcaagattattacatgggtcttttagaagagggtcagtagctataaaagcaaatgatatttatgaaatgatttcattgtatgtggtttattatgtagtcttcaaaacagaaaaaccccacttgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggggtggtgacagaggtgagctctttccccctcggacagcttggcatggtgactaccaatgaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggaccatcaggacacggtgtctcccaaacgggccggaacatacaaggttctacgtttaatagaaagttgatcaagccttcctctttggggagcctaatttttaagccattcactctctgttcccctgcagtcttttctctccaaactctgttgaaacttggaggcatctcgcttcctcctttggcctttgtagccaggttttcgcagcaaacagaccatatcatttaacacccacctgcttcttgttctgatagtcagttcagtagacagtagcattttttaagtcaaaaagaggcttagtgatgtaggccaaggtcaaggctctgtgtcatggggctctccccagggctcagtgccacggcacttcagacttgaccccagactgaaaagatgagaggacctgtagaagtcacggcctgtctgtcccgggcccatgctcctatctttttctcccccttggcatttagataccatggacttgttaaaatgtgacatgtactgatgatccttatgaatttgttggtaggggagctgctggtgaggattattttagactgtgagtaattgacctgacagacagtgatgactgcttcattaagagcccacgaccacgtgccagaatagttcagcatcctctgttgctactgtactttgagacatcgttcttctttgtgatgcaatacctctttcttgtcatgagggtctcttcccttaaatcaggtacatttcagattcttcaggtgatgttttttaggctgagtgtgttagcaccccttggaaaccaggttccctggggaaagtgtgtcacgtttgtggtgtttgcccgtatagctctcccacacccccacgagctccaagaggtggggaagcacatgtggcctgcctagcaggcaccagaagcaggttgtcggcacatgcaagccagctttgccctgttgcctgggggagaattgaaaagtttggccccaaaggggaaaattctttctgccatcaagttgctggtcagctgtcatggaacctgtctgcagcaatgtggctgtcacaaaacgcagcccaggacgagtatgcgctgaagctccattttgcattaactagtcaagtacttacccactgaaaagcacttcctgaaataatttcaccttcgtttttttccttctgcaggaggacaccatggaggtggaagagttcttgaaagaagctgcagtcatgaaagagatcaaacaccctaacctggtgcagctccttggtgagtaagcccggggctctgaagagagggtctcgcgccgcacccccagggtgacacaggcgctggggaagacgcacgggcggctcactgcacaaaacctcgttggaatatttgtgctctgccgacgttcagccgcgggtaaaatgaggcctgtatgggatgggtgtgtgcgtgtgtgcacatatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattcaagttcactggcttgagaagaagaaaagagcctggccatgtccctcccacacgagcacagtctcaggatgcaggtgcttgggaccatgttggaagttgggcccaggactgaggagcagagtcagaatccttcagaaggctttttctttagacagttgtttgttcagttgggagcggagccacgtgttgaagtcctcgttgtcttgttggcaggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacaggtaggggcctggccaggcagcctgcgccatggagtcacagggcgtggagccgggcagccttttacaaaaagccccagcctaggaggtctcagggcgcagcttctaacctcagtgctggcaacacattggaccttggaacaaaggcaaacactaggctcctggcaaagccagctttgggcatgcatccagggctaaattcagccaggcctagactctggaccagtggagcagctaatccccggagtaaggaatatttcatttttgaaccattttgggctaagtggaatattaaatgaagttcataaaaggcgtccttcctaataatcacagtcccctctgaaagagagtactcattgttcctccggggccagcgcccagcagtaatggcctcttcctgggagccgctggcattgcttttacgcaaactcatgggaacaaccagtacatggcttttgttttttagtgtgtgtgtctttttttcctgctttctctttattatcttttcattctccacttaacttgctgtcctctgattcagggatgtttccacaattgtcagaattgtgtatgtggaggtctaaattaagtgtctttgctgttttaaaccctgaagtgttttgaccttcaaatgtgccacaattatcttggtcttcaaattctttgctggtggaaatggcttcccagcaaagcgacggcctgtgcaggacagagcctgatgggctttgctggcgtcttttatacgagatgttctccacaccaccactgtgacctttcctacccaattagctcaagtatgaaacctctacatgagatttcatagcaaggaataagggtagcatgtgtgaaatgctggcggctccttgtaagacagattttctatgctccatgagagcctgatccagatactcctggctttcaggaaagtgaatcctctgatgctgcaaattgagattgcttgacttctggtttgcctggcacggccgggtccgttccttcttcattcaagcgaacttaaaatgctttatcaaaatcctcttaggcacaactcttctgtatttaatttcactcttgttgctgacgatcaggctatctcacgcagccatcacctcaagctgctgccccctctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctccgtgcctggcatagagtagcaataactgcacttactattctcgacacttcaatcaaagcacttagcatattaattaattacactcacagcaaccctaagaggtaggtgccattattatcgtcttcattttacggatgaggtaactgagtcccagggtaattaacttgctccaggtcatgaggccagggagcccgctcccagcaccagcctctccccatgttgggatctcagggtgtgtttgctgagaggctggcactgtgttaattgccgtgggcattaatacaaacttccagggcattggactcaatctttccattgtcagcattgcacctttgctcagcagtggtggatttgtgaagtggaaggttggccaggagctctcatgggtgaacattttcctttcttagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggctgctgctgcactgaagtggtccttcctgactacaggagggtttttttctgcctctttcttgctcttccctttcttttcttcctttctttttgtttttttgagacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttccatcagtagatacaaaatgcttcatttatttccttccttcctttcctcccctctccctcccctcctctcttctccttctccttccgacggagtttcgctcttgttgcccaggctggagtgcagtggcacgatcttggctcactgcaacctctgccttctggtttcaagcgattctcctgcctcagcctcctgagtagctgggattataggcgcatgccaccacccccggctaatttttgtatttttagtagagacggggttttaccatgttggccaggatggtctccaactcctgacttcgtgatccacccacctcggcctcccaaagtgctgggattacaggcgtgagccaccacgcctggccccaaaatgcttgatttgctatcgtttttttgtgggggtttttttttgagtaatttttggcagttactgatatacagtgcctagatccaatagtttgctaggtattgccaggtaggaattctctaattctgtcattcctgttaagttactagtggaaacttgtatgaggagaaacagttcctcatctgtgtggttactcagtggtacagttcatgtaggaagagcagggtcaattcttgcttctttgtttttatttaccagtttttaaaataacaaattactttttcttttttttttttggagccagagtcttgctttttctggggtacaaagtacaggctggagttcagtagcatgatctcggctcactgcaacctccgcctaccagattcaagcaattcttctgcctcagcctcccaagtagctgggattacaggtgcctgccaccacgcctggctaaatttttttgtatttttagtaaagatggggtttcaccatgttgcccaggctggccttgaacttctgagctcaggcagtccacctgccttggcctcccaaagtgctgggattacaggcgtgagccaccatgccctgccacaagttggtttctttttttttttttttttttttttgagacagtctcactctgtcgcccaggctggagtgcagtggcatgatctcagctcactgcaagctccgccttccgggttcacgtcattctcctgcctcagcctcccgagtagctgagactataggcgcccgccgccacactcggccaattttttttctatttttgtagagacggggtttcactgcgttagccaggatggtctcgatctccggacttcgtgatccgcccaccttggcctcccaaagtgcacaagttagtttcttaatacccttcagtggtggccaattaggtttttgctgtcattggtggtattatgaactctcagatttatatatatctgatgtgtttcagtccactgcggttattttccctgttgatattcagattgtctcgtctttggccagtgggaacttcacattagctcctagtcattttgacattaactttgtagttttccatgacgtccgcgccctcaaatgacaagctattgcaggttcattctgtgccccaggcctgaatcacccatttctctaaggaatcttatcctttaatgggaaatggaattttaaggcaataatctcagatttcaaaactttcaaagatttcataagatttttatgaaatgtttagagttagaaggggctttggagatagtcttgtgcacccagaaagcagtggtggccggttaggcacagagctggttggtcacagagctaagagttaacatggccagctgacttccggcgccaggttccttctaccacatatcccagcaagatggtcacattacctaaaagaccccacagggtctgaaactcatcatctgccctcctctagcatgtttgtggggtaagtttactgagtcttgttctgtcctggtctcctttttttttttttatttttgagacggggtcttgctctgtcgcccaggctggcgtgcagtggagcaatatcagctcactacaacctccgtctcctgggttcaagcaattctcctgcctcagcctccaaagtagccaggactactggcgtacaccaccacacctggctaaattttttttttttttttgagatggagtctcgctctgtcacccagcctggagtgcagtggcgcgatcttgatcttggctcactgcaagctccacctcctgggttcacaccattctcctgcctcagcctcccgagtagctgggactataggcatctaccaccacgcccggctaatttttttgtatttttagtagagacagggtttcaccatgttagccaggatggtctcaatctcctgacctcgtgatccgcccgcctcggcctcccaaagtgctgggattacaggtgtgagccaccgtgcccggcccctaatttttgtatttttagtagagatggggtttcgccatgttggccagggtggtcttgaattcctgacctcaaataatcctcccacttcagcctcccaaagtgctgggattacaggcgtgagccaccgcacccagccttgtcctggtcttctgatgataaagagcctggtaaaatgtcagagcctgggctgctgctggggccatcccttctgaggtctgctgcaaaggtaactgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaaagttgaaagtttttccatgagctctctccattccagttcttcagatgcagctaatgtagccatttgctacctattgacctttatttacagataaatagtatgtgcgtgacttgtcttttaaagcaaaaatggtattgatagataccaaacctgggtgtattcctaaatacagattcctgggccctgctttcacagacattctgctatagtagctaagctcatgaggtgattttttttttttttttttttgagacggagtttcgctcttgtcgcccaggctggagtacaatggcgcaatgttggctcacttcaacctccacctccctggttcaagcgattctcctgcctcagcctcccaagtagctgggattacaggcatgcaccaccacgcccggctaattttgtatttttagtagagatggggtttctccatgttagtcaggctggtctccaactcccaacctcaggtgatctgcctgcctcggcctcccaaagtgctgcgattacaggcgtgagccaccacgcccagctgcgaggtgatttttatctggtcgttttatactgattacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcggtaagtcccccgcttcccccaaccccactgctcttcccttccctgccagaggctacattcaggccatcataggccaacgggaagctgtgaatggagcccgcacagaagggcagccatggcctttgtcaatggttcagcttcggaaggaggaaggttctcctctccccacctgcctcctatcccctccctctgagagtccccgaggagcataggctccagcagtgagttcagtcctgtaggcagaggtgcttctgaagcccgccaaggagctagcccatctcccacctattacccgcggcatctgtggttgctgtctcagagcagattcaacaatagtaagcaccaggctgcgtgacaagcagctcacggtgaaggcactgatgtgagaagctcgctgcagccaggtggaaccaggacacgcacatggacagaacccgtgtcctggtggtctctgggaagagcatctttctggtgccattgcctaggcgagcaagggagttgggatcagctcaggagggggtctcaagacactagcaaaaataataatggccaacatttatgtagtgtgcctactacaggccaggctctgttctatgttcatggttgacccccagaaccagcagtccaggttctgctgcagaccagctgaacaaaagcattgaggggtgtattagtctgttttcatgctgctaataaaggtatacccaagactgggtaatttataaaggaaagaggtttcactgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagctaatttttgcattttttagtagagacggggtttcatcatgttggccaggatggtctctatctcttgacctcatgatccgcccacctcagcctcccaaagtgctgggatgacaggcttgagccaccgcgcctggctaccagaaagatttcttatgagctatgattcatatttaaagagtgcccattaaaaaactgttggccgggcgtggtggctcacacctgtaatcccagcactttaggaggccgaggtcagcgaatcacaaggtcaggctcccgtggcacaagctgggggctgcccccaccccatgctccccagaggagcacccaagcgtctgggctcagacaggcctggatctgataaccggctctgatgccaccatccctgaggccaggcaagtcccagccgggctacagcactgttgtgagaatgcagatgaggttgtaaaggtgaagcacgtgtcacgcttctctcaataaagccatcattgctgttaggattgtcattaggaaaggctttgggccgggtgcagtggctcatgcctgtaatcccagcactttgggaggccaaggcgggtggatcacctgaggtcaggagtttgagaccagcctaaccaacatggtgaaaccccgtctctactaaaaatacaaaattagccaggcgtggtagcgggtgcctatagtcctagctacttgggaggctgaggcaagagaaccatttgaacctgggaggcggaggttgcagtgagctgagatcgtgccactgcactccagcgtaggcaacaagcgagactccaactcaaaaaaaaaaaaaaaccacacacacgctttggtctctttccctgaagatgggaacaaaaagctggacggccctggcctcttcatccctgcactggtttacttgaaggcagcagccccccacccacccacatcactctctagtgagtataaaaacgatgacaaggccaagcaaagggtcaaaacctgtggctctcctgccagccagctagccgagaggcctatgaggagctctgggaataaggggctgtgtcccacagtggggaagggacaatgggccattatgcacaggagataagaagggatgacctttgacaatttttttgtttgtttgtttgtttgttttgagatggagtctcactctgtctcctgggctggagtgcagcagtggcactctgcctcccgggttcaagcgattctcctctgtcagcctctagagttgtctggagttgtcagctcttccccttgcgtttcagatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattag

SEQ ID NO: 36086 - DNA, 29778 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaaggtaagtggcagacgagactggagtactagccttggtcacacgggctggatctctcggaaagctcggagagggcggcttcgtgggcgattcgggaagttctggggcgggaccccgcggacctcggcaagggggcactggccgcgggggtgccgggatggggatggagggagcggaaagaggggcggagggcggctggatctcccaaaggccaccttgagtggttagggctctctatttcttcagcgtactttctgtatcaccgtagcatgtatttgagcaggactggcttacacaccctgatgatactggaggggaaacaagcacgatcttgtttttcactggccaagtgagtcagccgaatacacagctagccagacagaaagttggtttaggaagctgtttacttaatttgataagtgtggttatcccagtttggaaatgtcttgtttttgaagcagtaaaagataaaacccaggcgcaccctcctccctcgacgctgaaattcaagtgcgcaccacggactgtaaagtgcttatgaatttcattatctgcctaagctttgacgtttaaactttttcatagagtggcaaactaaagacctttatttcacatttgctttctggtttccaggcaggtccttttcatgatactttgattatatggatgaaaacacttttctgccactttatggagggtctgcttgagagcagagtgcttccattgggattttttgttccacaaattaaggtcgtaaaggagtctagcttttttagcttcatagttgttctttacatgctaacacagaatatttgttcccatttaaaaggtcttattagatcttcaggctaggccttaacaggaaaaggggtcaataattagctattaagtaaccaaaagttaattttgtaaaagttctcgtacagctgttggaagaatctgagatactgcgttggcaaatgtggttaagtctgcatgttattttgtgtatttttccttgagaccttgtttacaaggtcaagattagcagacataaaaggatgaaatcagtagacagactagtattatgaatatataccctgtatgttaaagtccttcagttaagcattggcagaggctggtaaaaatgtcaaatgagacagactctattcagaatacatcctaatctcagaacaaatttcacttacaaactaattcagtaataaactatttaacagtcatatttttatttaagtgtacatcatcagaactataaaattccattttcattgtgcaacaaaaatgcttctgggatttatagacgctctattgggaggacagtgttttgaaaggcaaaacaattagaaacaggctgaaagtactatcattaatcctttttttctctaaccttttggaaaaccaaagtgattacagaagcctacatggaggaggtgaagatttgaggagggttttgaaaaatggaaggattctcaaaactttttagtcaggacttctttccttccttccttccttcctttccttcctttcctttcctttctttccttcctttcttttctttcctttctttccttttcatttatttatttatttgagacggagtctcgccctatcgcccaggctggagtacagtggtttgctcccagctcactgcgacctctgccttccgggttcaggcaattcttgtgactcagcctcctgagtagctgggattacaggcgcctgccaccacgcccagctgattttcgtatttttttttgtagagatgggatttcaccgtattggccaggctggtctcaaactccgacctcaagtgtccacccgcctcggcctcccacactgctgggattacaggcgtgagccaccatgcccaacgtctttctttttttttttttctttttcttttttttttttgagacggagtctcgctttgttgcccaggctgtagtgcagtggcgcgatctcggctcactgcaagctccgcctcctgggttcaagcgattctcctgcctcagcctcccgagtagtgggaccacaggtgcccaccaccacacccggctaattttttgtatttttagtagaggcggggtttcaccgtgttagccaagatggtctcgatctcctgacctcgtgatccgcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttgggttttttttgagacggagcctcgctctgtcaccaggctggagagcagtggcatgatctcagctcactgcaacctccgcctcctgggttcaagcaattcttcttcctcagcctcccaagtagctgggactacaggtgcatgccaccatgcccagctaatttttatatttttagtagagatggggtttcaccatgttggccaggatggtctcgatctcttgacattgtgatcctcccaccttggcctcccaaagtgctgggattacaggtgtgagccaccgcgcccagccaatttttgtatttttgtgtagagatcggatttcaccatgttgcctaggctggtcttgaactcctgggctcaagcagtaccccacccccttccgccctggcctctcaaaatgttaggattacaggcgtgagccaccacgcccagcccggacttctttatactctcaaaaattgaggaccccaaatgtcttttgtttacattgattatatcaattgatatttatcaatctgaagttaaaactgagaaatagaaaaattttaagtcatttaaaagtcatgctagtctgatggtagtgggttatcagaacttattaacattagtgtcactaaagttgatatacaacctccccgctgctaaatttggctggctttaaaaaaaaaagtcatatgttaacataaataacatttttatatctaaagaaaacttaaaaaaatagattagaacatgtgagaaaagtggaaaaagaaaacaaacaaaaaaatagagttgagatcttactgtgttgctcagctggtctggaacgtgtggcctcaagcagtcttcccaccatggcctcccaaagtgctagaattacaggtgtgaaccaccacacctggccaaaagaaaactatatttgaaaacaaaaattagtgaacagtattttatatttttgcaaatctctaacatctgacttattagaagatatctggattcttctatcttctttttttcattcaacctgttgtaaggttgaagtatttgaagaaaatccatcctcacagctaagtagattgtagcagatataagtgaaggtgggtaataagagcgtagtagaaatactgagaacaaactgggttaaatatctaaaaatgcatttatatcttaaatctactctttagaaaattttagaaaacacgagaataccaagcacacattccattggccatcagtgatgatgtcatcacatctgatgtagactctggaaaactccacactcttgggagaatgagagttaaaaagacaaataatgtaatattactattatgaaaattttgacttcatagaccctctgaatgggtgttggggatccttctcctagagtaccagggtgcaagttacaaaatgctgaactactattatggacaaagaattttaggggatattccaagaagagaggattggcaaactgtaagcaaaagtgaggaagtgtgtagctctgttgatagagagttgtaaaaaaaataaataaatagcggtactcctcaaaactgtcaaagttatcaaaaacaaggaaagtctgagaaactcaacagcctaagaggagcttaaggagacgtggcaactaaatgtaacgtggtattttgaatgggatcctggaacagaaaaaggatgttagagaaaaactaaggaaatcagagtagagtatggactttagttaataataattatgtatcaatattggttcgtgaattgtgacaaacgtataatactaatgcaaggtattaataggataaactaccgagtgtagtatttgggaactgtactgtcttggcagtttttttctagttttttaaaagtaagactattctaaaaccaaaaaaattttaaaaaatggattagtgttgttatgtagtcccagattatttttttcagagccacttgtcttgagttgaaaaattacttacttaaatattctgcttagattatgtcttctagctgtatggttagaaaggggaccttcctgtaggttatgtttctcttgactcgcttccagtagaggactgaatttttgttgctgtgtgcctctttcatgtttgctggttttcttttttttttttggagacagagtctcactctatcgcccaggctggagtgcagtggtgcaatcttggctcactgcaacctccacccctgggctcaagcaattcttgtgcttcagtctccagagtggctgagactacaagtgtgcatcaccacgcctggctagttgttttttttttttttgtattttagtggaaatggggtttcactgtgttgcccaggctggtgtcgaactcctgagctcaagcaatccgcctgcctcagcctcccaaagtgctagtattacaggcgagagccactgcccccggctgctgtttttaattttacttgattctttacccataattgtctgcaggaaacctttaaaaaaaatgatacaagcagcgaaggtcatatctttaggaagtggaaggaaagggagatgattccccactaatgtgcagccaggcaggtgggggagaatgcggtagtagtgaagaaccccaaggaacagagttcagtggtggcagttttgcaaaggagaggaaaacagggtgggtcttagggttatttagcaacaggaaagaaagaaccaggaggctggttaaaagcttgatggatgtcctttgaagtagaatcgctgactggaaaggattgtatggggtgtcccatcagattgtgacactatagggagtttgtgttgatgaatggaatagtaggaaatgactttggatagctaggacagagcaagattatggagggcgtttcccccatcttgttagattttttacaaaaagcggtttactgaagagtcacagatgacagaggattcccttatatacaacctatggtacctgttcataggaggagcctgcagtaaattttctgagcacttgggatagcaaaccactgtgcctatagggaaaacgcagcgggtcttcccccgaccccagaagctgtccgtctcacagcctggaaaaagtgtatggagggcttttaattgttggcttgaagagtttgggtttgatttcaaagtatgggagtggcagcctttctgaaatctttacttatttacctcacccaaggaagttgcctcagtgtgaagtggaccagttgagctgttacagggtagtatagtctctagagtctagggtcagtaggagtggacagcaagggtgctttggtgctgtttgaggtctctacttgtttcactttctgattcagtgtatctgtgagtagatcaatctctgcctcaaaataacaaaattcctgcctgtcatttttgcctcttctgacaaattgtcagctaatactttaataccttagcagaattaattgacagatggcaaaggagttgaaacctcagaagcgggcaggcaaaagggcaactttccaagatggggaaaaggacattagattagcagggatgtagaaaggcgtcagacctctgcagccaatcactccagtgttttcttttggcacatactgctcaggaaatactggaatgcctctttatatccaaagctctatgctgggctctgagggttgatgagaagtctctacccttcaaggggttcatgctccattgtggctaatgcatgaaccctaatacagtgatgagttctgcattaacagtgtttgcatactgctatgggaacacaaaggaaagggtccaactttggtaacattgagacagccttatagaggagatggcatttaattggtgtaaataaagaaggaagaaaaaccaatggtagagaaaggaatgtgtgaaggcatgcagcggggaaagtatgccatcttttttgtttggttttgagacagtctcgctctgtcacccgggctggagtgaagtggcgcaatcttggctcactgcaacctccgcctcctgggttcaagcgattcttctgcctcagccttctgagtagctggaactatgggcacctgccaccatgcctgtagtgtaaattagtataaaaaatactaatttttatatttttagtagagatggggtttctccatgttgaccagactggtctcgaactcctgacctcaggtgattcgcctgcctcggcctctcaaagtgctgggattacaggcgtgagccactgcacacggcctgagtatgccatctttggcatataattagtgttactagagtgtaggatagatgagggttgagattggaaagataaatcagggcaagttgtaaagggcatcctttgctgaggaacttggattttatttatttagagccagggtctcactctgtcacccaggctggagtgcagtggcacaatcatagggctcaaatgatccacctcctacttcagcctcctgagtagctgggactgcaggcatttgccactgtgcccagctagttttttaatttttttgtagagatgatatcttgctgtgttgcctagggtggggaatttggattttatattgcagtcagtagggcagtttgcttcacacatttcggggtgagatgatagggaagctgtatagcaaaatgctaagagtgcagcctggcattgccttggttcagagcttggtacttccatctatgatgttttcttgggttaaaagaaaagcctttgtgtacctcagttttaaaatccataaaatggggatggattgcaactactcaattgttgtgtgatttaagtaatctatgtaagttatgtatatttaaccaagtgacttaaatatagtgaatattcagatattgtctgttatgtaactgttagtcattgccaaatgtgagtgagaattctgagttagacagtcacctgccttttggaacctggactttgaaactgatcagatgaaacatttctaggctaaacagcattgtatcttctacctagaggatacagaaggaagtcaggagagtcatgaggccaaaaaattagctatgttctccagatgatagaaagcttcaagagtctagaccttaaaatccttaccaggagagttctccactcaattacagataagctctgagtgaatgaaagacacaccagactttcaggaagcctcttcttctctcccaagtctggccttacagaaggctggaagagttctgtgatagtgtattgtaggtatgtgctaggtaccaggtgtatttcctcaatctcagggtgagactagataaaacttgattctcattcactcaggcataaatatagttatcatttgtcgcctttaggtgctccacccaaacagcctgagctaagtaaattcctgaatgtcagtactgtggaacctgaacaaaggtcacttgcccagttgtctctgagtgtcatgcagcaggcctttagaccaactagagggcctatactggctgaacttgatcaaataattttgtggctaaaacagataacattttatgctatattctaaattagacactcagtagtagttaaggaatgagttttggactttatcctaaaagcaatgggaaacaataaaaaagattttgagtaaggagatggaacccatcacatctgcattttagaacaattactgtgttacagtgtgaagaatggaaactaccaagattgagagcagaaagattcgttaggatgctctgaaagtaacccagcgaatgggataccttggagtagaattatggaagagggatggaaagagttgggcaagttcaggagatgcttaggcatcttactaaatagtaaaggtcttaatcaataggctataaaatataatcatttgctgctgctaagtaaagcatcttgctccctcagaaattatgaatttgaaataaacctacagtttgatttcaagaaggctgaggcaggagtatgtcactgaggaaggtcaactgggtctgacagaatattactgtgtgtattggtattgttttaagagcctgtttctcagcttctaaagttcagaaataaaattttggggctaggcttggtggctcacacctgtaatcccagcactttgggaggctgaggtgggtagatcacctgaggttaggagttcgagaccagcctagacaacttggcaaaaccctatctctactaaaaatacaaaaattagctgggcatggtggcttatgcctataatcccagctactcagaaggctgaggcaggagaatcgcttgaacccggggaggtggagattgcagtgagccgagatcacgccactgtactccagcctgggtgacagaggaaactgtctccaaaaaaaaaaaaagaaataaaatttaaaaaaaaatgtgttgtttgttcttgctatttttttttttttttggcagggggtctcattctgtcacccaggctggagtgcagtggcgcgatctcgactcactgcaaccctaacctcccaggttcaagcgattctcctgcctcagcctcctgagtagctgggactacaggcatgcaccaccacagcccgctaattgtttgtatttctggtagagatggggtttcaccatgttggccaggctggtctcaaactcctgacctcaggttatccacccgccttggcctgccaaagtgctaggattacaggcgcgcgccaccgcgcctggcctgttcttgtttttgttttagcatatcctaagatgttttgagaggggctgacataatttgtacacttagatgactcaatgcttaaattagaatgagatataacttttcattaagcttcaaatggtgctagttggcatagtctattcctataagaaaatctacttgggaaatcagattataagcagaaggtagcttggtgagcaaggattggaataagaggaattacatgaactcattggctagtggggcgatgccagtgggcctgatgcttcccctcagctttaaggatatacctacttagcaggctagaaagtgcttttggctgttttagtttacatatatccttgactaaatttgacctgggagataattttacttttgagatgatttctgcaaatagctagttattcatttctggtttttaactacatagtttaattctcaaaatataacattatttgtaaaatgagaggtactttatttcattatgatgaattgagctgttcttttttcttttttcatagtgtccatgggctattcctcaaaatacaatatcttgttctttggctgatgtaatgagtgaacagctggccaaagaattgcagttagaagaagaagctgccgtttttcctgaagttgcgtaagtaaaattcacaaatactttatctagcaacttatagcagagttttaggatttgatgagtaattgtcatgacaagtggtttggaaaaagcagtgcagaagaaagcaccatattgagagtccagtgatacttgaattttggtcctgattttgcattggttttcattattatcttggacaaaccactgtttctgtgggttttagttatatcgcgttaatgctgcagttgaactagatgaggtacagttttgatcaagtgtttgtagtttatcttttcatgaatatgtatctattctttcattatggatgaatgaaacatccagactttcttttttttttttttttggagatggaatttcgctcttgtttcccaggctagagtgcaatggcacaatctcggctcggcacaacctccgtctcccgggttcaagtgattctcctgcctcagcctctcgagtagctgggattacaggcatgtgctgccacgtccggctaattttgtatttttagtagagatggggtttctccatgttggtcaggttggtctcgaactcctgacctcagatgatccgccagcctcagcctcccaaagtgctgggattacaggcatgagccactgcacctggcctcatactttcattcagaacaaatgaattctaggcctcagtttagctttctctcccagttctcttaatcctagttggtactcccacaggtgcatgccattggtcttaaggctagctgtgcaggagaaggtaaatggtttgatagagttctttcccattgttcaattttaacatggaaaaggcacctcctactctcataattggcaacctctgtttacttaagcacattacattagtttatattgccttattttgaatagtgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaaggtattataaccttattgtgacaacttcattgagtggtagaaaacactcataatgtgctcctaagtaaatcttcaactatttttgcttcttaagtttccatttcctttgaaaattatcgaaaagtgcatccttatgaagacagcgatagctctgaagatgaggttgactggcaggatactcgtgatgatccctacagaccaggtaccaaagtttttactttctgggggcagcagaatagaggtataggaagactaatcttttcaatgaactcttttagttttatatttttctttgaatctcatttggtaatttactcttagattcaaatgtcttttcagacaacgttgaatgcagcaatgtagtctttgctatttttatatacctggcttatttcaattgcctttagcaaaaccggttcccactcctaaaaagggctttattggaaaaggaaaagatatcaccaccaaacatgatgaagtagtatgtgggagaaagaacacagcaagaatggaaaatgtaagttacagaaagtatctatctctgaatttagagttttgtttgaatacctttcaaaaacaggattctaaatataataccttagatttctaaaaatgtctttctttctaaagatgtttttagataacaatatggcaatatcatggaaactgagacattaatgaaaatataaagtacctcagaataaaattccataacagtgttgaaaaactattttgactcacattgattctaaaattaataaatagttattatgaaattaacatttattcttcatcatatctctataaaatagcatccctacccaaaaaacagataacggtggcgattggggaatacaaatgggagggagaaatacttttcaccatatactcttttgtgcattttgaatttattatcttgtgcctgaactacctgtgtaaaatcagaagtaaagtgtaactttaaaaaatagcattctaggccgggcatggaggctcatgcctgtaatcccagtattttgggatgccgaggtgggcagatcacctgaggtcaggagttcaagaccagcctgaccaacatggaaaaaccccatctctactaaaaatacaaaattagccaggcatggtggcgcatgcctgtaatcccagttactcgggaggctgaggcaggagaattgcttgaacctgggaggcagaggttgtagtgagccgagatcgtgccacttcactccagcctgggcaacaagagtgaaactctgcctcaaaaaaacaaacaaaaaaaaagcattctaaatccttcataaatattgtggttaatataatatattaaacatttagattttaaagcacaaatgcttgttaagtaaacatattcaattatatcatttctagaaatattccagatctaattctagaagagttctgtccaatagaactttctgtggtaatggaaatgttctgtatgtgtgctgttcaatatggtagccacatttgctgttgagcacttgaaatttgggtggtataatagaggaactgaatttttaatttaattttaattaacttaaatatccaagtgtggctagtggctacctaactgaattgcacagttctagaacataattgtcatggtgtgaacatagtctgctataacaacccactctccacaaataattacaaaattgtatttctttggtaagatttggtgtagccttcacagttcaatattgtgtcctttggctaaaagcaaggtacaatgcacatgccgaaagaccttagttttggatgtgatgaaatgttttctatgcctggaataaatgccttcctttgggttgtaatttcttaaatagtattgctcctctttctgtgagttatttaatttttttctctgtagtagctatgatttctggttttctagtgtgatcatctattgagtaagaaagactaatctcatttggttgtttttgtttttgtttttaactgtccctattttaaaatatttagatgctaattcttccttttggcagtttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagtaaggatttatagatttttttttttcttttttactagaaagattcatattagaaaactttgggtaaagaaaaaaaaacttcatgtttgatattttttcatgagattggctttttaaatcaaagatgtaaataaatccagccactgtggtgcccgcctgtaatcccactactttgggatagcagatggagacaggaggattacttgagcctaggagtgcaagaacagcccaggcaacataatgatccccagctcacaaaaaaaattagctgggcatcatggcacacacctgtggtcccagctacccggggggctgaggtgggaggattggttgagcccaagaagttgaggctgcagtgaaccatgattgtgccactgtactgcagcctgggtgacagattgagaccctgccttaaaaaaaaaaaaaaaaaaaaaaatgtaaataagccaggtgaggtggctcccagcaccttgggaagccaaggtagaaggatcgcttgagcccaggagttcaagaccagcctgggcaacatagggagaccctgggagaccctgtctcagcaaaagttttaaaaaattagccgggcatgttggtgtgcacctttagtcccagctgctcaggaggctgaggtgggaggatcacttgaacccaggaatttgaagctgtagtgagccataatcatgtcactgcattccatcctggacaacagagtgagaccctgtctctctctctgtctctaaaaaaaaaaaagatattaggccaggcgtggtggctcacacctataatcccagcactttgggaggccaaggcgggcggatcatgaggtcaggagttcgagaccagcctggccaacatagtgaaaccccatctctagtaaaaatacaaaaattagccaggtgtggtggcgggcgcctgtaatcccagctactcgggaggctgaggcaggagaatcacttgaacctgggaggtggaggttgcagtgatcagagatggtgccattgtactctagcctgggtgacaagagcaagactccgtctcaaaaaaaaaaagttattagaagtggctcagaaaatattttgtgattagcagtcattttcacttacagtgctttatctcttgcaggaaaaagcagttgatcctaagacacgtttacttatgtataaaatggtcaactctggaatgttggagacaatcactggctgtattagtacaggaaaggagtctgttgtctttcatgcatatggagggaggtaaatgagcaaaatatgataccatgatatgaaaacttagtctcttctccccaagattaatgaatttacacagaatcaaagataatgctgcatggcaagcagagtaatttttaaagtgttattgtagaaagtctaggcagtataggaatgtataaaaaacacagtcatcctaataccaccacccagagataatcattaataattttgggtagacttctccagtttttttcaatgcgtatattattattattattattattattttttgagatggagtttcactcttgttccccaggctggagtgcagtggcgtgatcttggctcactgcaatctctgcctcccgggttcaagcaaggtctcctatcccagcctccagagtagctgggattacaggcacatgccaccacgcctggctaatttttgtatttttagtagagacagggtttcgccatgttggctaggctgtcctcaaactcctgaccttaggtgatccactcgccttggcctcccaaagtgctgggattacaggcgtgagccactgcttccgggcttcctcatctttatcagtgtttagtattatcaaatctaatgctttttgtcagtgtgagagatgaaaagtaacatcttggtattttggtgtgcatttatttaattatgattaagttgtacattttttccaagtgctttattggccatttgtatttctttttcttgtcttctctcttgtttatcctttgtccattttctgttatactcaatatactccttttttttttttttttttttttttgggagatggagttttgctcttgttgcccagggtggagtacaatggcgcaatctcagctcactgcaacctccatctcctgagttcaagcgattctcctgtctcagcctcccaagtagctgggattacaggcacgcaccaccacgcctggctaatttgtgtgtttttagtagagatgggctttcaccatgttagccaggctggtctcaaactcctgacatcaggtgatccacccatcttggcctcccaaagtgccaagattacaggcgtgagccactgcgcctggcctggtatacttaatatactctaatataataaatgttcagtctttctggtggaattggtatcataatctgtactttgacatttctaagttagcaaaactagagaacattcagttttctacagctaaaagttaatgcttttaaaagtttgttagttttctgtggtacataataaattgccacagacttagcagccaaaacagcatccatttattatctcatagtttctgttgacagaatccaggcatggcttaactaggttctctgttcagggtttcacaagcctgcagtctaggtgttggccaggctgtgttcctttctggagcttggcgtcctcttcccttggccacctttcagttgcagctatacgactgaggtcccactttcttgttggctgtcagcagtgggctgctctcaactccttgaggcccctgcagttccttgccatggggccgtctcacaggcctcttcacacactagctctcacactttcaaagccagcaggagaatctctccagtctgctaagactgagacttagtgttatgttatcatgggaatgactagaccatcacctttgccacataacctaaccagggagtggctatcccacacatgctcaagggaaggaggtattatacaggggtgtgcacaccaagggggctgggagttttgctttccacaaagctctggttcctttctttcttcctctctctctctctctctctctctctctctctccccctctctccccctctctccctccctccctccctccctcccctccctcccctctctcctctctcccctctctcctctctctctctctctctccctctcctctctcctctctctctctctctttttctttctttctttctttttctttccttctttctttttttttttgagatggagtcttgctctgtcacccaggctggagtgcaatggcgcaatcttggctcactgcatcctctacctcccaagttcaagtgattctcctgcctcagcctccccggtagcggggattacaggtacacactaccatgcccggctaatttttgtatttttagtagagacggggtttcaccattttggccaggctggtctcaaattcctgaccttgtgatccaactgcctcagcctcccaaagtgctgggattacaggcgtgggccactgtgcctgggtcaaagctctggtttctgtcactctcaggttggtcaggcaatcaacaattattcaaacagtaatttgtgctagattactcagggaataaaatataagacatattttttactctcaaagagcttaagctttagctaaaaggagaacattacagtaagaaccattatggtcaatgaaagataattacataatagagtacccagttatgcaaacgagaccttatatgggataggaatagcgaatagaacaagatcattgccaggcacattcagggaagatatcataatgaagttggatctcaatctggattttaaaaataggttaaaaaaagaaatccgttggaggaccgatgggggcggatcacgaggtcaggagatcgagacgatcctggttaacacggtgaaactccgtctctactaaaaaatacaaaaaagttagccgggcatggtggcgggcatctgtactcccagctacttgggaggctgaggcaggagaatggcgtgaacctgggagcggagcttgcagtgagctgagatcgcgccactgcactccagcctgggtgacagagcaagattccgtctcaaaaaaaaaaaaaatccaatgttgagtataaaaagctagttgcagaatatatatacagtatatcatctatttaaattttttaagtcatacagaaaattacagagatgtttatagatgcttgtggatacttatatattatcttttaaaagagactagaaatacagcatttatgatagttattgcctctggtgagttaagatggggaatggtaatcagagggcacttcagcgtcatctgtaatgtttaattctttaagaaaaaggctaagggtgggagagttgaagtttaggcactgagaagattaggaaggtatgtgcttagaggtagtaggtagtaaagtggtgtaagcaaactggaaattggtaaggaggaccttaaaagctaggcagagggatgtgtcatttgctgagaaacaggatctttttgtagtaggacaatgacaaggcaaatcttataaattggactctatcctagagaccttccaagtaagggatctcttgtatggcatttttgctagggcctcacctactatgtggttaaactagtccaatgaaaggagcttatctcaaaatctagcctattctgtcataatgtcttttaagttattagagatttcttccctgaaaattgtgtcatctgttaaccaaatagttgagcagctgtcaagtaccaggtactcttccaggtactagggatacagcaatgaatggtacaaggaaggtctctggtctaatggaatatgcttcccccatcctcaacccctctccatgacaataataaacaaaaaatatcagatatatgctatgcagatagttaaaataggatgatgtcatagtgacaggctgactagctttattagtaggacagggaacgcttctccaatgaagtgacatgtgagtgacacatctaagatacatcaaagatcaggtggatgggcattctggactagagaacagctagtgctaatgccttaggacaggtacaaagttagtatctttgagggaagcgtaagaaacccagtctccctggagcataggatgtgaatgggagagagggggctggaggagtaagcaggggctggaccaggtaggattttgtaggccagggtaaggagtctgctctttgactgccctggaaccaaagctatgagttgattcttattttcaaaagattgctgtgtggaaaatgaattataggaggagaagagaagaagcagtaagatcagttaaaacgttgtagtagttgaagtgagaaatggtgaagggttggactagggagggcggtagtggaagtgaagagtaggagagcgttggtgtgtgttttgaaggtagagagaacagcacacgctgttggattggaagtgggtgtaggaggatagattctgggctagagcagctgatggtggtaccgtttgacgaggtgagagcctggggaagggtagggtgaggactcagcatgagttttgttttgggcatattaaatttgagatgcctgttagacttctaagtgatgtcatgtagttgttggataaatgggcctgaagttctagggaaagtcaggactgggatagaaatgtgggagttatcggccaggcgcggtggctcacgcctgtaatcccagcacttttggaggccaagatgggtggatcacctgaggtcaggagttcgagaccagcctggccaacatggtgaaaccccgtctctactaaaaatacaaaaattagccgggcgtggtggcatgcacgtgtaatcccagctactcaagaggctgaggcaggagaatagcttgaacccgggaggtggaggttgcagtgagccaggattgcaccactgtactccagcctgggtgacaaagtgagactctgtctcaaaaaaaaaaagaaatgtgggagttgtctatatagagatgatatttagagccatggggctaagtgaaattgcccaggaagagaaggaaggtttcttagaaccaggtgaaggactttaaccttttgagactaaatggaagaggagtcagctgggagaatatggtacagaaggaggtttgattcagattctgtcctttggaaatatagttcctttctttcccagattaacatcctatcagatatttaaaggtaaatattaatattgtttctcattccatccactttttcattcccactgccaccatcatgactgaagctcactattgggggactattgcagtagcatcctgagtcgaccccacacctctagcctgtccctgtgcccttccattctgacagtatcgttcactcgatcttcatgaagcacgcatttgagagtgccatacacagaaaccctcgcgattccccaccacctctaggaatttgtccaggctcttcacagatgtgcctctgtcctgtcctttagctccaattttttttcattatctctctccagccaagtcttaactatagtgtttgttgttcctcagacatgtcctgtggtttcctgcctctgcttttgttcatgctgttcaaatcctacccattgtcctgtttctgtttcagatggcacttgtgccatgaagtcttgcctgacctttccaatgaagagggacctttcctattcatgtacttcttttattctccgttgccacttcttgcagacttgtggggcaggaaccatttgattcacctttatgtctgctaggagtgaaagagttattttttaaaaagctgttttatttgttgctttttattgaattttgctcctgaaccatattgggaagactgtagcctattttcaagtgcatatgtcttcattgtatttcaagcttgattccgtagtcattaagtgaagaacattatgtgatagatggttgaaaatcggttgacaatttatttgaaagtatattttatttaaaaaatcaaaccaaaacctaaggctttattaagatccaaaacctaaaggcttaaaaaaacaagacttgacactgagagaaggtagatctaatttagtgttacagaatctttattttgaaattgttgtacttgtgagctggcaacttgtactgacttgattttttttcttccacttagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaaggtaaagaaaatattgtgctagacgtaatcttgggtaaatacctttttgcattaggataaaaaaatccatgctttcttttacattcatttatagaaataatgaaaggccaggtgtataacctcgattcatacttttaggatgaaaaagccattttcttttttctttcctcaatgaagcttgagggaaatctgggcattttctgccttagacactttatcatatatctaaatgccatttttaaattgcttttatcacgaagtaaaacttccagcatccaattaggcttagcataaaaaaatggtttcttttttgtttcagaaaatgtttgttgcatttaatttgttaattttgtgggagtaagttcttaccaatcaaattacattttgttttaatttttatacttgtatctgaattttctaagcaatttattttctatcaaagaatttgttttgtcaaccaagaaattcagtaataatccttctcattaaaaacctttctattatcttaatttattaaaagcttaattttagtttgttattttctaaagatatttgctttcaaaagtaattattcatatatatcagttacaaaattcttctactgagagttccccaccaaaataagccaggcatggtgtgcacgtgtactcccagctacttgggaggctgagatgggaggactgcttgaacctaggagttcaaaaccagcctggaaacgttagactcccaagaccttgtctcaaaaagaaaaaaaaatgttttttcaataaattaattaattccaggtagaatcattttctagaaggtcttgctgtcctccagtctcttttctgtactcctgaaattcctgcctttcttaaaattcttcaacagttttccatagtggagcttgcctgtctttgtagcctcagcccacattgcccttcctcctactcacagatccagctatgttgattgatatacattccccaaatggactgtgctcttgaacacctccctgcattcccttgcactgtctttatctggctaattcctgttccctacctcttcttctaataagccatccttggtgctgtgtgctcctgtagctcctacccatacctctgccagtgcgtaattgtaattgtctcttgtctgtcatttccatcagtccctgagctctctatgggcagaggctgtgttttactgtctttgtattcccacatcaccagggtagaacatagtgccagctcattgcaggccctgattagatatttattgaataaatgacatattttctctccttctgatctgtatattctgaatcatttctttatgtatagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatgtaagttgtgcttttaaaagaattcacacactacctttaaaaaatatttcctctaaactttaaaaaaatttccttaaagaagccaggcatgttggctcacacttgtaatctagaactttgggaggctcaggcagtaggatcacttgagcccaggagtttgagaccagcctgggcaacatggtgaaaccctgtctctactaaaaatacaaaaaaattagctgggcgtgtgcctgtaatcccagctactcgggatgctgaggcaggggaattgcttgaaccagggaggtagaggttgcagtgaaccaagattgcaccactgcactccagcctgggtgacagagtaagactctgtctcaaaaaaaaaaaaaaaaaattaaaaattagctgggcacacacctgtagtcccagctactcgggagtctaaggtgggaggatcacttgcacccaggaatttaaggcagcagtgagctatgattgtgccactgcaccccagcctgggcaagaaatagagcaagaccctatgtcttaaaaaacaaacaaaaaaacccaagttccttagatagtgctatttcaaggtgctataacaaagacaagttgaagtttgtgaaagaatgttaacactgaagagttgtttttctatcaatatgtgtgtgtcttaaatagttttagaaaacttacagacttaaccagggaagtcgtcattgttaggattagtgacacagtgcatgaagctatttttcaccaaacttcattaaataaaatttgctgttagtacatttagcaaagtgcctcattagtttgtgagctttcatgaatgttatagttttttggggcttttttttttttttttttttttcaaataagagacagggtctcactatgttgcccaggctggtctcgaactcctgggctcaagtgatcctcttgcctcagcatcccaaagtgctgggattactggtgtgagccaccacacccagccattgaatgttacagctttaacagtgaaggaaaggaagcaggtctggtctcatcataagagagtgatgatgaaaattgaaaacagtagggagtgcaggtgttaagttggaaggcatgttgggaatctcaaggaaactacatgctttgaaatagcaactgaattcaatctgagggccttccaggttgagacaatgctcctaatactgccattatccctctgtgttttaattgaacactggagaaacttaatgtgctactttatgcaatctccacatgaagctgtcatgtaatgcagccattgatctagatatggaaattttaatccaaattaatttttaaagatatagctagaaaggtgatccacctttctctgcctccaaaggtaaacattgaaaggaaaatcaagtatgtttttctggcctctttgggaggtggggtggctggggaagagattaaatagtgatgaaacttttctatttaattctattaaggctggaaaacaaatgcattaatgttgatttctactgtaagactttgaggggggctgggcgcagtgctcacgcctgtaatcccagcactctgggaggccgaggtgggcaggtcacgaggtcaggagattgagaccatcctaactaacatggtgaaaccccatctctactaaaaaaaattacaaaaaattagccaggagtggtggtgggtgcctgtagtccgagctacttgggaggctgaggcaggagaatggtgtgaaccagggaggcggagcttgcagtgagctgagatcacaccactgcactccagcctgggcgacagagtgagactctgtctccaaaaaaataaaaaataaaaaactttcaggggtgtcatcatcaataataccacttaattattcatttcctaatgtgtgccttccctcttcacagttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcaggtagacgtgtaaaccaatatgcctttttttgttggatgtaacagctgcaggtatttttctcactcctaagataagtaagaggaccatattcttagaaattgaaggaagggatacgggctgctttcaggacaaggatataaagatcaatttgtcatatttcattttgcaagaatttgattccatgtcttacagttgggtaaaatgttcaaggggtgccaggtatggtggctcacgcctgtaatcccagcactttgggagggtgaggtgggtggatcatttgatgtcagaggttcaagaccagcctggccaacatggtgaaaccccatctctactaaaaatgcaaaattagccgggcatggtggcaggcgcctgtaatcccagctacttgggaggctgaggcaggagactcacttgaacctgggaggcagaggctgcagtgagccaagaacgtgctactgcactccacccagcctgggcaacagagtgaggctccgtctcaaaaaaaaaaaaaaaaaaatatgccaggtgcagtggttcatgcctgtaatcccagcactttgggaggccaaggtgggtggatcacctgaggtcaggagttcaagaccagcccggccaacatggtgaaacgctgtctgtacgaaaaatacaaaaaaattagttgggtgcggtagcgtgtgcctgtaatcccagctagttgggaggctgaggaaggagaatcacttgagcctgggaatcggaggttgcagtgagccaaggttgcgccattgcactccagcctgggtgacagagcaagactccttctccaaaaaaaaaaaaaaaaatgttaaagggaataagtgagtgttttggctccttgtatataagcagtcgagtagacatttaatgtgtgcatagtgcttaaacagaagctggtgtgcctgtatgcttgctgccattattaccattaaaagagggacagtctctattgtgggacagtgtctgatcactgtcactgtgaagcatggtaagaagattaggtggctgggcatggtgattcacgcttacaatctcacactttgggaagccagggagggaggattgcttgagcccaggagtttgagaccagcctgggcaacatagtgagactcctatctctacaaaaaaatttaaaaagtagctgggtgtggtggaacatgtctgtagtcctagctgctttaactgggaggctgttttactagggaggctgaggcaggaggattgtttgagtccagaagttcaagattatagcgagctgtgattgtgccactgcactccagcctggatgacagtgctaggccctgtctcttaaaaaaacaaaacatatatatatatatatatatatatatatatatatatatatatatatatatatggtaaaatttagtaagcacagggttgggtcacacttgtttggcatttctaagggaaatgaattgttggcagtagattcagatagcaatgatctttctaaaggatagagtaacttcatattggaaataacctctgagcctgcttgaaatttttaatttctggggtttagtgaaagtatttcctttacatattcaaagcaatgccaagtggttttatttatagcactcatttttatagctatagaaggtgcagtggtatgagctaaatccagaaggcaggatggatgtgtgagaggatgaaaagcaactagaacctgagtatagtccagcttggaagcaggaaaatcgatggttgagaaatgaggcaaggaatgtagtggctcaagagatcctccctccttggcctcccaaagtgttgggataacaaggataacaggagtgagccgccatgcctggctgagccagtaatttttactctcttaaaaactaggttattcctaatgattctgcctttgagttgaaattactgtgtgtgtgtgtgtgtgcgtgtgcacacgtgcatgcatccaagtctttttataaatgtgctgctccctgtttttagtttataagagaacattgctaatacttcttactgactttcttgtatttccttactagtttttccagaaaggaggagtcaaggaagcccttagtgaacgagaactcttcaatgctgtttcaggcttaaacatcacagcagataatgaagctgattttttagctgaggtatgtgataaacagctgtttttcaccttgctggtcatgcagaactgcatagaggagataactgaaacccagagctagttttatcctccctttcccccaaaacaaaattaatttgagatttttcttttcttaagatgtttttggttttttctttttttctttttttttttgagatggagtcttggtttgtcactcaggctggaatgcagtggcgtgatcttggctcactgcaacctctgcctcttgggttcaagcgattctcctgcctcagcctcctgagtagctgggattacaggtgtgtgccaccatgcttggctaatttttgtatttttggtagagacagggtttcgccatgttggccaggccggtcttgaactcctggcctcaagggatccacccaccttggcctcccaaagtgctgagattacaggcatgagccactgtgcccggcctgtttttttctatacttaaaattcagaatacacacacagcaaaacatttcttcacggagggcaccatttggttaagatgggcaaactgtacatttccagtagactcctatttcccctatttaatgaatgaggaagttgaacactctgagtgatacaaaaaatagtaacatgtggtccctgccctttactaaacatagaaagttagaagtgcctatctttggaaatacccggttattataatatcagatctagagaaccatgaaaaagcttcctccagagaaagtctcttaaaattgaacaaaatctaaaaggtgaaatagcagttaattattcccaacattataccaaagcagagagtgattactgagtctgttccagaaatccccaggatgacttgagtttgggtaagctgggcctagcctaaggctagagagaaataacagaaagatggtaaattcattcttccagcacaatacagttgctcagtaagtaagtgatactgttgtttgatgaatggtagagttttctttttcctgtttctggaatgttttatagaatacatttcaaaacatagatgattccaattgctagctggataaagatagtaaatattgacccttgcaatcaagttaaaaaaaatacatgtatgtatgactatttgtgtatacttggatgcacgcacacacacacacacacacacacacacacacacacatagtaatttcaactcaaaggcagaatcattaggaataacctagtttttaagcgagtaaaaattactggctcagccaggcatggcagctcactcctgttatatctgttatcccaacactttgggaggccaaggagggaggatctcttgagcccaggagtttgagaccagcctgagcaacataaactccattaaaaaataaaaaataaaaaaactggctggacacggtggctcacgcctgtaatcctagcactctgagaggccaaggcgggtggaacacctgaggtcaggagttcgagaccagcctgggcaacatagtgaaacccgtctttactaaaaatacaaaaattagctggcgtggtggcacatgtgtcccagctactagggaggctgaggcaggagaattgcttgaacccaggaggcagaggttgcagtgagccgagattgcaccactgcactccagcctggacgacagagtgagactccatctcaaaaaaagaaaaaaattactagcacaatctaaaatatggtttctgtgaaaagtaggattttgacaaatggattcaatgtattatttttgtagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 36087 - DNA, 29778 bp, Homo sapiens; identical to SEQ ID NO: 36086

SEQ ID NO: 36088 - DNA, 183028 bp, Homo sapiens
gacacactcctctacaacaccagagactcccaaacacaaggccttatattgactcatttcagctcacatcctggcgactctcaagagagaaacctcagagtgactaaaatctccataatgagaagacatgtacattcagtatctattttggtaggagactttatattcagccttctttctgtagagtaagacgtggagatttggacttagggtgggctgtatgtggggtggagagtaacaagataagcaaggaattaactccatagtaaatgttaacactttctacatctttaaccccaattttatgtgccaaagaaagaatccccacaactgataccttcctggcagaactgacttcaggaaaggcaactcaggcagatattcgagtaggcctagactgtgtgggcctgtggccagtctcacaacaaaacagaatcaacagccttgcagtctcagaaatgcagtggtcattctggtaagcaatagtcaaaactaaaatttcttaaactgattttttgcctctatggtcaaaggagaactgatcctacttgttatttcatagatggaaaaatccatttgccaatcaggatgtgtctgatactccttttttttttggtttcaagagtaaagtcaagaaaagctgctttttgaaagtcaaagaatcacagtagttgttatttcttagtgcttactatttgctacatgcttcacatacgtggtctcatttaatcttcccaaacaattttgccataatattattacaaccatgttgaatctgaaaataataataataataataataataataaggcttagagaggttgagtaacttacctaaggttaccaaattagtaaagactgaactgggatttaaaagcaagatttgtagaatttttctccaaaacccagaatctctgcattgagccagcctgccattctgagacagacaacattcataacacttgcatattgtttgtacagtgttcattgtttaatgtagggcacatttcatacataccaagaggaatcatatgcttattcttgctagtatatggcaaacttttccattctataatacaaatatgactgatgactgctgtcatcagcccagcaaatcacctttcatcacaggtacacagatgacaaatacagagtacggaaggagtcagctgaaggtgctgcttgcctgggctgtcttttttttttttttgttacatctgccacttcatttattttatttgcaggaggagttgaaaccaattttaagggagattttcattttccccctaaacatgaatcattcaagtaaaaccaacttaactatagaaatgtagcaaagtaaggggaaagcagcacaacaacccaagaggcaaaggctggggggaaggggtgggtgcagtctgcgtataacatatgcacaaatgccttatgattcccctgctcaggaccgcctccccagaaggcaagcacaagggcccattttaagaggatgtttccccccaaacatctgagagcgcttcaacttaaacagcttacggttaaaaagacaaaaaagaaagcaaaactaaccaaagaaactccaaaaaaccccatgaaccacccagccataactgccttccttaatcgatcataggagtttcattttataaaaagataaataaaaaacattgaaaaaaatattttatcatgttatatttgtaaagataatagaattcatacgtttcttagaaaacagaccagacactgccctccagtttccaccccattgctgggaggatcagcaggactagaaagtttgggatactggagctgccggtggagaatgggaagtccagcccagaagaaattaggaaatagggctcaggggcacgtgaggtgtggttaggagcaactccacgtgatacatggctgcacagaaaaggggaacacaggtgatcggaaaggccttaaactcctccttgacatacaaaaccgattttcacaaagatccaggcagtttggtcccaaactaaggtgaacacttcaaagtttattcacatgctttactttctcttttaagaatcatcgtttcccaaattaaattagatttaaattataatgttactacatatgcctaaaaaaagaaaagaaaaaaaaagaaaggcttttaaaatcaggacaggggagaagagattgaaaatcatcaaattagtcctcttagctccaaatgaaatgaaattaagaacaaaaactctgggcctaccgcaccgattgcagctgcagcttgcaatggcaccttgggctgtcattttatccaaaacaatcactgctccgtagaaagactgcaaagacttggagtcctgtgtttcagtcctggtgttggtgctaaccagttgtattgggcttgttacctacgaagaaaactcacctttgttaaatgcccagtgtgtattgggcacggctttcttttttaatttatgtggttttctttagaagcccatacgtgtccaagggttatgaaggatgctaaagttagactcttccacccatggcccccagcctgtgatcccattcccagtgttatctattgttaccaattttgcataatacttctagagtaccaggaactttaaatatattatgtcagttaagtttcctggttattgctccaatttaatttaatttaatttaatttaatttttttgtctttttcaggatttagggcaggaaaggcaggctagtgtatgtactcagtctgcatatttgctccaatttataaccctattttacagtttctgaaattgagcttagtagctacttgcaaataactaattagtagtggagctaagattaattcaccctttctgtactcactgaataactataatggtaccatgctaggctttgaggatgggatcatgaggcacatagatccttcctgtcagtctagtggaggggttttcttttttttattaattttttttctttaattagggataggatctcactgtgttgcccaaggctggtcttgaactcctgggctcaagcagtcttcccacctcagcctcccaaagtgctgggattacaggcctaagccaccttgctcagccaagtgaagaagttttaaaaagtaaatagataagctactgcttccactgtcaccatgtgatgtgcctgctcccactttgccttctgccataaccaaaagttcctgaagccctcaccagaagctgaatagatgttggtgctacgcttgtatagtcagcagaaccgtgagccagttaaacctctgttctttataaattgcccagtctctggtatacctttatagtaatgcgaaagtggactgatacagaaaattggtactgatgagtggggtgtagctataaagatatttgaagatgtagaaatggctttggaactgggtcacaggcagaggttggaagagtttggagggctcagaagaagacaggaagatgagagaaggtttggaactgcttcaaggctggttaaatggttgtgaccaaaatgctgatagagatattgacagtaaagtccaggctgatcaggtctcagatggaaatggggaaactgttgggaactgcagtacaggttactcatgttatgccctaacaaagagcttggctttattgtgttcatgccctaggggtctgtgggagtttgaacttaagagtgatgactggctgagcacggtggctcatgcctgtaatcccagcactttgggaggtcaaggcaggcagataacctgaggttgggagttcaagaccagcctgaccaacatggagaaaccccatctctactaaaaatacaaaattagccgggcatggtgacacatgcctataatcccagctacttgggaagctgaggcaggagaatcacttgaactggggaggcagaggttgcggtgaaccaagatcacaccattgcactccagcctgggcaacaagagcgaaactccatctcaaaaaaaaaaaaaaaaaagaatgatgacctagaatatctggcagaagaaatttctaagcaacaaagcattcaagatgtgccctggctgcttctaatcacccacaatcagatgcaggagcaaagaaatgacttaaagttggaacttacatttaaaagggaagcagactgtaaaagtttggaaaatttgtagccttgccatgtggcagagaaagaaaaacactttcaggagagaaacacaagcaggctgcagaataaccacttgctagagagattagcatgactaaatgggagccaagtgctaacagccaagacaatgggaaaaaggcctcaaaggtgtttcagggatcttctaggaagtccctcccatcacaggctcagaggcttaggaggaaataatagtttcaggggccagatccaggacatcactgctctgtggaacctcaggaacactgctccccacatcctggctgttctggctccagccttggctcaaaggggcccaggtacaacttgtgctgcagttctagagggtataatccataagtcttggcagtttccatgtggtgttaattctgcaggtgctcagaatgcaagtgtgaagaaggcttgatggtttcctcctagattctggatatatggaaaagcctgggtgtccaggcagaagcctgccacaggggtggagcccctagagagaaactctactaaggcaatgcctaggggagatgtggattccagtccccaccacagtgtccccaccagggcactgcctcatggagctgttggtgggggcccactgtattagtctgttctcacactgctaataaagacatgcctgaaaatgggtaatttataaaggaaagaggtttaattgactcacagttcaacatggctggggagtcctcaggaaacttacaatcatggcagaagtgaaacaggcacgtcttacatggtggcaggtgagagaagtgaaaaccaagtgaaggaggaagccccttagaaaactatcagatctcgtgagaactcactcactatcacgagaacagtatggggggaactgccctcatgattcaattatcttcacctaggcctgcccttgacacatggggattattacaattcaagatgagatttgggtggggacacagagccaaaccacatcacccaccatcctccatattccagaatgatagattcactggcagcttgcaccttcttcctggaaaacatgcaagtactcaactccaacctgtgagagcaatcacatgggctgcatcctgcaaagccatgtgggcaaggctgctcaaggccttggaagcctatccttcacatcaggatgcaggacttggaatcaaggattatgttggaactttaagatttaatgcctgccctcctgggttccagacctgcatgggcctattacccctttcctttggccaactcctcccttttggaataggaatgtttacccaatgcctgtactaccactgtatctttgaattcaataacttgtttttttattttacaggtttatagatagaaggaacttggccttgagtttcagatgagactttggacttttggacttttgagttaaggctggaacaagttaagactttaggggactattacaaaggcatgattgtattttgaaatgtgagaaggacatgagatttgggggtgcagtggcagaatagtatagtttggatgtttgtcccttccaaatcttatgttgtaatgtaatctccggtgttggtggtgggacctggtgggaggaggttggatcatggggctttgggtagtgtggacatattaacaatattgattcttccagtccatgaacatggaatatatttccatttatttgtgtccttttcaatttttttcatcaatgttttatagttgtcatgatccctcgtgaatggcttagcatcatcccctgggtgatgagtgagttctcactctggtattttacatgagatctgtttgtttaaaagactgtggcacctttcccctctctcttgctcccactcttgccacatgacatgcctgctcccacttaccttctgctatgattataagcttcctgaggccctcaccagaagctgagcagatgttggtgccatgcttgtacagcctgttgaattgtgagccaattaaacctcttttatttataaattccccagccttaggtattcctttatagcaatataaaaataaactaaaacatctatcatgtgctgtggttcttactggagcaccatcaactcaacttgtagcactgaggaaagctgttagaaaaagtgacctccgtgctaagacatcaggaatgagctaggagttagccaggtgaaggggaaaatgttagaggatggacagaagagtaatcttaagcctgatgttttgggaggctttcagggtgactggaactgttgtgggagtgtgcccaaggtgactggggaggggtaaactgaagactgagtagttcagatattgtaaagcctgtgaggatttagtaggggagtgatgtgatcacattctaactatgggatggagaatgaattcaaaaacgccatgctcgttgagaggctgccacaggggagaacccatagcagcctgagtcaaggtcaatgctgaggtatttgggaagcagaagcaaaagaccttcagggactggtatgcagcaatgatcatgagaatagattctgtaaccaccaggaatctttgctctgttgtttcctgatagcagaaccattggacattgaattgtttgtgatattgtacagggcattgttataacctttttaaatatcacttttctaatttgcaagatgggagtaaaaatggggtcaaaatggggatactattagtacttaccttgtaaggtcatcataagaactaaaagagaattcctgtaaaggttggttgtagtgtagttcccacatatattaagcatttaggaaatctcaaagcaaagggaggagccaagcatgtctttccaggtacaaccttgggcatctaagtgcttggtgttgccagtctctgtgttgaggaacacagaaaagggacagatttggaggaaggtgataaattcggcctgcatttgtttgagtccaaagcccaaatctcttcactacaccagtttccttaaagacactgccacttcctatctgtgtgatttttttttttttttttttttttgagacagagtctcgctctgtcgcccaggctggagtgcagtggcgtgatctcggctcactgcaagctccacctcctgggttcacgccattctcctgcctcagcctcccgagtagctgggactacaggcgcccaccaccacacccggctaattttttgtattttttggtagagacgggatttcaccatgttagccaggatagtctcaatctcctgacctcatgatccacccgcctcggcctcccaaagtgctgggattacaggcatgagccactgcgtccggcctcctgtgtgatcttttttaaatatatatatatatatttttttcttttcttttcttgttttttttttttttgagatggagccttgctctgtcgcccaggctggagtgcagtggtatgatctcggctcactgcagcctctgcctcctgagttcaagcaattctcctgccccagcctcccaggtacctgggattacaggcgcctgccatcatgcccagagaatttttgtatttttagtagagatggggtttcaccatgttggccaggctgatctcaaactcctgacctcaagtgattcgcctgccttggcctcccaaagtgctgtgattacaggtgtaagccactgcgcccatccctttaataatttttttatttttaatttttatgagtacatagtaggtacatatatttatgaagtgggtgaaatattttcatacaggcatacaatgaacaataatcccatcagggtaaatggggtatcatcacctcaagcttttatcatttctctgtgatataaacattcagattatattcttattttaaaatgtacaataaattattgttggctgtagtcaccctgttgtgctgtcaaatactagatcttattctttctatctacctatatttttgtatgtattaaccatccccacttgcatccaccttcactatctttcccagcctctggtaatcatcattctacactctatctccatgcattcaagtgttttaatttttacctttcacaaatgattgagaacatgcaaagtttgtccttctgtgcctggcttacttcacttaccataatgtgttccaattccatctgtgttgcaaatgacaggatcttattctttttatggctgaacagtactctattgtgtatgtgtaccatattttctctatccattcatctactgatgaacacttaggttgattccaaatcttggctattatgaatagtgctgcagtgaacatggagtgcagacatctcttcgatataatgattttctttattttgcgtgtatacctagcagtgggattgctggatcatatggtagttttttagttttttgagacaccaccatactgttctgcataattgctgtattaatttacattctcaccaacagtgtatgagggttctcgtttctctgcatccttgcattattgcctgtcttttggatacaagccactttaactggggtcagatgatatcccattttgttttggtttgcatttctctgatgatcaataatgttgaacaccttttcaggcacctgcttgccatttgtatgtcttcttttgagaaatgtctgtttagatattttgcccatttcaattggattattattttatttttccccattgagttatgtatcttctatttattaatcccttgtttttttgttgttgtttgtttgttttgtttttgagacagagtcttgctcttgctcttgctctgtcgcccaggctggagtgcagtgatgcgatctcggctcactgcaacctctgcctcccgggttcaagcaattctccttcctcagcctcctgagtagctgagattacaggcgcctgccaccatgcccagctaatttttttgtatttttagtagagacggggtttccccatgttggtcaggctggtctcgaacccctgacctcgtgatccacctgcctcggcctcccaaagtgctgggattataggcgtgagccaccgcgcccagcctattaatcccttgttagatggatggtgtgcaaatattttctcccacttcgctttgtcttttcacttcattgataatatcctttgctgtccaaaagctttttaacttgatttgattcaatttgtccatttttgctttggttgcttggcccagaccaatgttctggagagtttctcctatgttttcttttagttgttttatagtttcaggtcttatatttaagtctttaatccatttatatttgatttttatatatcaagatatacaaaatacaagatattttgtatatcaagagatagtaatctagttttattattccacagatggatatccagttttcccatcattatttgttgaagagactgtcctttccccagtgtatgttcttggtacctttgttgaaaatgaattcactgtagatgtatagattgatttctgggttctctattctgggttctctattctgtcccattggtctgtgtttctgttttatgccagtaccttgctgtttcagttactatagctctgtgatataatttgaagtcaagtaatgtgattcctccagttttgttctttttgctcaaaatggctatgactattctaggtctttggtggttccatatacattttaggatttttttttctgtttatgtgaagaatgtcattggtattttgataaagctttcattaaatctgtagattgctttgcgtagtgtaggcatattaacaatactgattcttccaatccatgaacatggaatatatttccatttatttgtgtccttttcaacttttttcatcaatgttttatagttgtcatggtatagatcaccacttctttcgttaagcttatttccaggtatctaattttatttatagttattgtacatgggatattatcttgatttctttttcagattgtttgctgttggcatatagaaatgctactgatttttgtatgttggctttgtatcctgcaactttatgaaatttgtttattagttctaattgttttttgggggagtctttaggtttttccaaatataagatcatatcatctgcaaacaaggataatttgacttcttcttttccaatttgtatgccctttatgtttttctcttttatgattgctctagctagaacttccagtagtatgttgaataacagtggtgaaagtggagccatgcacggtggcttacacctgtaatcccagcactttgggaggactaggtgggtggattacctgaggtcaggagttcacgaccagcctggccaacatggtaaaaacccatctctactaaaaaatacaaaaattagctgtgtgcagtggccggcacctgtaatcccagctacttgggaggctgaggcaggaaaatcgcttgaacctgagaggcagaggttgcagtgagctgagatcgcaccattgcactccagcctgggcgacaagaatgaaactccgtctcaaacaaacaaacaaacaaacaaacaaacaaacagtggtgaaagtgggcatccttgttgtattcccaatcttagaggaaaggctttcagttttttcccattaagtgtgacactaactgtgggtctgtcatatatggcttttatcgtgttgaggtatattcctcaacacattacccagtttgttgagggttttcatcatgaagggatattgaattttatcaaatagtatttcaagattaattgaaatgatcagatggtttttatcttctgttgatatgatgtatcacattctttgatttgcatatgttgaatcattcttgcatccttgagataaattccacttggtcatggtgaattattttttaatgtgttgttgaattcagtttgctagtattttgttaaggatttttgcatcaatgttcatcagagatattggcctatagtgttcttttttctttttgttcctttttccttttctttctctctttttttttttaatgtgtctttgtctggtgttggtatcagggtaatactgacttcatagaatgagtttggaagaattcactcctcctctattttttggaatagtgtgagtagcattagtattagcttttctttttaaatgatttttttttttgagacggagtctcgctctgtcacccaggctggagtgcagtggcgtgatctcggctcactgcaagctctgcctcccaggttcacgccattctcctgcctcagcctcccgaggagctgggactacaggcgcctgccaccacgcccggctaattttttgtatttttagtagagacggggtttcaccgtgttggccaggatggtctcgatctcctgacctcgtgatccacccacctcggcctcccaaagtgctgggattacagacatgagccaccgcgcccggccttctttttaaatgttttgtaaaaattagcagcgaagccatagagtcccaggtttttttttgctggcatactttttattatagctttgatctcattgttttggtctcttcaggttttgaatctctttgtggttccatcttggtaggttgtgtgtttctaggaatttattcatttcttctaggttttccaatttattggcatatagttgctcatagtagtctctaatgatcttttgaacttctgtggtatcagttataatgtctcctttttcatctctgattttatttatctgagtcttctttctttttttcctagtctggctaaaggtttgttgattttatcttttcaaaaaaaaaagaaattttcattttattgttcctttgtattgttttttaaatttcatttttgtttatttctgctctgatctttattatttattctactaattttgggtttggtttgctcttgcctttctggttttttaagatgcatcattaagttgtttatttgaagtttttcctctttcttgatgtaggcatttattgctataaactttcctcttactactgcttttgctgtatcccataggttttggtatgttgtgtttttatttttatttgtttcaagaaattttttcttttaaaaaaaaatttttaaattttaaattttttctcaatcaatgccatgccagaatttcaagaaatctttaaagttgtttcttgatttcttcattgattcactggtcattcaggagcattgtttaatttccatgtgtttatatagttttcaaagttccttatgttattgatttctcgttttattccattgtgaacagagaaaatacttaaaatgattgcagtgttttcatagcctaataaatggtctgttcttgagaatgatccatgtcttgaggagaagaatgttaattctgtagccattggatgaaatgttttgtaaacatctactaggtccatttggtgtatagtgcagattaagtctgatgtttctttgttgatttgctgtctggatgatctgtgcaatgctaaaagcagggtgctaaagtctctagctattattatattaggatctatctctatctttagctctaataatatttgctttatatatctggatgctccattgttgagtgcatgtatatatttataattgttgtattatcttgctgaattgatgcctttatcattatataatgaccttctttgcctatttttatagtttttgacttgaaatctattttgtctaagtatagctactcctgctttttttcatttccattttcatggaatgtctttttccatccctttatttttagtctatgtgtgtctttataggtaaagtgtgttttgtgtaggtaacagataattgggtcttgtttttatatccattcagccactctatgtcttttgattggagagtttagttcatttacagtcaatgttatcgttggtaagtggggacttactcctgccagtttgttgttttttggttttatctcccttccttccttcttttctgtcttcctttttgtgaaaatgattttctctggtagtatgttttaatttcttgctttttattttttgcatatctgttgtgggttttttaattcaaggttaccatgaggcttgcaaataatgtcttataacccgttatttaaaactggtaacttaactctgattgcaaaaacaaagaaactaacaagccaagggaaaactaataaaaactatacttttacttcgtccctgcctcttacttttaactccttgtggtttctgtttctatcttattatactatctatatcttaaaagttattgtagttgttatttttgataggttcatctctttagtattcctactcaagatatgagtagtttatacaccacaattgtagtgttatagtattctgtatttgtctgtgtactcactattaccagtgagttttgtatgttcagatgatttcttattgctcattaattccctttagcatttcttataggacagatctgttattgacaaaatccctcagctttcatttatctgggaaagtctttatttctccttcatgtttgaaggatatttccacaggatatagttttctaagataaacatttttttctttcagtactttaaatatgtcatgccattgtttcccggcctgcaaggttcccactggaactcctttatgtgttacttgtttcttttcttttgctgcttttaggatcctttctttatccttgacctctgggagtttgattattaaatgtcttgatatggtcttatttgggttattctttttttttttctgtcttctttgctttttttttttttttttttttgagataggttctcactctgtcacccaggttggagtgcagtggcatgatctcagctcactgcaacctccacctcctgggctcaagcaatcttcctgcctcagcctcccaagtagctgggactacaggtgcaaaccaccatgccccactaatttttgtggttttggagagatggggtttcaccatgttgccgaggctagtcttgaactcctgagctcaagtgatccacccacctcagcctctcaaagagctaggattataggcatgagccaccactccaagcatgcccatgtattttcaaatagcctgtcttgaagctcactaatactttcttctgtttaagccattctgctgtagagagactctgatgcattcttcagtttctcaactgaatttttcagctccagaatttctccttgatttttaaaatttatttcaatttctgttaaacttatctaataggattttgaattccttttctgtgttaccttgaagttcattgagcttcctcaaaacagctattttgaattctgtctctaaaaggtcgcatgtctcggtcactctgggattggttactggtttcttatttagttcatttggtgaggtcctgtttttctggatggtcttgatgcttgtgaatattcatcaatgtctgggtactgaggagttaggtatttattctaatcttcacaatgtgggcttgtttgcactcacatttctcgagaatgttttccaagtactcaaaggaaattgagtgttgtgatctaagtctttggtcactgaagccatatatgcattaggaggcaccccaatcccagtaatgccatgactcttgcagacttgtagaagtactgccttggtagtcttagataagaactgggaggattccctggattaccaggcagtcttctattctcttccctactttccctcaaatagaatctctctctccattctgagctgcctggagttgggggaggggtgacacaagcactcttgtggccaccattgctgggactgtgctggatcacacctaaagccagtaaagtactgggtctcgcccaaggcctgtgtcaattattgcctggctattgcttatgtttactcaaggcctaagggctcattagtcaagaggtgatgaatcctgccaggcttgcgtctttcccttcagggcagtgggttcccttctggcccagggtgggtctagatatgctgtctggaagctaggacctggaattgggaactttaggaatctatttagtactttattttactgtggctaagctggtacccacattgcaagaaaatgacctttttattcttccctctcctttcctcaagcagaagtctctcttttcctcaagcagaagtctctccccatgtccaccaccaccatgagccccaggtccatggcaacaactgcctggctactgctgatgtttattcaaggcacaaggaccctttagtaagcaggtgaatcctgtcaggtctttgtatctcccttcaggacagtgggtttccttcagacctagggcagatctacaaatgccatccaggagctaaggcctggaattggggaccttaggggtctgtgtggtactttattttaccatggctgagctggtacccaaattgcaagacaaagtcctttttacttttccctctcctttcttctagcggaagctgtctttcccatggccaccataggtgagaacgtactgggtcacacctaaaagcagcactacctagctgtgtgatcttgagcgaattactcaatatcatcatctgcaaaatggaaatgatagtaaatagtacctttctcatatgattgttataaggattaaatgagttaacatgtgaacctggtatattattagctactgtaattggttgtaaaagtctggatatacctaatggtacactttttaaaaaatctttttgcctctaatattacaggttgaatgtcaggcatgccatctcttttcaaatagatttaaactaaaaacattattaaagaagaaatgagagattgctctggctacaggatgaagaaatgatcagagtcagggcaggattcaccaggagagcaactcagtagtgagttccagttagttctagaggctatgatgcagctatcttacagataagcacgcggggcaagttgctaggggaacccaggctctaaaattgcagttgaagtaggtaagctctaaaattgcagtaggtaaaaggtaatatgggtaagataattgctgctggtagaactcaatgagagggaaggcctgggggagactgtcagtagtgaacctggggcctagaggcaacaataaaagtaatgcttattttcagttcctgcagtctgtggctccttcaaacatattcctgagggcaaaaggtaactgaccttagggtgaggtagttggacgacagagtatataggtaaagcaaagaaaggcattgtagagctacacacagcatttgcaaagccataaaatgtgcaacagatgtactcagaactcccatagttcagaagcggggtggatagcaatgagagaagagaccccaggagaatggagaaggggctagattatgctgtcttgtatgctatgcatggcagcctctttttagtgcctgcttagtatttatctatccctcagggaatatgaccctattcctagctcaggggtaaatcctgatagtctacaccaatcataataatctatttcatttcctagcattggtttaggtgtgtgtgtgtaacccagtgtagtcaatgagacatagagaaaagttgcctaggaggtctttgggaaagatttcttcactctattatttatatatatatagagagagatggtgtcttgctgtatgtattgcccaggctggagtgcagtggctattcataggtattcattggtatgaccatagccttgaactcctggcctcaagggatcctccagcctcagcctccttatagccttggacttcagctactggccaccatccctagctggtttcttcactcttaaaggatacctaaggaatagtcagtctcttttcttccactgatgttgatgtctgagatgtgatgcctggaaatagggctactatgttgtgaccatgaatggatctagcctgaaaaccaagctcgaatactccaagaatggtagagcagagatagaacaaactggagtcatttatgtcattgtggggcactgcatcagccaaacataaaggtgctctacttggtaacctcttgctatttgagataataaatgtttcctattgtttaagccaatctgagatagggctttctgttatttgtggctgaaggcatggtaattgaaacaacatgcaaagaaacttagccttatcatgtagggaacatgagatcaaaaaaagatctttaagcaagaagtgacaatagcatttttttgcattgtggactaagcagtctgtcaaataaattcactataattttaacatttaaatgtaccccaagttgattttgtcccatgatataacaaataccatatgttatattacatatgccatttagtttgaagtaaatttacaaactggaatttaaaatgataacgtctactctgctaatgatgttgagtatgtactagaggaagtgagagtgaagaaaaatgatcagttaagtccatgagaagtaatgagaactttaatgaggaggaattgatgaatcaagaagcaatatcatctggacttagtgatgactggtggtaaaaggggaggattacaaaatgattccaaaatgttgggcttggatttccagggctctatttaccaggagaagagcctgaagaaggttttggttgcagtgaccagaaacctaatcaagctagctaaggaaggatacaggagtatctctcagagcccagagcaagaagtttcactgggcctcagccagagtagactgaaccctagggaactggattctacctgttctgggtgatggcatatggtctgtcatttctgcttctctcagcacatcagcctcattttctccagactggttttctctgttgggcgtggtgatcttatagttatcccagccccagctttcttggacccagcagagactaactcaggtcttctatgtttcagttccaaactctcgggagagagactctaaatagtccatcttcgatcaggtgcccattctttgtcctgagagttctggttgaacagctaaattagtggtttgtaaggcaattcctcccaggattataagagagcatgtcctctaaaaggggatatgggaatagcgaaacagtaaattgatggaggagatgattacatttcaagtatattagtggctacaaatgatgaaacagatagggatgggagcaaatgataaattaaaatttgaatatattaattttgtggagctcaagggaccatcagtggaaaatgtcttttaagcagagatctgaactgaagttggaaaggtgacaccatcagaatgtaggtgggaataaaaaaagaaagaaggctgggtacagtggagcacacctgtaatcccaacaatttgaaaggcagaggtgggaggattgctcgagcccaggagttcgaaagcagcctgagcaacatggtgaaaccccgtctctacaaaaaatacaaaaattagctgggtgtgatagcacacaactatagtcccagctactcgagtggctgaggtgggaggatttcttgaccccaggaggttgggcctgcagtgagccaggatcgccccatggcactccagcctgggtgacagagtgagacactgtctcaaaaaggaaaaaaaaaaaaagaataatgagatatgagacagacctatcagaaggatcacatagactgagaagaggagagtcaaggtttgtgctaccagacacactgatttgtttttattttatctacttttaaagtaatgaatagttcaatttttagaatcttgaaatggtatttataaagagtttccttcccacccgtgtcccagccatacatttcccttccctgtaggcgatatcatcatttatatcttttcaaagatcagctgggcgtggtggctgacgcctgtaatcctaacactttgggaggctgaggcggaagggcatttgaacccaggaactcaagaccaccctgggcaacatagcgagaccctgtctctacttatgtgattatatatatatatattttctaaataaaaaatgttaaaaaatgataatctatgcatgtaccagtaaatacctttattatttctacaccccccatatttttcaaacacaaatagtaatataccatttacttaacttatttaaacaattccttagtgatggatgtttaaagtgttttcaacttttgctattatgaacaaaacaacaatgaataactggagtgcaattttttttaaagaaatgggtgaagaagataaactaatgaagagccttgaggaggtcgtcaatggctcttgctcccacagtgccactcaaactacagtaacaggagccatccataatctccaccccagctcgtctctcttggacattgcatgctgtcatgcttctcccttggctgtcacacccccttcccattggttttccactcgcttatctactctttgccagacccctggctcttgtctaaatctatcctgttctttttctttttctttttttttaaaggcagaatcttgttctattgcccaggctgaagtgcagtggtgcaatctcagctcactgcaacctccacctcccaggttccagagattctcctgcctcagcctcctgagtagctgggattacaggcgcatgccaccatgcccagctaatttttgtatttttagtagagacggggtttcaccatgttggccaggctggtatagaattcctgacctcaagtgatccatccgctttgacctcccaaagtgctgggattacaggcatgagcccctgtacccagcctaaatatcctaagtgaggcagggcaactgcaagaagttattctgtggttacacctctggaatctagaaaggcctttaagtgtaaacccattatgaaaactaacaatctcactaatagggatacattaatatcattcctcaatatttactagccatgtgaccttggacaaactcattgacctttctgagccttactttcctcacttgtaaaatcaaaagaataatagtatccctttcatagggtggttgtgaggatgaaatgaaaagatgtatgtaagcactcagaaataatacttggcagtcgcactctttgcagaagataatgaaaagcatttcatagtaacagctcattgcatttcagctaatatagagctatccccagatgggcacctgggaattcctttccccatctttgtctttttgtcttttctattttaccctattgcacatcccccagggtccatgcttcatcctgccagagccacaggaggttcaaggccaaagtcaagttgggaagactgaaggtggcttcttacagctttccatggcggtttctgcagacaaataaatctacttcaatccacttttatactaaattatcctctttctacctagggtggggagatctctgtctccctgcagtttaatacaatagcttgaaggataaggactaagtaaggaggcagataatgtaaaagtagactatactttttgaaaccttggtagtgaagagaagagagacagaaacactaataacagggttaagattgcaatcatttgaaatttaggcttatttacagtctattcgatattgtatgttgaatgatgcagtccaagctggggaaaataggcttttgtagaggagtatgcttctcttctagaccagagaggtttgttcattctggagcactcaaagcaaccaactccaacttcaccaaagtagaaaaaccagcctcttaacaaagaaattctttgcagtccttggttcccatggccaattttaaagtcaaaagacctcaatacattttttttgcttttatcaatttaatacattcacttactattattatctgccttcaaaaacatctgactttagggatgacagttttcactatcctggggaattaaccttaaaactaataagtgtctctatggtgcagccaaagttacaaagccagactgaagtctgcagataccaatgatggttggtctttgtttaaccactaatcactaagagacctgactcccaggggtcttaaatgttagggtggaagatggtggatcagtctacggtacttacttcctgacagcaagtcagaaagttgatctttttttacatttaaatttaatttttattttactgtagtaagaacatttaacatgagagctaccctcttaacagatttttaagtatgcaataccatattgtcaactataggcacaatgttgtacagcagctttctagaacttattcatctcacataactgaaactttagcaactccctgttttctcttcccctccttctgcttctataaatttgactattttaggtttttcctgtaagtggaatcatgcaatatttgtccttctgtggctggcttattttacttagcataatgtccttaagtttcatctatgttgtcacatattcaggatttccttctgttttaaagctgaataatattctattgtgtatatacaccacattttcttatccattcatctattgatgaacatttaaattgtttccacatcttggctattatgaatagtgctgcaatgaacataggagtgcaaatatttctttgagatcctgatgtcaattctattggataaaatttctgaaataaagaactcccacaactcaacagcaaaaaaactaacacctgattttaaaatggactaaggatttgaatatacatttctccaaataaagacatacagatggccaataggtatattaaaaaatgttcaattccactaatcatcaggaaaatataaatcaaaaccacaatgaggtatcacctcactcctgttgaaatgactgttaccaaaaagacaaaagataagaggtgttagtgaggatgtggtaaaattggaacacttgttcactgttggtggaaatgtaaaatggtacagccactgtggaaaacagcatggaggttcttcaaaaagtgaaaaatataacatataatcagccatctacttctgagtatttatttaaaaagttgatcttgattgacaacccgaagttagagaaaatgtgggaaaactcttacaccacacattcagtctctttggatggcagtttatttagatgtatcaaattgttttgacccagcaattctacttcttgtattgaaagctgtaagtacaagatgtatgtacaaggtactacagatgtatgttctttgcagcattgtttgataaatgtatccatctttcactaaaaataaaactgaaagcaaccaaaatgtttgtaagtatgtaactggttttatataatacagccaccaatattacataatacatatgttaaaaagaaaaataagagtcaatttttatttcagagacagggccttgctctgtcattcaggctggagtgaagtggcatggtcatagctcactgcagccccaaactcctgggctcaagcaatcctcctaccccagcctcctgagtagctgggactacaggtgcatggcattaagcctggttaattcttttttcatttttttttttttagaaatggtgtctctctatgttgcctaggctggtctcaaactcctggcctcaagtgatcctcccatctcagcctcccaaatacgtttttttgtttgtttgtttgtttggttggttggttttttttgagacagggtctcactttgtcacccaggctggagtgcagtggcacaacgttggctcactgcaacctccgcctcctgggttcaagcaattcttctgcctcagcctcccaagtagctgagattacaggtgcctgccaccacactgggctaatttttgtattttgagtagagacagggtttcgccatgttggccaggctggtcttgaactcctgacctcaggtgatctgcctgcctcggcctcccaaagtgctgggattacaggcatgagccactgtgcccggccccagataagtattttacatatataccctcatttgatattcacaacagctctacatgtaaggtaatcatacatcttgatttgccagaacagtctccatttatacctgtcacaatataatgattagtagtgcccccttcattctcaaaagtacctctcttggacagtaaattgtgtggtcaccttatctatgaggaggttattgtcatcaccttattgaatagctgaggaaagggaagtgttaagtaactttcccacattcacacaagtagaaggagagaccagcagagatttaccatgatgtcagaatacagttctgaatttcttggggcaaagaaatgttgcctgtctctctaggacgccatcggcttccaatcaaagcttgagaaatcagccctggaaaattgggaaatgctagtggcaggcttgcagatggaaggcagtgtaggacagttaagtctgtccatttcctcataaaagtatatcattattccacctgagaggtttttatcatcatccctaggagctcatcacttttctttgccaacctttggctccctctcaggaattaaggcctggttttacctttctgtgttggcattttactttttttttttttcccaccattccatctgttctctttccctgaactcccaacagaggtgatgctttgagggcagggataatcatgggcataatgatatttatctaacttatctatactgtgctaggatcagtccagctaaactaggtaaattcctcttgtgtttactattttactgggagccaacttatctggaaaggctgaacagtacagagaaaagaggctagaatttcaggaagttaggacatattcattggtgaatatgttggctgccatattgttatatcatgctcaaaataaccctaaaaggtaggcagtattgtcctaattttctgatgtggaaattataaagcacataaatatatctcactaaattcaaacatatgtatccattcttaactcttccttaacttggtattccaaaatgctcatcgccaacccaacagaagtcagagaggaaaacaacaacctttactgattgcagttgaaatattctacttttataaattttacaaaaacatatggccttgggccaggcgcagtggctcatgcctgtaatcccagcactttgggaggccaaggcgggcagatcaccggaggtcaggagttcaagaccagcctggctaacatggtgaaaccccgtttctactaaaaatacaaaaaattagccgggcatggtgatgcatgcctgtaatcccagatactagggaggcagaggcaggaaaatcatttgaactgggaggcggaggttgcagtgagccgagatcacgccactgcaccattgcactccagcttgggcaacaagagcgaaactccatcaaaaaaaaaaaaaaaaaaatacttgtgaacacgttaatataattcctccaggaccttggaaagttcccatgaattgagggtcctgatgtttaagatttattagtttcatgaaaaatctgtaaatccatttctgataacggagatagaatttggtagatgagggagaaattccaaacttgtgtgtcactggcagctggtacataaagaaattgatactgtaagccttcacagtggcagggtagggcttggcgacttgcctcaggctgtggatcaaagggctccagagtgtgggatctaatggcatagactgtggtccctgcagagtaggtagtgagcatggtgagtaatgtctgccactcactgcttcctgtgattaacagaacatgacaattaagcagaatgtactactggccattatggaaaaagggcctgcagaactgccaggggagtttgtgttccagatgaagggaggctgacttgggactccacagttctaagggatggcctcaaacctgtctttacataagttggccacttctgtctatttgttgcttaggtaccctcctattagcatccactctagctgcacagtaattataatcactgtgtataagtgttctgtgaattagagcttcaagataattttgaaatagttgagatgaaaagttagactagattagaaatccatctcattatctcaagaaatgcaccattacatttgccaatgatgttaggttgaatataacatcaactgtgaatataacatcaactggctgggtgtggtggcccccgcctgtaatccccgcactttgagaggccaaaacaggtggatcagctgagatcaggagttcgagatcagcctggccaacatggtgaaaccccgtctccactaaaaaaaaaaaaatacaaaaattagctgggtgtggtggcaggcacctgtagtaccaactactaggaggctgaggcaggagaattgcttcaacttgggaggcagaggtagcagtgagctgagatcgctgtgtcacccaggctggagagcagtggtgcaatcttgtctcactgcaacctctgcttcccagattcaagcgattctcctgcctcagcctcccgagtaactgggattataggcacgcgtcacgacaccgcgttgattttgtatttttagtagagatggggtttcaccatgttggcctggctggtctcaaactgctgacctcagttgatccacccgtctcggcctcccaaagtgctgggattacaggcgtgatacattagatagattgagttttaggttcctgtgggaacaccgtaggagacattaagtggtgtctaatactggaaagtgctctgtagatatacatttggagcttgtcagtgtatgaaaggtagtccaagtcatgggaatggatgagtttgaccaagacactggataatgggaagacaatagagccaacaacagaattttgggatcactactttaatattacgtgccagagctgtttgtatatacagtggtttctttcataaatgtatttgggaggaaagcatttttagcaaatatgaaattgctcctgtaggggagtatcaagttgcctagggactgtgccctctccatttaagagtctcagccgggtgcggtggctcactcctgtaatcccagcactttgggaggctgagatgggcggatgacctgaggtaaggagttcaagatcagcctgaccaacatggtgacaccccgtctctcctaaaaatacaaaattagctgggcgtggtggcgcatgcctgtaatgccagctactccagaggctgaggcaggagaattgcttgaacctgggaggcagacgttgcagtgagccaagatcgccccattgctccagcctgagtaacaagagggaaactccgtctaaaaaaaaaaaaaagagtctcaaggttatctagttgactgaggagggtggatggtggtgacagacttcaggatttaacataatctttctggttgctccttctctgactcttttgctgactttcactattgaaaagcatgcacactgccaatcccattgctttccctgctctccctttattgtctcccttaaaaagtcagtggtgtgtggcaagcagggcatgtaccttgaaaataggcagacccggtttagaatcccagctaactgtgcgcatgggcaaattacttagtctctctaatcctctgtttttctcatcataaatctgaactaacaatatctgccaggcagggttgctgtaaggactggaaacagtatgtaaaagcaccctgcaaaaaacctgatgtactgaagctgtgcttaccatcatcagacaggtcatctaccctaaaggattttttttcttgttccttctttccgcaaaaaaaacacaaagaatctagtctgacaaggattttgccctgattcaataaaaatgagactggattttcatattgttgaagagatgatgaggactcccctttaaaaccagagatgctaaaatccttaaattatctggaaagattcttactaaattttgctgataaagaatcaatactgaagattttttttgtctctttcccttctctttttggggaaatcagaattcctgttctgaaatgtaagtagatctttatcttaaaaataggttgacaaggacatctctctcctttttctttaagcagatggtaatttgtgattttttccccctggtgctggattccgcctggaggtattaggtgtggacattaggacatggtcaatgttccaccataattccttaccagtagataccagtttctgcaaataacttctgcattgaaattttgagttctaggctgggcgcggtggctcacgcctgtaatcccagcactttgggaagctgagacgggccgatcacgaggtcaggagatcgagaccatggtgaaacctcatctctactaaaaacacaaaaaattagctgggcatggtggtggacgcctgtagtctcagctactcgggaggctgaggcaggagaatggcgtgacccctgggaggcagagcttgcagtgagccgagatcgtgccactgcactccagcctgggcaacagagcaagactccatctcaaaaaaaaaaagaaagaaattttgagttctaatattactccttcactccacttccatgtttttaattaggttctggccattttacctagaaacaccactgctcctcacactagacacttttaacactggtagtttcattgtcttcctctaagctctttcttctggctgtccaaatttcttcggtaccattattctcctggtgatacaagttcaaaaatcaggaggctgggtggctgaaaaacatgatcaaagaccctgatcattcctgtctctctgttcactcatcttcatcttcaggccagctgccctcttggttacaaaatggctgccagagatctaggcatcaccctagatactccaatgttcagatgaagcagacagtagtttctcttgtatgtgtaatatgaataaagaaatatttccctaaagtccttcagcagacgtctcacatctcattggccaaaacatgctcattttaaaaacaatcagtcactggtaaggagtatagggttgtcatgattggcttagattaatcaagatatggccctgagccagggatagtgtcatcttccctgatgtgtagatacccaaataaaactggagttcttctaacaagaaaaaaggggaaaatcaaaagaagtaagatatatgattctggtttccttctaccatcttagtccaaaccccggactagcgtctcaaggacagctgtgatagtttaccaactggtctccccacattttttccatcacaattttgttggatttatcttccagaaacactgcttttccacttagcccttttgtttaaaaatgccattggttctctctaaccttcagaaaaacattcaaacataccatagaatgtttaaaccatagaatataagagttagaaggcccagcgagctttgaatgtcaaaactagcaccaagagctagactagaaaacatggacgtgtggtcttagctaaacacctcttttgcttaaccaaaggaacagtatacagaaatctccctaaaagaacaatcttcaagctaagttaagtaactttctaaggaggtgtatcagtacagattcttaagagaatcaattttggcttgttctctctgaaggctagccttaagtttcatacaaattcttttttttttttagatggaatctctctctgtcacccaagatggagtgcagtggtatgatcacggctcactgcaacctccgcctcccaggttcaagtgattcttcttccccagcttcccaagtagctgggactacaggcacgcaccaccatgcctggctaatttttgtatgtttagtagagatggggtttcaccatattggccaggctggtctcgaactccggacctcgtgatccgcctgcctcggcctcccaaagttctgagattacaggcatgagccaccatgcctgggcctacaatttttacgtgtgtgtgtgtgagagagaaagagatagagaaagacagacagagagagagagagagacagagacagagagagagagacagtgtcttgctctgtcacccaggctcaagtgcagtggcatgatcatggctcactgctgccttggcttcctcagctcaagcaatccttccacctcagcctccccagtagctgggactacaggcctgcgcctaccatgcccagctaatttttttttttttgtagagacgaggtcttactatgttgcctaggccggtcttctactatgttgcctaggcttaagcaatattctcacctcagccttccaaagtgcgctgggattataaacatgagccatcatatccagccaaattctttattttcaccttccattgcaaaacagcctatcttctccttacctgtcttgactcttaccttggtacctccaaaatcttgagacctctggggaataggggagggggaaacaaagggaccatttgaagtattggctcctcccatccctggcctctctggttattgtcaaagaatgcataactctggagagagagacccatgacagcaaagtaaagaacacttcaaatgctaaaaatggagtctgctttttgttttcacttattttcaaaacaaaattctcaaaacctaggaggggccattagctggaaaaaatgtctctgagcagcagatgcagtgccagatactgatgctgattcagggctgagtgatgcatccataccaagcacataccaaattttcacatgcctttccgagtgtcattcaccttttgtagaatgcagtgtgaatgatccctctaaaattgggggtaacataaaaatagttttaaatttaaatggaatgttttctgaggttactacattctctactacacaagatagaattcatggattaaaaattcacctgatttttttacataacgtacacatcattgaataaagtaattaaaacctacttctatgaaattacgtcattgaatatttttccagtgatagtcaattctcaacttatttcttcttttaactgatttttaatttttattttttttaaaaaacagagacagggtctcactatattgcccagactggcctcaaactcctgggctcaagtaatcatcctacctcagcctcccaaagtgctgggattacaggcgtgagccactgtacctggcctatttcttcttttaaaacatttatttttactcctattaacacaaagtaacattatatgccagctgccagacttcatttttagcaattcatactttttctttttcattaagtagataggaaaagttaacaataaaagttctaaaaacagctggatgtggtagcatgcgcctgtagtcccagctcctcagaggctgaggcgggaggatcgcttgagcccaggagtccaaggctggaatgagctgtgatggtatcactgtactccagtttgggtgaccaagtgagaccctatttcttaaaaaaaaaaaaaaaaaggaaaaaacttcttccattaccatccatcctcttatatatctttttatagaaagattttttatataaacatttataaaaataaaaagtaggcataaaattagtactctaagttgagatacatgaactaattgaaaatagtcccattcatcttattaagaactatatctctaataaaatgtttctttttaagttatttatattaatttaacatgtatgtgggtcactttgatatttttacaccaataataattgtaataataataagtttttgactctttagaggcttggccatggtagaaactattacctggctcccacaatttgttccaccctccttcgggtacgtaggtagcctacttttccccatcatccttgctgtaacatgtagtcatgtaattgttctggcaacaacttgtgagtggaaatcatgtatgtcacttccaggcctggtcccatgaaatatcttctgtgcttttctttgctttttctccttctaccagctacacgaattgagaatgaggctctaggaaagcggttggcgaactttggtaaaaagccagacagtaactattttgggctttgcggccacataaagcctctgatgcacattctactggttgtttttttgtttgtttgtttgtttgttttttgtttttttgtagccttttaaagatgtaaatctattcttagctcccagagcacacaaaaataggcccacaagctaaaccctttttctaggagacagggaagccataagatgaaaggaattaggttcccctcatcactatgtggtggggagcactttgcttacctggggacctcacccaggactattctgtgagaaagaaataggctttgattgtgttgagcagttacatgctggacctatttgttattacaaatcagcttcataataacacaggaaataaaaaaattacaaacatttttaatgcagagaagtataatataaaaaatgaataataagacctttaagcataataatatagtacattaagataaatatgtagaagtagaataaaaataggagcttagggaaaaaacatctgactgttaaaaaagagctcatttgtagacttttaaaatggatgtggtgggcatcaaatcgcttggatttagattcaattggatatttcaaagcaaattgcaatagtttattttaaaatatctatattaataacatcatgaaaattacaacctttgcaattattcaaacatacgatgtaatattttagatgtcaactgaaaattttgtgaaggagtacatggttttaaaacattctgttaggggatatgccagcagaaacttttgaagaggcttcaaagaacccttatagactcagaaccaaacctcttttgaaagcttcgtagattccctgggctgaatgtacaagcaggggtttttctggtttgcctctgctcttttcgaaatcctgtgtctaggtcaccttagacagtgttcatacacaggaatgtccttgcttgtcaggagtcctgccagcggtgttgagaggccaggtgtagacccgtttcttctgaccttagattccccagtggatcatgaggatgaagctgttttctttcttcctttcaaaagtgttcccttcttggtggttctgaggattcatgagttaaatatttgttaagtttttgcaatatttggctgaaagtacgaagtcttatttattattgctggatggatgaaaggtattatacaagtgcaaagtatcatttcttcccaggacagacggcgttgtcatgcttaatccccaggcagctcatgaccccattctcttgcacggcctcctcatttacataaccagccacaaactgagttgaaaggactcctgcaagaggatttgcactttctccttttcttcagaatgtgtatctgcctaagcagtgtgataacttttttcccagactggatcgatattccttagctggtcctgttgcagcaggagtccggtgactggagagaggaagctcttgggcagtgagtaaaaaaagagaattgacttcttttttttatctgtttctgtctactcatcaggccctggacaagtcacttcacctcttgcctcattttcttttcttttcttttctttttttttttttttgagacggagtctcgctctgtcgcccaggctggagtgcggtggcatgatctcggctcactgcaagctccgcctcccgggttcacgccattctcctgcctcatcctcccgagtagctgggactacaggggtccgccaccaggttggacatcagcacctgtagaggggatagcactggatatggaaaacttagagtagatagtgaaggaggaagaggataaatagcagttatggcctcaagaccaactacagcggtaggggctgtggtttgtctcattaatcgccctcttctaagattcccctgaggaggaaaggcccacagcaaccttggatgaactgcgccctgaaaaatggagaagtcagcctgtgtgatgcagtctgtacgcactgtgataaaaaccatgtgggtaaatgcttaggactttcttcaatagagtcactgtgaggacagcagtgagctgacatcttcaccagccacacctgtaaaattgcttgcactgttcacactgaaggccgtggtttcttgtctaccaagggttgagcccagctgggtgctagagctgagccattgctgcccatcgcgggacgcccctaagggtcagctgttgccttggaagcactggcctggtcggggctgagacttttcctggccagccctccttcctaccctcctccttcactattgacagacgtgcattgcaatctgaatactctcctagcttactcaccttctttctcctctttaacttttgcaggcattttccccaatacatctctgctcatctgactcttatcttggcatctgcttcctggtggatctgaactgacccataagccacgcttactagtgattttccaggtaatcatctatttttattcatttttttttcttgattggtagtttgaacatgatattaaacacatttactgtataaatatagatatcattgttggccagtttgctgtaattgaactctccagaggggtttcaggatggttttgctttttctagaaattgtagcagggaagcagaggtctacctttgtctgttttcagaagggcaagtttaccttcagagtttccctggattacttttaatgtttcctttccttttccctcccactggactctagtactggggaccttgtttgtcttctttaaacgatagaagtgcaagttcaagtgaaatgacatttctagaagaatggaaattccttatttaagtgaagcccttttgagttcagatgggtatgtgataacagaaagagaagagcactcttgttcccagactagctacccactgctgcccaggctgcagagtaatgggactggtgcaggaactcatttgggattttccttggtaagattatgtggtcacaaaggaggttcccttgtaagatgtggggttcttgtatatgtgggggtatattgtatatgtgtattgttcttgtatatgtgggggttcttgtatatgtgtataaccttgtatatgtggggttcttatttcttgttccacaaaaacaaaacccctggcagtggtgaaatagaaaagactgactaaaggtaaaaacttggactctgtacaaaggcctttggtgattttgggtaaaaaaggccaagtctctcccacgccaatggcttgtgttggaggctgtaaagttactcatttagcaaagctgaccagaaagtcaaagggaggattcattagcaaggttgaaatttaccactagattatgcttgtctttccagccaaacagaatgagacttcatggcagtctttttgtggggtgttcaaacactaatgaaaaaaaatttgaaaccaaggtgactttttggtgagtggagtgtctgagggagcttatgtggagaaatcaatgtaactattgcctcagtgttgtcagagaatttattaaaagggatcccccgttccccattggtaactacttatttttttctaagaatgggatccaacacttcaaattttagaccttgagttgtgatgtgaagcaatgaagactcagttttttgttgttttttttgagacacaatcttgctctgttgccctgcctggagtgcagtggcgccatctcggcttactgcaaccactgcctcccaggcccaagtgattctcctgcctcaacctcctaagcagctgggattacaggcgcccgccaccatgcccggctaattttttgtatttttagtagagacggggtttcaccatgtcggccaggctggtctcaaactcctgacctcaggtgatctgcccgccttagcctcccaaagtgctcagattacacgcctggccaagagtcagctcttgacagccccaaaaatctatccttagggcagatagaagagagagatttttcacatgataatgtatttaaatcaggattagacaaagaacttcatccttccttgctgaaagatacaagttgtcatatttaattggaaaaaggcagtcttttacacttatgagagaagtggatacctaaaaatctagaggcttctttccctaaaagccattaaccagtattatttttatagatttaatgccaactaaccagactctgaattattatcatctctagtgttgaactccaggctgtacaatctatacgagggataagccttgactgacactttcacagacagcagttacagaattttttaggaaggtgacaggtagatctcaagggtcttctcattcactttttctttggtatcttatcaagatgttttaattctcttttcaaatatcttcagattcttttccctctggtgaaacagatggcaggtaggaggaaatatacagaatgaactgtgaaatttctcttgtctaaaatcattcacaaaaaatgggagatgatgactcagtagaactacaacgtgcagccactgggttagtgcccatgtagtcctaacattgtttggctgttaagagcttcatgtgatacctccaagtctagaaggactcaaccagagtatcaggacagattgagacttggggcttccacgaatttggagcatagtgggatgctgggttgcctagacatcattagtaagatttttttcataatttttttttttttttttgagatggagtcttgctctgtcgcccaggctggaatgcagtggcacgatctgagctcactgcaagctccacctcctgggttcacgccattctcctgcctcagcctcccaagtagctgggactacaggtgcccaccaccacgtcctgctaattttttgtattttttagtagagacgggatttcaccatgttagccaggatgatctcaatctcctgacctcatgatccaccccccctcagcctcccaaagtgctgggattacaggcgtgagccactgcgcccggccccattagtaagatttgttttttcctataacaaaatgcatcaagttccaactaaacaatttacaaaataattttaggaatacaactcttaaaaagtagagacccaatgtttcatattaattagaaataatgattcacatcacagaaggattctttaatacacacaagcgctccaataatcagggtttgattgaattttcagtacctccaacacatttaagtttttatttatttaatgagagggaggagacaactaagcttcgatatacattttaggagcctctgtacatcgtatggccattagatgacaaaacatttgtgaaatgatactgtaagtcagtggaggaaaaatgcctttaaaaacagcctctctttccctctctttaaaggaaaagacaaaatagtgtatgctcacagaggaggaagtaattaagagtctgattctgttaggaaactacagaagaaatataatttgaaagccggagagatactggaggggttgagtcctggtgctcttgttataaatcaatggcctttggcaagacataaacttttctaaaccttggttttcttatctgtaaaatagttctagtaaggtgtatctgcccattctcacagggttactatgagattcgtgtgtgactgtacatgtgaagttgttttgtagtctgtaaaatattatataaatatgatttattattattgccatagttgaaatactaacagcttttaatgatcataactagattgagatgtcttcaatcatatggtcaaattaggatgtattgtgtggcagatgctgtatgagaattaatctactctcttatctaagattatctagaaatatatatttttaaagaaaatttagccatttttaagcatgtgtgaattgaactggtgcccacaggcactggctttcttatactcaggtcctctctccaccttgttttggtttggagggctctcttctccttggctccaaaccacaaattaacttttttgaccaggcatgaaaagtgtcctaacttgtgtctggacaatgctgagacagagagataatagtagagcccatatatacttgactcttgtcaccaagaaaaataagacaaggaagagcagtggcttgaacagctagtgtaaccagatctgtgacttatttgggtaaagggaggagttgagtgaaattgtcaaacaataaatgttttaatcaggtggcaaactcttccaagctcagcttgaaagatcacttctgcccttgaacacaatggatattaaaaaaatatgtaccgtatttgttgaatggatggataatattgagcaccttgaaattccccccaccccaaacactgctaattagttctctcatcacacccaaaataatactaataatatggtttgtacttctgagagtgatgattcagtgttatcatgttacacatatatacagatataagcacacaaagagaaatatttatctttttatttctacatagtttttaatataattttagcatctttttattcatttttccatgtttttgaacaaagttataatgatagtattcacagatctttgtttcgtaatttttctcattaaaattataaaaattcttaaaaacatttttcaggttgtcacattgtcttcataaacactttcaaataactatcagaatcttcattgcatatgttaagctgttagatatacttaaccattctcttcttaaatatttaggaaatttctgagccgggcgcagtaactcatgcctgtaatcccagcactttgggaggctgaggcgggcagatcatgaggtcaggagatcgagaacatcctggccaaaatggtgaaacccccatctctaccaaaaatacaaaaattaactgggcatgatggtgggctcctgtaatcccagctacttgggaggctgaggcaggagaatggcttgaacccgggaggcggagtttgcagtgagccaagatgacgccactgcactccagcctggtgacagagcaagactctgtctcaaaaaaaaaaaaaaaaagaaagaaaggaaatttctaatttcccgttattatagatcatggtgcaatgagcaactctgcaatatgccctgatcattaacttctaaaccatactgtatattgttgagccttttcaaaagtgtatttttattttctaggaaaatatctattacttaatatttcccatttaaaaatatttcctccagtcccttgccccaaaatgatagcaaaaatactaaaggataaataacttacataaggtactgaagttaagattaaatatcaaaaattccttttttctctagcccaaatgcattactaaagcaacagataacatcagacaaaagatagtgccttctggccgggcgcggtggttcactcctataatcccagcactttgagaagccaaggtgggtggatcacacctgagatcaggagttcgagaccagcctgaccaacatagagaaaccccatctctactaaaatacaaaatcagccaggcatgatggcgcatgcctgtaatcccagctactcgggaggctgaggcaggagaatcgtttgaacccgggaggtggaggttgcggtgagccgagatggcgccattgcactacagcctgggcaacaggagcgaaactccgtctcaaaaaaaaaaaaaaaagatagtgccttccatcatcattatcatcaaaattatcttccttatcatcatgccagtgatgcatttattaagaacaccaaagtgaaacacggcaacaaaagagtaaatgcaaaaatgagtggcagcaccaattattttttatttaggtatttgcatatttgctatatgctggacactgtgttaaacacttgggatatggtaaattctgaaaacacaagtatcacgtttgatttgtcaaggaactggtcaactcttatcctcatgttgaaccttattcaatagttttctggactcttcattattcaaacctttatctattcaaggtccttgtctgttttgctcctcttcagttgctaatggtgacccaaccctggctctgggaattttctccatactggttcagcaagtcagggcaggttctgccccaagggcttctgggaccacagtcctctaacttagccaccccaccaagtttctaaccatacacctttgctgaaatcagtcattcagaccaagtcagcaacccggaggtagggctgagaagcagctgaagctttcctgaggcaaaaatggcagatgaatagcaggggcaaaatccactgggttaggcatgtacagaacactcctgcatggagaacactttgttaggcatgggagaaacaaaaagaaagtgaagttctcttagacttgttctcagagagcttgcaatcttgttaaagagttgagtccagaagtagctgaaatcgtagtgaatggtgagaaattatctaacaaactgcacagtacactaatgggtgctgaaagaggaatgggcaaaatcatctaaaggtcactatgctctcaacaaggaattgtggccttcttaggagcggtttcataagaaaatttttttttaagatggagtctcgctctgttgcacaggctggagtgcaatggcatgatctcggctcactgcagcctccgcctcctgggttcaagcaattctcctgcctcagcctcccgagtagctgggattacaggcacgcgccaccacgcatggctaatttttgtatttttagtagaaacggggtttcaccatgttggccaggcttgtctcaaactcctgacctcaggtgatctgcctgccttggcctcccaaagtgctaggattacagacgtgagccactgcgcctgacctcataaagaaatttaagctgcttctagccctgcagctatttacagtccagttggggaggcaagagatttctgaggcgaattttacaatacaatatatgccgggcctggtggctcacatctgtaatcccagcactttgggaggctgaggtgggtggatcacctgagatcagcctggccaacatggtgaaaccccatctctactaaaaatacaaaaattagctggcgtgatggcgggcacctgtaatcccagctacttgagaggctaagacaggagaatcgcttgaacccgggaggcggatgttgcagtgagctgagattgcgccattgcactccagcctgggtgacagagtaagactctgtctgaaaaaacaagacaaaacaatgtaaggcagtgttatgtttgattacatgtggaaagagtgaaaaagacaagaacaaggagaatttaggaagaagggagagattactgaacgcctggcaatggagtttggaggacaattttgagcagaattcaaatagcaaagttcaggtaggtgtattaacgaattaggccaaatatgcttgggtcagagcctggctgaagtgggagaaagatactttattactggatcatgtaagaaccagggtcagaaagctatgaagatggcagtgtgttgggaaacctttagtgccagattgatagctttgactcatatacttgtgaacagttgttaaaaaaaacttctgagctgggtaatgacatcataaaagaaggagaccagaaaacagagactggaggcagagaaaccagttaggagaccacttcaagcattttgagataaggtcctgtcgtgagagtgggaagggaagcatggattttgggggacactagaagaaagaatcaatagcatttgccgctgattggatgtgaacagagggaagagaaagggatgactcaggagaagcttcagtaggaagtgtgttgtggggaggatttagaagcaggcatggactttgttggaaagtgtttgcaaatggaaagatttacatatctatcagcaggagtgtgctctcaactgattatcttataaaagctgtggagtttctttatgagatagtcagacaaaaagtatcacacgatttaaaatggcaataccagggagcaactcctggctcacacaggatgcagtctggagaatgcactctgctctagagttacaaccctgggctgaatctcagggttttttgtttttttttaacatggtttcattgtatatatttggacaaaatactttctaactcatcgatccagtttccttatctttaggtctccatgaaacaaaacagccatatttgttgagtgctttattatgttaagcaggctttgtgttaagagctttatttggccgggcgaggtggctcacgcctgtaatcccagcactttgggaggtggaggcgggtggatcacaaggtcaggagttcaagaccagcctggcccaaatggtgaaaccccgtctctactaaatatacaaaaattagccaggtgtggtggtgggtgcctgtaatcccagctactcaggaggctgaggcaggagaatcgcttgaacccgggaggtggaggttgtggtgagctgatattgtgccactgcactccagcctaggtgacagagtaagactccgtctcaaaaaaaaaaaaaaaaactttatttgtggccgggcatggtggctcaagcctataatcctagcactttgggaggccaaggtgggcggatcacttgagaccaggagttcaagatcagcctggccaacatgatgaaatcctgcctctactaaaaaaatacaaaaattagccaggcgtggtggtgcacgtctgtagtcccaactactcgggaggctgaggcacaagaatcacttgaacctgggaggtgaagggtgcagtgagctgagatcaagccattgcactctagcctgggcaacaaagtgaaaccctgtctgagaaaaaaaaaaagactttatttgcaactttttattcttagaatgcacattctacatttaaaaaacatttcaatattttgtggcttaaagcaatatccattttatttgctcacaattctgcaatctgggctgggcttggctgtgcagctctgctggtcttactggtggtcactgatgtgtttgcagtcagccggtggggttggctgaggctgggctcagctcaggtgctgggcagctggacttttccctctctccaagtatctcagggcctttccttctccatgtggtttatccaacagggtaactggacttcttacttagtggctcaggtctcctaaaagtacaaagtggaagcttccataccttcctaggggatgggatgggaaaggcagggaagtggcacaacttcactgccacattttcctggttaaggcaaatcactggcccagtccagattaagtggaaggggctacgtaaaggtataaataacatgaggctgggccattgaaaggcagcaacgcagcagagagactaccacaatattatttccaatttgtaaatgagtaaactgtgacttaggaatgctaagctacttgcataatgtagcagatagagccagcttcaaatattgtgttctaaatcaaatatcaacaaataaaatgtgtatgtgttttcacctagaatcctgtggggtgggtactgttattgtccctaatttacaaaggaggaaacccaagaatagagagcttaaatgtcttgtctgaagtgactcagctgttttgttccagaaattatacacttatccactgtgctgcctcttacgggcagtacctgatacatacaagacatctgtaaatgttatttaatctgaagctgttgttggaatggctgggacaacagcaaatcttttgaattattcactattacatcttatatgctatttgggaactgggagtttttcagttatcctgtgttaagggcaatttccgtttcatacatctactttatctgttgcactatctatttcttgaagcttggaaagaaacgaagactgcatccttgcccatccagttccaacccagattctcactgcccatctaattccaaccctgattctcacctttcttcgggagtgaggactttcctagagtagggctggcctcaagttttcatcttttaatcatcaagtcagccttgtgacttctgaattagtatcattaggttccagtcacttcctcttgttcgatagcttatttcccctgttgttgcaactgtgatggcttctgagagtagcttgcaaagattctactttccaaggagtgacctgtgctagtttcccctttccttttgccagtcctatgggcagaggacttgctgcacagaatcccagctactcgggaggctgaggcaggataattgcttgaaccagggaggcagaggttgcagtgagccgcgatcatgccactgcactccatcctgggcaatagagtgagactccatctcaaaaaaaaaaaaaaaaggatgatacgtgtatgcctgccttagtctaagatggccctaatttcttccagtctatgaggagtctggaattggagccacctccaagtacagataacaggggaagtggctcactttggtggttctgttttggatatggatgcagccattcagggagtggccccaaaattctaccttttccgaggcaaaactatgagtggccttgtcttttccttaaacttttctcctccaaggcagctccagattttaacttcgactttattttaccctgtaaaaatattaaggcaggctgggcgcggtggctcatgcctgtaatcccagcactttgggagcctgaggcgggcggatcacctgaagtcaggatttgagaccagcctggccaacatggtgaaaccccatttttgcttttaaaaaatacaaaaattagctgggcgtggtggcaggcgtcttaatcctagctacttgggaggcagaggcaggagaatcgtttgaacccgggaggcggaggttgcagtgagctgagatggagctattgcactcaagcctgggggacaagagggagacgtcactcaaaaaaaaaaaaaaaaaaattaaggcacaatacgtgaacttgaagaacatacagttctcttttatttaacaaacacttacgtaaccagcccggtgctgtgcgaagtgctttacattgtctcgtttgatttacttaataaactcctatttgaatcaaatggggtggagtaggggcttcctggaatttggcttacctcgccatctccccccaccctttcccctcagtggagaggcaaccagagagaaaagaaattgagctgctctgaagggcaaggcctcctcctacttcccgcagctgtttcgccagacttgaccttcttcccttagctagaggcagggggtctccatccctcgcccagatctagttggtgggaaggtgggtggcttttttcgggtcactggcgcaccctctctacttccagccacctgctcgggttccatcccggctccaggctccccggagggcggcagggacattccaatcctcccacaaccctcacggatgttgcgggggaggggggtgcaattgctcttctcttccaacacccagctttttcttctcaatctctagtggcctgagtcacccccgtagaggaaattaaggattgatgaatggtttgaaagttgtttgtttacaacccacccgttggcgaagccgcatctccagtgacagaggcactttctgggcaccgtctgtgctctagcagacaattgagagccaggcagccaagatgcctcctcgccagaccaaatatggtcacaagagctaagcagcctctcgtggaaaagctggccttgttggtgtctccccgcgccggggcgcacccgggccggccttcgggcagaatcgcgggtcagtgcggcgctccgggtgctgcaggcctcggcgcctggctgcaggggagggcgcggtgtccaggaccggcccttcctaggcctgagcccctcatccgcgtgccctccgccacccccggccttggtttcggtccacaaccccttgatgaaacaggctcaggccactttccctttgatcccgccccaagtccgtggtaaactcaaaggaatgcagatgcaggtctgagcgggagaggtccgcgcggccgggaggagtgggtggggggcacccgtctcctcttacccagtaaagtacccatcacgcccagggttttctggagccgaggtgggaggaggaggaggaggaagaggaggggcgagcgggggctggccggctagggactaggaggtcatacataattcaacagctcaactttcgggcccgcctctttcctgggggtgggagtttgctccaaactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcctgcggttcagcaagccccgagtgcagttattccctccacccctcgccctatcttctcctcctccaggcaacttctttgcttcaagaaagttgcataattctcgaggccaggagggacccctcccccatcctgctggtcttaccgctgagtgtctgggatctccaggcgggcaattatctgtctcctcgtttccttttccctctattctttctcccaccatctcgccctctcaccctgtaaccctcttacccacttcctccgactttaaataaaaggctgatctgaccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaagtaagtcagcctggagccgaagaaggcaccaagtcacagtgcccaacgcgcgcgtgtgttcgtgtgtgtgtgtgtgtgtgtgtgagagagagagagagagagagagagagaaagagagagatggtgcgtgtccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaatcacaagcctgctttgtcactcttcttcctttcacattgttccagctttttgatgtcatgaattttacattagttgaaattttcaaattacaccccacaggaaaatatattctcaaacactagaggaggttgtttcaattgtggtaccctaagataactacattcctcaggagaaaccaggctggaacttgaaatgttccattgaggtcatagggtcaggctatcaaagatggaggttgtgccagcctaaccacttgtttcaggattgcctgcactgccagtgagggaaactcctctcctaagaacttgacttagacttcattttaaagcccatatttctttagtagagtagccttagtgcaaaagtgaagacactatgtacaattttaaaagtttaatcaagcctttctttggcactaatatttgatgctctgattgctatgagagagccctaagaatgaatacacagtgatggatgaagtttactatagtgagcccattgattcataccagtgaccaattcttattacttccccatctcaaggctgttgatatcttgtccaaggagttcttttgttgtttctgagattggtgtaatgctgagattctgaaacagacttgatggtcatttatgccacagctggtcttctctgggttattgagtgatagtttggacatgtgctcagtcctttgacttctaagtagctggtggagtcaagaatatgatgtaataacatgacttttgttgttgttgtttgttgtttgtttttgtttttgagacaaagtctcactctgtcgcccacgctggagtgcagtggcacaatctcggctcactgcaacctccgccccctgggttcaagcaattcttctgcctcagcctcctgagtagctgggattacaggcacccaccaccacgcctggctaatttttgtatttttagtagagacgaggtttcaccatgttggccaggctggtcttgaactcctgacctcaagtgatctgcctgcctcggcctcctaaagtgctgggattacaggcttgagccaccatgcccagccctacatgatttctttctttctttctttctttcttttttagatggagtctcgctctgtcgcccaggctggagtgcagtggcgcgatctaggctcactgcaagctccgcctaccgggttcacgccattctcctgcctcagcctcccgagtagctgggactacaggcacccgccaccaagcccggctacttttttgtattttttttagtagagacggggtttcaacatgttagccaggatggtctctatctcctgacctcgtgatctgcccgcctcggcctcccaaagtgctggaattacaggtgtgagccaccacgcctggccccagccctacatgatttctaaactgtgtttatgaatatatacacacatacgtatggtatatgatcagtataactgtgattattaaaaatatgaaataggagctaggcttgcctaatatctgaggaaaactagacgaaaaagaccctgaaacaaaagcaaaacaaaaaaattcctttatacattgtgttttgaatgattggagtagctcagaactgcctgtgaacaagggcaaaagtggaagttagccttggatttagagaaagttgctgtgatctctctgcccatccccccaaccacaaccactctccaatccaaagcagagtgcatcttcatttcactttgggtagtcaatgaaaatgacagctgaaaaaaatgtgtaagtagtaggctggcctgctctgatgctatccctggaagtattttggccaagtgactaagagaggttaagaatttgtcagtgactattgtctttaaggataagcaatctgccaagagttctctgaatttcttgtagagttttgtttaaagttggaattaggtaaatgtcatacactttgttacacagcctcaaaaggcagtgtatttcagtggattaagtagaagcttgaaaaatgatggtgactcacttggagttacttttcattatgtctgtttattactttacttgccatctatgaaatagggctgaggctagcagatacatttttttttttaatttttttatttttggctggggtagagatggggtttcactatgttgcctaggctagtctcaaactcctgtactcaagtgattctcctgccttggcctcccaaagtgcttggattacaggcatgagctaccatgcccagccagaagaagaatctttttcttgactctgttgggagttgagagctttataagttggaaatcaaaggattttagaatgacaagggtcaattttgtttagtttagtttttgactagaaaattgaggccacggaagggtgatgataggaatttgggaaagtcatgtggttatttaatggtggaccctggactggacctctaatctgttgctgtctacttaggcaacagttttcctttttccccaccgacacctttcccccatgtcacttccttagctaaacaatgaacttaatgggaaacagagcctggacatctaagaagctttaaaaaagccttttgtcattttctcaggtaagattattcctaggtatatgatgtaatcactttctgcaacctcctgaaggcacctttcctgagcattcacagctttcctgtggtgttcaggtgtcctgtggtattcagatattcctttagagtaacaatgactagggcatggtggtgcccacctgcagccactaccacccccaccccatctctaaataaaaagtttttaaaaattagagtaacagtgaagcagattgaatgttaaaacacctagcctctgaaaaccactgtgttcattcattattcctgctgtcctctcaatctcatgaatcaggctggggtgttgggcaacctggcacactgactgaatactgatcacattaaatttttaaaaggtctctgattataaatagaatacatgctttctatacataaaccagaaaatggggaattataaagaagaaagttatctagcttcagtagaatttcccatctttactctttcgcaaacattcttgtaaaaatctttcatttgagtaacgtgattttataagaaaaaagattttatcctcctcttaaatacaattcagactataacatttggctgccacgtctcatttttagtgacaattttagtgttttgccttttctcaaatgtgtgacagaaaattatttttgtccaagtgatccatgcacttggtaacaaatccaatatacaggaggacatttgttgaaaaacaatggtttccttcacctcctcaaggctcacagagggcaacttttaatttttttcaactgtacccatatttaattcttagattgttaccttcttaagcttaagtaatgtgcttttaccaccatgttttgatttatcaacttttagcacctgatatgaaagtgagaatgtagctctttaagctagttttcttttttctctcccaggtttgatgtttataatattttaaatttgtctgttaggtcaccttttttaaataatcatctttttttttttttttttttttttttttttttttttttttttttttttgagatggggtctgtctctgtcacccaggctagagtgcagtgggaatcatagctcactgaagcctcaaattcctgggctcaagtgatcctcccacctcagcttcctgagtaactacgactataggtttgcaccaccatatttggctaatttatttaacttttttgtagagacagggtttcctatgctgcccaggctggtctcaaactcctggcctcaagcaatcctcccaccggcttcctaaagcactaggattacaggtgtgagccaccacacctggctttttcaactttggatagtatttcttgattccttatgctgtatgtcagtaatgtttggattgctaccagttctactgttcactttttgacaatgttgctttccacattgccaaagccctgaacccataacctgtatttgtgctttgccccaaagttgaccatcttattcgtatatgattcttaaagttgaaaatccataaggccgggcgcagtggctcatgcctgtaatcccagcactttgggaggccgaggcgggcggatcacgaggtcaggagatggagatcatcctggctaacaccgtgaaaccccgtctctactaaaaaatacaaaaaaaaaaaaaaaaaaaaaaattagccgggcgtggcagcgggcgcctgtagtcctactcaggaggctgaggcaggagaatggtgtgaaccccggaggcggagcttgcagtgagccgagatcgcgccactgcactccagcctgggcaacagagccagactccatctcaaaaaaaaaaaaaaaaaagaaaatccataggcaacatttacatgactacaattctgtgaaatgattcattgccttgtgtgtcaggattggattttagacttgcactgtgggtctggttttaggattcctgggccaatcaaaggatgagatatctagccccaaagtcaaatgggattttttgttttctcactcttcatcagttgtttaaatttgtgttaccttttagttttttcatatttggaccatgactttcttaaattttttccctagtatttctgattgccttttaatgtgttcatgcattatttgccattattatgatctcaaaagttttctaggctctcaatcttgtctaacctatcgagtcttctttgtctaagctgtatgccgagattcctttctcgttctgtgccgttctgaactggttattcactaagcccactacagagctgtcatcctggaacttctttccatggctggaagtgctgtttccttttcccgtgtcttcctatttttttggtttatccctcattttgctgcagtacatgcttgagtaacttcttaagaagtggtttgtaggaggtaagtttttcaagtccttttttatctgaacgtatttacttaaaaattgttctgactctggcttgttttttctgtttatctttgaatgacagtataatgtagctgttttcataagggccctttgtcattcaaaaaatactgtctgctaactcagttgtctgtaatgtgaagagagtgatacctgttgcattgtggtttgaaagatgagcatatttaaagcatctggcgcacaggagatgttcagtacaagttagttcttgctttctcttctctctctcccaacacacatagcctatttacccagccaaaatcagaagcagaaaccttggcaataggggtcaggtgatttttgactctggattacagctgtagctttgagggacaacctggatctggagttgaaagtcagttttaagtttaaaataaggagttagagtcaactttcctggttaagagaaacctaaataggaatgctcactgtaagtgcccttttgcttcagcattttgggcagaggatacccaactccatctgagaagtgtctagtttttattgtttggaatctagattgtcactacaaattgagctgtttttgtgtgtgggataggggaggaagaggaaatggagaagggggagatgagcaggaaaggtaattgacatttgttgattacctgctgtatgccagacaaggcagagagtgagagtcagcacatcccagagagatagcaacagaattatatgcatatggaactttttcataaccctagatgcttttacgtatattatttcttttaaccctcacagtgatcccatgaacaggtatatattattacctcattttactgttaagtaaactgaggctcagtgaggttaaataaatgtcctggggtcatataacaggtgagtggcagagatgggattagaactctgtgattccaaaacctgtgttcctgtccttatgccatgctgtctcatgccaattgtgtggcccataattaggtcttgtaattatgtatccttgatgatcgcataactgtggtggtggagtggtggatggatttttagagtttgcttctgaactgagtctgggttatgctatttggaactgtcattgatggtgagatagagatgatggaagaaaacccaaatataccagaaatgggtagtacacctccattgtctatttatattttattctcatcaagatttccaccaaggtgactcacaccactaatcttatcactttggggggccgaggtgggaggattgcttgaggccaagagtttgagacaagcctgggcaacatagcgagattctgtctctacagaatttttttttttttttttttttgagatagcgtttcactcttgtcgcctaggctggagtgcaatggcgccatctcagctcacggcagcctcctgctcccaggttcagctgattctcctgcctcagcctcccgactagctgggattataggcatctgccacctcgcctggctaatttttgtatttttaatagagacagagtttcaccatgttggccaggctggtctcaaactcctgacctcaggtgatctgcccaccatggcatcccaaagtgttgggattacaggcgtgagccactgcacccggcggtcatatggatttctttcagcttattctttacttgcatgctctctttcctggacttctagcttttatttaatgttccgtctaggcatagcagaaaataaataagaaaggaaaagatgatgttcacttgctcagtgctattaggagaagaagtgaaatgaagaaacatttataaagtgctgagcgcagtgcctggcacaaacaccacctttgcaagttcattcctgttattgttcgggatttagacggtgaaaggggcgatgatcttccagggccttgcctttgtgccatctaaaagatctttagccagttcagctaatttacaactagaaatcatttgaacttggctgggcgcggtggctcacgcctgtaatcccagcactttgggaggctgaggcaggcagatcacctgaggtcaggagttcgaaaccagcctgaccaacatggagaaaccctgtctctattaaaaatacaaaattagccgggcatggtggcgcttgcctgtaattccagctactcaggaggccgaggcaggagaatcgcttgaatccgggaggcagaggttgcagtgagccgagatcatgccattgcactccagactgggcaacaagagcaaaactctgcctcaaaaaaataaaaaataaaaaaaattaaaaaaaagcattgaactcctgtttgtgttagcatcgtgagtatgtcctaaaagaagaaatgtgtggctggctttatcaccgcaggcagctgacagaatctggagagagaaggggaacacagacaaaccaggccaaagagctggtttcgacctgtggtcctagagcctggatcagctgccttccaccttggtttgccggaagcctttgtaaggtgtgtcctaagtcagtcatttataatatgactaaaggtctgaaatttgcagctgtacagaatgtctgtcagtttctcccattggctgtactccttctggcctcaggaacttggcacaagctgtttcctttgcctggaacattatttccctgctttttgcctgcttaactcctccattaccttcagatatcagcttagatgccacatcctgcaggaacttttccccaacttgcagctcccactctggattagatgctgctgctcctcctcccataggcccttctgtttcctcagtcattgctccactctcatattactgttttttttttgttttgtttagttttggttttcctttttttactgcactgtaacctccatcaggggaagaacgatgtttgtcttgcttggcattgcttaacttgagcacagtgcctggcacatagtaggtgttcgaaaggaatcctgtattatttatttttagccattttcattgtaaacttgcaccctggaattcgtaggagtcttccatgcttggaaatggcattccattgtatctgtgcccctttgactgcaagattaatgtcagagctccagatactaaatgcagtggagagggagatgaatgaaggctgggtgttcagagaagtctcataaaggtgcttagacataaatggaaccttcaaaaagtggcaaagatataggtaggtgtgcagacaagccttccaggaaaaacaggatgggaagagaggtatagaggcagaaatgctgagggtgtgtttttgagactaagaggagcttgtactgacttgtattaaaagataggtgttggttggtagatgattatgcatcccattgaggttctggagcctcagctagggtgggctcattgaccttttgctagtaaatgtcaactttctcactccttagttttgagatacacgagtcctagctttttgtgactgtagcgtaagaccccaccattgtcacctatgttgagatcttcctggttgtttagagaactaagcattttatgctgacttaaaagagtctggaaattatggtctttttatctttccattcatagctccatcctatattcaatttagcaagtacagttccaaaattgtgggtggtctttacttcccaagtaagtgggataccaggctacccttgacttgggaccgcccctgctggatctatcatttctgcttgtaaatgaatagcttttgagtctgcttgttcccagaatactctcttgtggttttcggtactttctcagttcctctgaggctgatcaactagacacagacaaaactgagattctggaaccatagtcatcccaccagggcccacctaggcccagttccctgaggatgccctgcctgggcagccagtggcctccctctcaggaacgcattttctaaactcgaaagttcatgttttcaggtgacttctttaaattaaaaaaaaaagtttttaaagaggtaataaatacatttaaataccaagaacctaaaataagtacaaaggcatttactgggaagagtctttctttcactctcctccagtcctcttgtccccctccccagagcactagtttttttgttttttcagagaaactctttgtgagtacaagcatgcatgtatcaatgtagatatccacctagaccatgtcaacacaacacaatggtagtgtactgtacacactcttctgcaccttctttttttttcacttagtataatatatcttggagttcatttctcttctgtacataaacctctgttttttttaaggaccacatagtattccattgcttaggaatttaaatgtacatcatgtcccctactgatggacatttaattgtttctttctctttttaattaaaattttatatgctcaaacactgttggagggaggaaagtggaaaagaaattcttctgatcttctctgaatcccccatttagaaagtaccattgttaacactttattcagaaatattctttgcccaaagaacagctctccggttcccatctaatttgttagctagctagtcggttatctaatttatctgtcatccactgttctatctgtcaatcagtctgcttatccttcttatacaaggctgatgcatggtctaccaaattcaataaccagttagagtggatgcccaaccaataagaactgatggcatactgctgggaagtaactgattatatagcttagtgctactcaaagtatggtccatggactgatgccagtgtacagttgaattataactggcctatgaagagctagatagagaagttgagagtatttagaaactttatggcaaaatggcattgctatgacatccaagtaggtgaccaatgcaattatcttgtggaacagggtagtttgggtgtgtcactcttgtgtggtgagtcacatgtggtgtgagctatgtataagccatccaccataggactacatactggtcttgacagattggaaataaaaccccggtccttcaccacagatagtttgagaagcagtaatctgtttatctctcttaacgacctatctaatgtgtctgtcatccatctcttaatcaattcatctatttacttacctatcgttttatttttccatccatccttctagctataatttttgcatcaaccaattaatcatacctttcattaacttaataatcattctaagaggttcagtcttaaaatggaaatctatggcacaaaggttgtatataatctgttttctagtacataatatattttatgtctttgtggcttctacagtaactcattgttttaaaattttgctgtggcacatctcaattctgaacactgtacaaaaatccaatttctgttcttttttgtgactagtctgctggtaagcattgccagtgacagactcaggagtcaaaacatggtgactggagaaaaatacacatgctaggttgtttatttaaaaaaaaaatattcatttgtgatggcttttctgcagatattaaaatactgaatatctttctcctagtttgcacttgcaaagcacttcttagcctaggttttcaaaggggcacctgggcacctatcatagttgaggctgcaactgtgtgtgataacccatcagaaaggagaaaacccaagcaaatggtaaatgtgactataatgaacaaacgtaacttttactgacttcatttattttggggtttgtttttaaaaagctggcttttgttataaaaataatacatactcttaccaaaaagtccaaacagaactgaaagttataaagtgaaaagtaggggctgagcagtggctcatacctgtaatcccagcattttaggaggccaaggcaggtggatcacttgaggtcaggagtttaagagcagcctggggccaggcgtggtggctcacacctgtaatcccagcactttgggaggccgaggcgggcagatcacgaggtcaggagatcaagaccatcctggctaacacggtgaaaccccatctctactaaaaatacaaaaaattagccaggcgtggtggcgggcacctgtagtcccagtgactcgggaggccgaggcaggagaatggcgcgaacctgggaggcagagcttgtagtgagctgagatcgcgccactgcactccagcctgggcgacagatcgagactccgtctcaaaaaaaaaaaaataaataaaataaaagagcagcctggccaacatggtgaaaccccgtatctactaaaaatacaaaaattagttgggcatggtggcgtgtacctgtaatcccagttacctgggaggctgagacacgagaattgcttgaacctgggaggtggaagttggagtgagctgagatcaggccactgcattccaggctgggccacagagcaagactctgtctcaaaaaaataagtaaaaaaagaagtgaacagtaaaagtactgcccacctccctgccaccaccaccctgcaaccccaagacacacactaggtttactcctcagaagtaactactgttcccagttacttgtgttatcttccaaggatttattatgcatatatgtatatatgacttgactgataaaaacagcattagtttgtttttgcattgtgggaagtctctgttactggttgagcctcacataacctcaggaccgggtagagtacagacatggattaaattctggagaactggatgcaatgcctgatgggatgtctcagggtgaaaagccttatcggggtaaccatgatctagagactgggatttgactttttggttcaagaaagtgacgtctctgctggcccaaaactggtcaggttttcgaggactgtctgatgtgagccatactggggagaaacagggatagaaattttcattacagttccagaagcacaggtagtgactggaatattctgccactctggaatgaaggtattcataagagtgatttaattgctgaaaagttgctttagtggtgctggaaaagagaagaagtgagatcattttaatcactgaagggatattagcaggtaaatttgacaggatttggtgatggattggataaaggcagcgagtaaagcaggaggaaaggaagatttgcagattgctggctgtataatgtcagggctggtggcgcctctaattgtagcaagccgtactgggagccttggaagaagtggagaaattatttaacatattgagtttgaagtgactttaagatgcccaagggaggaaaatggggtgtagtggaatgtgtataattattcaaatcctggtgtggttgagatttcttagagaggttacagatagaatgagaagaaacaagaagtactgatggaccctgtaaagagatggagagagaagagaaagagaggtaggaggaaatccagagagtggtgcgtggaagccagggaagaaagtctttcaagaagaaagaatggttagctctgtggtgtgtttctcagaggtcaaggaagataaggactgaaaaatgtccagtgaatgacttttccacgaggacactttctttcccaggataggtcataacagggcctgaggtactaattcttatgataattcagataatttagttttgagagacagaaaaataaggaaaataaagatctcaattagataaggtgtgaatacactcccacatagtcccacaagtttccatataacctatagtgtctctcactttattgccgtataccacacgtttgcttgtttaagcatcctattaaaatggggtccgaaatcagtgttttataactaactgagctaagttataagactcgggtaaaaacatgactctaattgatatgatcattacttgctgtgaggaaaattacagtctgcaatcctagcttggtaaaatcttcgtcacaatttgtagtgcacaggactgttattgctggcacacgtcataactaaattacagccataaaaatagcagattatgtttggagagtatcagtaaaaaatttatggttccaaatattatgtaactgtagtttcagataaatgtttatctttcctatctttgtttctccattcactggaactgattttgatacctggcaaaggggactcagattaatgcaagtaagttcgccaggccagtttgccctttcacaatataaggtaaataaaacatgtttaattatatcaaactggtttgagtttggctgcattttgtagttaaagcttgtattgtagttaaaaggctattctgtattttgctaatttgggagcatttggtggccttgttacagatttgggatttgtaaagacatgtgaatttagtaggcgggattaagaatcataaaagaagcagtaaacttgagtgctgctcataaaattacttaggttttctgcagatgcattctctagtgcaaccgtccccactttttgggtctttgttttaggtattatgtgaaatataaccctatgcatatgcaacttttggcaaataaggatttcttttttttttttttttgagacggagtctcactctgtcgcccaggctggagtgcagtggcccgatctcggctcactgcaagctccgcctcccgggttccggccattctcctgcctcagcctcccgaatagctggtactacaggcgcttgcaaccacgcctggctaattttttgtatttttagtagagacggggtttcaccatgttagccaggatggtctcgatctcctgacctcgtgatccacccgcctcggcctcccaaagtgctgggattacaggcgtgagccaccgtgcccggccggatttctcttacaaaattatatcatccaacttatatttgggtattcgtactttcgtgtgtgtgtgtgtgtgtgtgtgacagagttttgcttgtcgcctaggctggagtgcattgatgcgatctcagttcaccgcaacctctgcctcctgggttcaagcaattctcctgcctcagcctcccagttagctgggattacaggcatgggccaccacgcctggctaattttgtatttttagtagagacggggtttctccctgttgatcaggctggtcttgaactcccaacctcaggtgatctgcctgcctcggcctcccaaagtgctgggattacaggtgtgagccaccacgcccggccacattcgtacattttaacataaaatccaaccataaggctatattgtagaaaagcttgaaggaaagaaggcaggaatggagaaaggatcagctacctaaaagttgagctgtagccaagggtatgtttaaaacatctcttttttacctaggcttttaaaaaagtttagctatcttatctatcatctaagaaaagttaaccttgagttattgatcttgcatgtctgcatttgaagtatgaagatgacaggggctgtgctttgggccttggaaagctgtgttctcaagcaaaggtccaagagctgtaatccgtatggtacacagtggaaacattgttctttgtatttgtctgttgctaactttttaataaactattaagtagttggtgattattaacagtaggagcagaatgtagggtcattatggacaatttggagtgtcaacattaaagaaatgattttaaaggttagatcccaattgttgagactttgcctgaaactttggcaggtaagtagagtgagggatggaccagcacaaccttttgtaattattagccgtagtgaagtgagtcaagttttgccacagtgctttttgtttaacctaacaattggccggccctagttaattgttgaaaaccattaaaggactcaaatttcccagttgcacatgcattggaatgtccagcttacctcatgtgtgtgaataaagggccagtggtgtggctaattaaagtgcattgtcctttaagcaaagcgtcagtaacaaattaagttttaagagttctcgaaaggcccttctgaggactggtaaacatcttggtggctggtacatatcgtatggagtctaggtgtgaaagctgctgaaaacaagcattataaacttccaagtaagtgtggaggtgtaaactgatgccatagagttgcttcagctgaagcgaaagatcatatttactgacacttattacaaatgggtttttaaaacaatgtctgttttgtacagtgacagtaaagtctgccaagagtaaaacaaaaagttatattgtggaacaagataaaaggaccctgcataataaataatatcgaatgccttaaaatatgaggtttcatttccaaaatataaatatgagctcctaaatgaatgtttaaataatttggtttttctttgatttgccagtgacttgatacgtaaaataattttggctctgaatatgtccagatctaggccatcacaataaagaatacatctgtatagtaaatacaaaataaagcaaccacaaatgacatcatgttttagtgatagcttaggaattgttttttttattatgatagaccaaaagtagtttattggctataaataatatatttattatctgccagtttctaagagtagcatgatatctctgatccaaactgtattgattctggtcgggctcggtggctcatgcctgtaataccagcactttgggaggccgaggtgggtggattacttgaggccaggagtttgagaccagcctggccaacatggtgaaaccctgtctctactaaaaatacaaaaattagctgggtgtggtggcacatgcttgttatcccagctactcaggaggctgaggcaggagattcactagaaccagggaggcagaggttgcagtgagccaagattggggcactgcatttcagctttgggggcagagcgaaactctgtttcaaaaaaacaaaaacaaaaccaatctatattggttctaacctttatctatagacaaaagcattggtttatgaaaaccatcagagatgcaagccatagaaactttcaaaaagttctttaagatgcaactgtctggatctgataaatagtttcaattgttttgctcttgatctggatgggttttgagcagaggagattgggtgaaattaaaggtttcttaaaattgttgacactggtagagaggcatttatctgaatacagtggggaagaccagagatgttgcttaaagagattttgtaagaaaagtaggcacaattcttgtgaaaagtgggctacgtgaataagggcaatccaagaaatcatgttagtgcccctgtgtagttgtatgacttctgtactttttctttctttctttctttctttctttcttttttttttttttttttttgagacggagtctcgctgtgtagcccaggctggagtgcagtggcacaatctcggctcactgcaagctccacctcccaggttcacaacgttctcttgcctcagcctcccaagtagctgggactacaagtgcccaccaccacgcctgggtatttttttgtattttttagtagagatgggatttcaccgtgttagccaggatggtctcgatctcctgacctcgtgatccacccacctcggcctcccaaagtgctgggattacaggcgtgagccactgcacccagccaacttctgtactttttcaaaggtgaacttttggggaggtgatttcttgagaagtggggaagataatgggataagttgtaaaagtgcccagaaatatgagtttataagagaccttgagagctacatactaatgtagctgtccattagtatgaaagaagaccagacatgttgtccaagctgtctataggaaaatagaagaggtaactttaggttgtcgtggctcacacttataatcccagaactttgggaggctgaggcaggagaatggcttgaggccaggagtttgagaccggcctgagcaacagagcaagaccccatctctataaaaaagttttaaaaattaacagaatgtggtggtgcacactgctatagtcccagctacttgggaggctgaggcaagggggatcacttcagcctatgaattcagggttgcagtgaactatgattgcaccaccgtactctggcctgggcaacagaaagagaccctgtatatatatatttttttccaagataattttagtcttagtctactctgaataacaaagaagaatgatttattcatttagaggcattttaagagcagtctttgtagaccattgctagatctttttggaatgggctgccttgaaagcagagagaatgtaaccatgtgtctttaagtggcattgtttagtggttcttcacggcagcccaaagagaaagtatctggcatcagatttgctggatgtgcagagatgccagtatctctcgtttgagctagcctctgcggtgtttttgctctcaaacctggtggtagagtgacggctttgatttgcttcctgcctgaagcctgctttggatgaatttaaaaacctgtttgtttccccatcggccggctgagccttacccataattcctgaactttgattatgggggttattacaggacaagagcttctttgtaaaagagcatgtttaatactctggggtctagcgtgactagcggatataaattgtatggaagcaattaaatgcgaaggaaatgtcatgtgggctgaatttaaacataacttgcggcattgattttttttttttaacttacactaagaaggatggagagagaaaaaagaaagagaatggaaacaggccaagcgagtcagagaagcacacgcagagacaagagaaaaggagtcatttttaacatttggttaaaagtccaaagcccagagctagcattatgtgaattatactagtattatgccattgccctttaaatgaactctttaaaaacacaaatgtcagggaagtatactgtacttggggcttgtatctctttccagttgctcctctttatcttaaggcatatatgtacatacagcagtgattttttttggaatatgttaataaacaggcctgaaggaagctccgtaaacgattaaagtgcttctttccctagttttctctccttttatgctcacggccactgcatgcctcttttcttttcttttctttctttttttgacaaagtttcgctcttgttgcccaggctggagtgcaatggtgcaatcttggcttcctgcaacctctgcctcctgggttcaagtcattctcctgcctcagcctcccaagtagctgtgattacaggcatacagcaccacgcctggctaatttttttgtatttagtagagacggggtttcaccatattggtcaggctggtcttgaactcctgacctcaggtgatccaccacctcagcctcccaaagtgctgggattacaggcgtgagccaccgtgcctggttgccactgcatatgtcatacagagtagctcatctttgcacttttgattaggagtagtgtgtcatttctcacttgcctagaatgtcctacatccctatgcttggtctattaagacttagccagccccatctcctgtctaatgccttattacaccaaccaactagaagggatctcctcctactccagatccccatagtaatttgatctattggggtaatttgccacttaatcttttctactgtccatcagagtgtcgtgtaaggtttgtttgtaaatgaatgggtttatttcatttctccaacttgccaattcttagaatatggaactggtgttgtattgtccttcatgcctagcacatattggtactagggaatatttattgagattaatgttaatactgaatatgggccgggcacggtggctcatgctgataatcccagcactttgggaggccgaggtgggtggattacctgaggttaggagttcaagaccagcctggccaacatggtgaaaccccgtctctactaaaaatacaaaaaaaaaattagctgggcatggtggcacacccctgtaatcccagctactggggaggctgaggcaggagaattgcttcagcctgggaggtagaggttgcagtgagtcgagatcatgccactgcactccagcctggccaacagagcgagactctgtctcaaaaaaaaaaaaacatactcaatatgctgttaaaataatcaaaatgtgactgggtggtcacaggcagaaattgatgcttttagattagatgtaataatatagcaagtttgatgtgaaattgagtttagaaataatagacaacctttgattatttgctgtgatagagagtacttgtcctttatttttattctatatgctatgaactcatagtgacaagaaccaaatcttacctgccttgcataatacttctctcttttttttttttttttttttttttcacttgagacagtcttgctctgtcgcccaggctggagtgcagtggcatgatcccagctcactgcaacctctgccccctgggttcaagtgattctgcctcagcctcccgagtagctggggttacaggcacctgccaccacacccagctaattttttgtgcataatacttctctaatgcctggcccaaagcatggcatgcatagtagggattcatttaacttttgctgaaagaaatataaatgatttttttcttttaaatttctacattatttagattttctggtgactctttcctatgcaataagccaatacatatttatggagcacatactgtgtgccacatactggtactgtgcttagcataaaggatacatataatgtatattttactttagaatatattctattctttgtatttaattcttagcccgactataaattctaaaaaatcagtttttcaagcaaaaacaatgaagatccaagaaaggaaaatttcctggtattaattcaatatattcatctattcccagattatttccacattccacttgatggtggaaatttactaccccctccttgcctttcaaatgatcctaagatcgtaacctttcccaatggagctgaagaggtagagtaggctgtttgggtttcaaaggacttttcaggacacaaagtaaataggggaattggagatatcaacaaaactaattaagtggattgactgtgtcagtagtgagtacagagatgtcagaaaagctagttgtagcaagtatttaaacacagcctcaagttcattttcagtggtgttgccatcatccacaaacttcaaagaaagtttagccagattaatccaggaaaattcattctcctgggaacatcacattctaaattacttattcattgttaatatcttcatttaaaattttgacttgaacttttttattctttacttgtcctttaagatcacacagacccaagatttgataaggttatcatcttttcagatctcagaaaagtgggaaaatgaattcccttttgaccagaataaagggaagaagaatttaaaattataaaccaggtttactttactcatagatggtcatatattcaacattgccttttttttattttaaaaaactgcccaagtcataaataaatgcattcttgctttaagaaattcagctaaagcaatagactttcttgaccctctatccccaatcctgctcatctccccagaaggagagcccatttctcagttcagggactgtccttcagacttatgcatgtagaaaccaatgattcaagtttttcttcttctccttcttccttcttcctcctttctccttcctcctcctccctcttccgcttcctcttctcctcctactcttcctcttcgtcctccttcctcttcttcttctccttctctttctccttctccttctccttctcctccttcttcttcttcttctccttctatatattgtaccttaacttcgtttttacccaccactttaaagtattttgttctatgacagcagctagagatcttaatacgttactccatttcatggctatacacagtttatttacccgttttcctagtaatgggactgtaatgttacttaaacctcatctcaaagacctaatataaattaaattctagcttcatttgaatctttcatcactttgaagggagatttttagtaattatcaaaagatatgagatcaaacaagtccaattactaaaaatacaatgcatttgtatgataatttaaacttcttttaaatatggagacccagagcactgtatccccagcactcctgtgagctagccaggagaagaggaacattgtcacaaccacatgaagaagagggtagagcagggcccccttctgctgatttctgattatacagggctctttggtcaagatcacagaatgtgtttctccctcccatgcaagaaaggcagggattcctcctctcctctttagtcttccatccctgctcagagctttttggctagcattgtcaattcaaggtttggcctcagagtctttgatttaagttgtgaggggacagacatggtgaggatataccgtggccgggtctggagggtgagctactgagaatcagggcagggaagaggctcagtggttgctggtgctgaggtagtgtctggaaagcacatccgtgtgaaagggcgaatgccagctgagcatggccttgggtcactggctgccttgcaaacaggagctccacaggagaggtggacttgcacaacagcagcctgacagatccagggtctttcacttgcttctttgggatcctcaccaagcatgtcattcaaccatttattgtgcatggaccttggtagggaataggcattgctctgttttctgatttatttctccttgaaagcccattctcaagggcagggaacatgttttattcttcccagaaccttaggataaataaacgggaaaaaatgagtgaaaaaggaaactttggtgggagataatgaggcttttccttactgctcttatctttagaagctgggtcacagacatcttaatatgcatttacgtgtatttatttaacaaacgtgtacctagcacttactttgtgccaggcattgttctcacactgttcacatttaattatgccaagaactctgacagaaacactatttttatccccactttgctcagaaaactgatgtacagggcatttaaggaacttgaccaaagccgcacactagtaaggacttaaacttgggcagtctgggcccagagccaccctggctctccttttccctctcaccggtcttgacatggttgggtcttcattatttttccctttctggacctctcatctttccttcctctttctccattcctgttgcctccaccctactgtgtgatgtgatcatttatttgtagactgcagcacactagcctctgacttcagtcctttgcacaccacagccaggctaatcttccttcatgatggctctcatcacccttttcctgctacagaactcttcttggtgtcctgtcctgtcagggctgatctcctgcctggttcctaaacctctagaatctgacagtgtgaccctgctcatcgagcctcacttcccttgcaacccatttgctgccacccacagctcctggcagtgcttgtaccccttccctggagcaccctcactcacctcttccctgaccctccatcagttcattctgccatggatttccttctaggtctcacctcctgcctgactacacagctcttagtgtccgctccacccctgaacccagtctacaggctgttggatttcattgttcctggcttcaaaaagcctgattaggtttaaactctttgggggtctaccattatacctagcactgagctgggtcccaaaggacattgttgagtactgggattagtaggtaggacgcttgcctaatattggactttttacttggtttcctcacccttaaatgaagaacttaaaggagataatggccaagtttccttttaatttgcttaaccaattacacttgcatatatattttattttttagagacaagttctcacttgtcacccagagtgtaatgcattggcacaatcatagctcactataacctcaaactcgtgggctcaagagatcctcccacctcagcctcctaagtagctaggactacaggtgtgcgtcaccatgcctggctggcttattttatttttgtagcgatggggtcttcctatgttgcccaggctgtccttgaactcttggcctcaagccatggtcccacctcagcctcccaaagtgctgggattacagacgtgagccactgtgcctggccatacttattttttaacagcttcattgatatataatttacacagcacataattcactcattttaagtgtgtaattcaatagtttttaatagattcaggtatgtacaaccatcatcacagtcaggtttagaacattttcatcaccaaaaagagaagccccaactaactagatagctattagccatgcccctctcctccacattctcatcttcaccagtcttaagaaattactaatccactttatgtctctgtagctttgtttattctggaaattgtatgtaaattgaatcatatgatatgtagtcttttatgagtggcttattgcacttggcataatgttttcaaggctcctctatgttgtagcatacatcagaacttcatcctttttatggcttaatagtattgcattgtatggatataccacattttgtttatccattcatttgttggtggacttttgggttgtctccacctttttgaaaattacatccatttttgagtggaaaatgatcttcctttagtggcttctacagttgccaacagcagtttccctctactgctttaaaggtagggatctgggcttaatggctttgtttgcgttgtgtggatggacaggttggatgcttggtcatcaatgtcagagagcagtcatagagagtactcatgagctttgtaatcagacgtactggtttgaatcatggatctgccacataatgagcttacataacttcaggaagcacgtttcctcgttggtaaagtgggaactaccttgcctgtttccttagagtcagagctatgctagaaactacgtggccttggggcaactcaaccaatgcagagggacctcaaggctataaaaataaataagtaaataaattttaaaaagtaaaaattattttttaaaaagtactctcacgcccgtaatcccagtactttgcgaggctgaatccaggcagatcgcttgaacccaggagtttgagaccaacctgggcaacatagtgagactctgtctctacaaaacatgcaaaaaattagctgtggatagtggtgggcgcctgtagtcccagctactcaggggagctaaggtgggaggatcacttgagcctgggaagttgaggctgcagtgagccgctgtactccagcttgggtgacagagtgagatcctgtctctaaatgaataaataaataaagtgcttaaagttctcaattttattaaggtatcatgcctcacagctcttccctaccaagcatggagcccaggatcaccaccctagttgcagtacccagagtggacctacttaattttgttgggataattcatgtctcccttcgtgtgtgttaatggcctctcttgatcttggatctggatttgtgctccagtcactaccccatcaggtcatttgacaagaatggctatagggagtgaaatgtttttccctctctgagaagatacagcgggagtgtaatttcattctttgtgggataggcaaggaggatgcattgctgttttttggtaagctttacctgaaagtagttatgccagagggtaggtggtgattctgagcttgcttatggttattgaatatccattggcacttatatttggggtttgtacgtgaagactgaaaatgccttttttagtaactggctgaaggagagatgaaatgttaatttgatccaaactttgcttggagagtggtgtttcagaactgattttgctaatgtcattaagaatcaaggaacccgacaattttggattttaggcaaggcctctctctacacccagagtaacaacttaaaaaaattattttaaagtaaggaggttttagaaacataaactcttataatagtggatcttttgagagaatggaaagtaagtcattttcctcatctaaacttagcttctgcccccatgatattggtaggaggtcgagaaatttgactgtgagaattatgtgaatctttattcctcttcctctattctgaccccaggtgagtggggacagctcttgcctggcatttctcccactggcttgacccattaatggcaactgtgaaaaggtcaacatttccaggctgacatactgaccacattttgtgtgggagatctcaacaaaagaatatttgtttctgggaggctgacatccccttttgtccattaagcctgtcctttccatcattagattgtgaaccttgtcagaattaagtagagcttaaaaacaaggaaggaatgagtaaaggaaatttagtttgctacatctaaatgcaaattgtgcaaaaacagatgggtgaggtaagaatggacgtcattcctggcgtgactgcaggtactcttggtctacaccatgatcctggaaaaggaggatttaatcatctgagttattaaccgttctcattaccttaggcattgtgactctgcttcctattgatcctagagctaaggtgccccgatttatatgcaaactcttgtttacctgcccaataagtgcaaaagggcttaagcaggtgactggggcctcacatgaagtgacaagactatttctgcctagaaggtacgggagctgagcgggactgagctggtctgcaggaaaggcaagaagaaattctgattatctgtcccaaatagagccatatcctgtctatgaggtggccagctaggagagtggaaacagtttagatctttgtctttggctactggtccgagagaagttgctgttcttcttttatccttggtagaaaaccttttcttcatccctacctattcattgctagagctggaggccaaagcaaaatgacagactgtaattttatatgagttattttgggactaacactcttataattatggttcacttaaatattataatattacttattgcaaaagcaatttatagggaattggaatttttttacagaagaaaaaaacgcaccgaagattttattattctaatatccttgaagttagcccggtgtggtggctcacacctgtaatcccagcactttgggaagctggggcacgaggattgcttgagcccaggagtttgagaccactctgggcaacatagtgagaactcatctgtacaaaaaatgaaaaagttagctaggcacagggtgtgtgtctgtagtcccagctaccggggaggctgaggtgggaggatcgcttgagtcatggaagtcgaggttgcagtgagccatgattgctccactgcactccagcctgggtgacagagcatgaccctgtctcagtaataatacccttcaagtttttccctatatgtttgcatatatggttttcatattgttatacactttcatgatcagatactccatagtagatgggttggctgatatgaaaggattttttgttttgttttattcctttaatatgtgtcatcaacagtttaaaacttacagggatttttaatactcatttagtgccagttgtctttgaaacaatatttttatcaaagattgttgtgacagagaagaatatcttcatggttttgttttggtcttcacttgggtaacaagttactggtatttggagaacaggagagactattttcctcagatttcgaaatggcaaagcataggagtgaggttggagaaaccacagggtctagcgggaaagtcttttacaggccacactcaagtcctggttggggttagcttcgcttagcagattccccagcgtaggaaatactgacctagttcttagataatctctgaggagtttctctgtaagggtatataagtatcctaaatgaataggtggaaaatacaatataagtacttttgtgagcctgagggactcttctgtaagatcaaagacaaatattttagtttgactgagaaaggagtgaaactttttaaataaacaacagtatttattttaatagggagtctgaggtctttccagtaggagttgggaaataactttttttcctcttaaactcatgctgcacaattaaagaaaaatgttttttctctgaacctttccttcaaatacttggcagagattactgccagaagaatgagatgggcacagtggctgatgcctggtaatcccatcactttgggaggacacgatggtaagattgcttgagcccaggagttcgagactagcctgggcagcatagggagacccatctctacaatttttttttttaaagccaggcagggtggtatgtgtctgtggtcccagctactcaggaggctgaggtgggaagatcacatgagcctgggaggtcgaggctgtagtgagctgttatcatgccactgtactctatctagcctgggcaacagaggctagagcaactctgtctcaaaaataaaataaaataaaataaaataaaataaaataaaataaaaaaaataaaaagaatcatttgtgagacttgagagacttgtaccattggattagaatctttcttggtactaaagtctgaaagagctggacttgagctaggttaaccatccattttccctaaccttcaaaagctcacctagtctatcctgcggacaaggatatatgtgctccacgataccgaaaaagatactgctggggcaagaattagcctgtcatacaaagcaataaacaataccaagagccaaaatttgacttcagtggcagctgtttcctagagcagtatttgtttgagtttccttgttgcaaagcatgcagctcacaaagtgccccaaactggcttaataagttttgtttgtttgtttatttgttttgagacggagtctcgctctgttgcccaggctggagtgcagtggcgtgatctcggccaccgcaagctctgcctcccgggtccacaccattctcctgcctcagcctcccgagtagctgggactacaggcgcccgccaccacgcccagctaattttttgtatttttaatagggacggggtttcaccgtgttagccaagatggtctcgattgcctgacctagtggtatgcccacctcgacctcccaaagtgttgggattacaggcgtgagccacctcgcctggctttttttttttttttcgagacggagtttcgctcttgttgcccaggctacagcgcaatggcgccatctcggctcaccgcaacccccacctcccaggttcaagcgatttttctgcctcagcctcccgagtagctgggattacagacatgtgctaccatggctggctaattttgcttttttagtagagacggggtttctccatgttgatcaggctagtcgcgagctcccgacctctggtgatctgccccttctcggcctcccaaagtgctgggattacaggcgtgagccaccgcgcccggccaataagtttttaatgtcttcagaattttttagaaagcgtcaactttctttaaaaataataggaccctctcaggctacaaatataaggagaagggaaggagacccaccctggagagttttggaggtgaaccccgctgtgatttcatggacaacatggatatctctgtttggtttaatacaaactttgaccagcttgatttgggggcctcctgtagccatagcacacactcttcagttatcaccacctattcctttcttcctggcttctctggcatttccagggggtgcaggaaagggctggtttaaggcagctggcataccttcctttctctcaggcttcctcactcctaggactgtataccatagtttcttcccatcaaaatttcgtgttcctctgctcattgcatttcattgttcagcataaattcagggttgattaccccacatgacaccctacatggctgaaaatggggtggatgtttcccaaaggaaattaggattgtggtcaggagagaaggggaatagatcatgggtttaccttaacaatatgtttaccctaagaagggttgttggataaaatacaggtattcagttaaatttgaatttcaaataaacaataggtaaatttttagttttaagtatatcccagatattgcatgggacgtatttgtactaaacaaattatttattatttatctggaattcatatttagctgggcatcttgcatttttatttgctaaatctgatgaccctaggtccctaagaaacttctcatgtctcattttatgttttttgttagcttacctggcctaagatttctttgctttggagaggtgctggggagtggcacggtgggcaggatattacacttgtgtgaattaagagagggcagggcataaataaagtattggccaagcagctgcttggtggcctcaggacggagtaggtgttcaacaacctgtgcgctgtgtgccaaggttgggcaacaccttgtttttgatactattcttagatgcacctttatgctgtgtgtatttcatcaccccatgtgcctacacattcaatatgggtggttttccaattgatgctcttttgtagtcctcgtgggaagatacctctggtatcttcccttggagtatggaaaaaaaggagtagaattttacctctaaccaaaaacgctcagcctgctttgggattttcaatgctaattactttagtaaagtaaaaattatttttctatactgaacatcacatcagttctggccattttttttttttttacatactatagaatatgtatatacttgaatgcaaacattctctttaaattctagctcaaacaagatattattagcttggttttatatattgactgatttcaactggatggattttaagggaggaaaacccataggaaatatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaagaatggtttatgagtgtcaccttaatccatgagctcaactgggtgtcagacgtctaggaagggagggacttggtaggtacttaaatggtaaactcagggtgctgcatggaggtgattaaggaggtggcatttggtttgagtcagggcttttagtgctatgcatagaacaacttgtttccttttgagaatataattgtttgcatgtgatgctaatttccgctttttttttttttatttggaatctcgctgtgtcgcccaggctggagtacagtggtgcagtctcagttcactgcaacctctgcctcgtgggttcaagtgattctcctgcctcagccttccaagtagctgggattacaggcatgtgccaccatgcccagctagtttttgtatttttagtagagatggggtttcaccatgttagccaggctgttcttgaactcctgaccttggatgattcacccaccttggccttccaaagtgctgggattacaggcatgagccaccataccatgctcagcccctaatttttgctttattaaaacaaaaacaaaatttgagtcactataattctgtcacagaaggcagggatgaaaaagggtagagttggccgggcgcagtggctcaagcctgtaatcccagcattttgggaggcttaggcgggtggatcacgaggtcaggagatcgagaccatcctggctaacatgatgaaacccaagctctactaaaaatacaaaaaattagccgggcgtggtgggcgcctatagtcccagctacttgggaggctgaggcaggagaatggcatgaacccgggaggcagagcttgcagtgagctgagatcgcaccactgcactccagcctgggcaacagagcgagactccgtcacaaaaaaaaccaaaaaaaccaaaaaaaaaaaaaaaaaaaagggtagagttgtctatttcactaacaaccaacttttcctgaaaaaggactttctgtaaagattaagaatggtacgggcatggtggctcacacatataatcccagcgctttgggaggctgaggtgtgtggatcacttgaggtcaggagtttgagaccagcctggccaacatggtgaaaccccacctctactaaaaataaaaaaataaataaataaaataaaataaataaaatgaattagctgggcatggtggcacatgcctgtaatgccagctacttgggaggctgaggcaggagaattgcttgaacctgggaggtggagattgtggtgagccgaggtcacgccactgcactccagcctgggtgacagagtcaaactccatctaaaaaaaaaggttaaaaatgattatgatttctttttctaagtttattaagaaacagtacgtatcagttcattccccttagcagaagcaatgttattttagaaggatgcagcaaacttgatcttatatagtcccaagtgtggctcccatctccaaggtggtagccagcctggacagcttgaagaacagagactgggctgtttggccatgaatgcagcacagaatatagattcctgtctctggcttgtgtgatggagggtggactagtcaggactgttccagctgaagatgacagaggtctagctcacactagctggtgcatgaaccaagtgaggccaaggttggctccagatccagggacttcattagtatcatttagacttctcatctctctgcctcttggccatattgccttctccattggcaggaatatggcctcaggaaggttgggcatccacatcccaaacgagcagcctctaaagggacaagagggcttccctctacccgccctcacccgcccacttcaatgtatgccagtatctgttcatttgacctcctgtgagctcagcagagaagggtactggattgttcatcattcaggaatcacagagttagaatggagaaagatttagttcctcaatggaagtggtcatggtagtggtggggagggatgtggccggacgaagggaagtgattctgggcagacgataaccacatactttctccacagagagtgatgcaagccacatgggagatagggaccctagccttaaccctgtagcctggctggagagctaagcatatatgcaagagagcacaacattgccaaaactacatgaaggtaacgaggagatgcagaattaagtgcagccatgaagcatggcccttcagaaaggactgtgaggttctggcattgtatataaattcccatttgccataaatagtagccctctagtttgcttatcaggattgtatcttctctacacggtcacatagtggatgattagccctgaaagcaattacataatttccacttatacagatttacatttacccatagaaagtatttctctcctattcaaataaggatgtcagaatgcaagttcgtagaagtgatgtcattcaatggacaaaaaatggattaattcatcagaaagaaagacaacatatattgcaaacttaaatgatgtgggatgcctttcacagctaatggcatcatagcatggcctttgggactgcccagaattccattttatagctgtaccctactttgttcatctagcccctcttactgagcatttaggttctttcccattttcacactttaaatggccatatgataaacattcttttttttgagatgtagttttgctcttgttgcccaggctggagtgcagtggcacaatctcggctcactgcaacctccacttcccaggttcaagtgattctcctgcctcagcctcctgagtagctgggattacaggcgtgcaccacaacactcaaataattttgtatttttttggtagagacagggtttcaccatgttggtcaggctggtctcaaactcttgacctcaagtgatccacccacctcggcctcccaaagtgctgggattacaggcataagccaccgtgcccagctgataaacattctcaaagatttttaagatgcatcctgagtgcttcattagaatttgttcttagcaatggaattactgaatccaaggctattattgccataaatttcgatggggatagtaaggaaagaataatgataaactcagacccactttagtgggttactgaatcgagcacattattattattattttgagacaaggtctcactctgtcacccagactggagcgcagtggtgtgatgtgagcttactgcagcctctgcctctcgggctcaagtgatccttctccctcagcctcccgagtagctgggactacaggcatgcaccactgtgcctggctgattttctgtatttttggtggagatagttttggtttggttttggttttggtttggtttggttttggttttcgccatgttgtccaggctggtcttgaactcctgagctcaagagatctgcccagctcagcctctcaaaatgttgggattacaggcgtgagccactgcgcctggacgcacgctcacttgcttgctttctttttctttctttctttctttctttctttctttctttctttcttccttccttccttccttccttccttccttccttccttccttccttccttcctttctttctttctgggaaaatatggtttggttgtaagtacaaaaagataattatcattgttatatgttatttgtattatattattggtataaatttaatgtctctaataaattactttgacaattggtcattcatattttcatggtttttgaaaacaaagtgtatctttcaaataacaacaacttgatagaaaagatcattgcacctgggagaataataacaacatcccaaatttgctttaaggttatacctgaaatgtcattgtcagagaaacaactcataagtctgggttaaaacaagcctcttgctgattttgaggtgatcaaatttatcataataaaaaaatagttattaccaatcatgtcataagactggggggcatgcagtgagcagaagcagataggttgtgcaggaggagggtgtgggatatggattcataatctctaccaaaatattttttagataaaggtgagtgagtgagagttgaaataaagataaggaaagttcaatgattgattaaggcattttgactctttgggtcccagagcagacatccttatggtggcaaagaaaaaccacgtaactaattcggaaattgtgccaacaacatgttgaaacagtagtagagaaattcaaagtttaatgttaggtcactggtccatcgtccatgtacaactttgagaacacctgtaatgcattacatcagacattaaaacatatgtagttatttaaaaactgatctgtaatataactgggcatagaccatattagtatgatttctgtcttctgagtgaatgttttatttggacttcttcctctctttagatttttgctcttcctgtattttttctttctatcatctttagcaaaagattgctagtgaaaggagttgcacctggttaccttgattaacacatcaagagctctggaaaatctggttgctggtctccaaatagtcctgaccatgggaatatacaacaagctactgtggtgcagcggtctcttgctctcggggccttatttattacagcacttgctgctagcattagtcacttctgtttgggcactgtggttttctgcttccttccaataacattacttgagttaaaaaaaaaattacagaaatgtagtttcacaaagacttctgtgattagaattactgtctggaatttttaaaagcagacagcaaagaagcaaatttaagaaacttgaaaagtttaaaaacaaggactgtttctttataagggaggcctaaaaactgttgggttcatattttttgcccttttaaatgccatatttagtatacttcaaaacagtttaagcaaagcaaaagctgaggtagaaaaagcatgttattctgtgacattttcaggaccctaaagtaagaacggcagcacatttgttttcaggaacctgtggttcattcagcaaaattaattccaatacagaattgttcctatcaagggtgacatggattcttttatgatgctccagatttctggtagtttgtttgcattctctccacttgtgtcattctgagaaaagagaatagtcataggacactacagttgaaaagcttgagattcttgtgtaaaggctgatgtgtgtggtctcctagctctgcatcctagaggtgtggtttattcccccatgtggggcagatgcaattgtaactttttgcaatggaaatgctgttagtttccagacagatgggatgtgagctggaacttgaggacctagatagataaataggacctagataaaaatgatctaggcatttgtgttggctgctataaaaacatcctctgtcatgtggagtagataagatactctatgttgttttaaagaagtcttttacaaagaagatgagtgtgtgtgtgtgggggggagcggtggaggaggggtgcagaagaacatatgagatccagctccccagaggatcttccttaaggcacttggaactaagtttgaaggcactgcccacaaattctctccttcatcaagacttgtcaatccagctaagctctgtggtcacacctactgtcatcttagaagatgaattctgtggttgcctcaatttaatggctgaccaaagaggttccaaaaagatccagttagatcctcaggtctcatatcatggaggttggggtgtccatgacctctgtttatgctctgtgtgccacgcttccctttatgggttctttatctaaaaaataaagaaactgagttgtctgaaaccctctttggaggaggcaatctggtgtagtggttaagaatatggattctgtagtcagaatgtttgggttttgcaacatctctaaactgagatgatacgaaaacacctacccaacaaagctgtttctaggatttaagaaagcgtttttctataagagtgctataagatggagcccaggaccaaaatacatcaaagcgtgtagatgttaaatggagctaagtcccaaattgggtgactaaaggaaggtgtaatgatggaatcctgggtgcttctaatggaccaccaatttggaaaacaaaatttagaaatcgatctgtgagatcctgagagaacgagaccattgatataatatgatctccagtttcagcctgtgcgaggattaaccagcaacccaagaaggcaatattactggggccaccacatttttgggcaagaaaggtaaactgtgtcccttggcagtcagttcaagcctaaacctaaagtagtaggcttgaacaaaattacctttgttgtgctctaataaaaataaacagagtgtggagattgaagaaatcatcaaccagtgctatatacctgtttgtttgtttgtttttggtgacaggatcttactctgtcacccaggctggaatacagtggtgtgatcatagcttactgtaacctggaactcctaggctcaagtgatactcccgcctcagcctcctgagtagctgggactgcaggagcatgccactatgcctggctaatttttaaattcttttggtagagataggatttcactatgttgcccaggctggtcttgaactcctggcctcaagcaatcctctcaccttggcgtctcaaagtgttgtgattacaggtgtgagtcactaatctggcctggttccttttttaataatactactgacaaacactgcctcgtagaaactcctgtcagcgtgaagagttggaaggggaggggaacagtgctatttttcttcttcaagaagtttcagggggctcctcataggattgccttcaggagtgtccatactccctgcctctctggctgtttcttatcagctaaatggtacaacctccaagaggtgtgactgatggtgaatttcatctctttctgaaaggtgccatgaaaacatgcaaggctattcctctctgccattgtttctgtctgtctctcagcaggataaggtcatgacagaatggcacgtttatcttggatttccttgtttggcaagcagcctggatatctctgggttgaacgtctctgggtatctcacagacgtcaatgggttgaaggagatgttggctcttgcactgattctttcagaagcccaggaggtggtggggaggggggaggagaagaggggacaggattgtacttgtcgtgtcactgccctctcagttggagcttcctttacctttccaggctcctacagcgtggagaggcagcctagtataatgcaaggcacagagactttatgtctaaatagagctgtgttcaagtctcgactctgcctattttaaggtttttctcctatatactcctcaaaacccctgtacttattcttcgatgatattttttcacatctgacattacatctttctctctctctttttctgcatttgtctgtaagctttagatatgtggggaccacatctttttcatagctattagattgttaaacagtttctggagcttggcttactgagcttcaaacgctggctgtgtgacattgggtaagctctctagcctcttgcctgccttgggtggtgttgtcaggattagagataaatacatgttgtatcgctggcaccaagaccagcacagatggatgctcgagagatgttgttctccttacctcaagcttggtaccagcgcctcagtgtctgctgaccccaccagcatgcccggatgtatctgttggctgcaagacattgtagacccaggcttgtagccagcctgggcaggcagcttgttggctcaaggagtccttcgtactgttcttcagtccttcgaatgtcttattctcagacgctcttctgagaggacatgcctgcaaagagcacaggctttatctttggaatctcttgtttcagtccatccctaagaaattgacagtagcctttaaaaagtaacccttaaaagttatttcaaaagtaattatagttctttgttaattaagggggaaaaatctcccatagtctatcatttgtatatctactgtttgctttggtatacatccttccagatttttctatgtgcatgtactataataacgttgttttcttttagccaatggtggaatattctgcattttatttttgtatccataggagggatttttcagagtccatgaataatattggactctgaatattggtatgatttatggaactttattttattttactttattttgagacagagttttgctctgtttcccaggctggggtgcagtgatgcaatccctgctcactgttaacctccacctcccgggttcaagtgattctcctgcctcagcctcccaagtagctgggactacaggcatgtaccaccatgcccagctaattttcatatttttagtgaagacaggatttcaccatgttggccagactggtctcgaacttgtgacctcaggtaatccccctgccttggcatcccaaagtgctgggattataggcatgagccactgcgcctggcctgatttatggaattttaaaaggttccaaatcctttgttagaatgaggccagttagaaataatgaaaagtggctaatccgtggaaagccataagcctctagtggttttgaacttgaagaagcacagcaaagcacacacactgtgtgtgcattgacttatccacatgctactacataagcctggagagagatggggacagaaggaaagagaagacggattgcacactgctccaatccaattgccctggagtgagagtgagatgagatgaaagttcgtttttccttctgctcatcatggtccccaggagaccctcaaattgtgaccaccttgtcatggcacaaggtggctcctaaatggaaaccagctatcttctcagctatctgttccaaagcgggaggtaaaactgggtgtgctggttttaattaagagatagcatgtctaaaaatggcacataaacttaatatgcagttaggagattttcagggacattttttttctacattagtttcgcattttcttggtgactttagaaactaacccccttattagactctctggcctatgcacataaagcaacatttactccctccctccctccttcttactttttcttccactttaagcttctagtttgtgctgggactgcgggatgtagtaatgaataagtacatggcctttgtcctaaataacttaggttcagttttagaaagaaatctgaaaatgacttctcataatacctggcagaatgaaagaaatttattaaaagagaggacagcaggccaggtgcaatggctcatgcctgtaatcccagcactttgggaggctgaggcgggcagatcacctgaggttgggagttggagaccagcctgaccaacatggagaaaccttgtctctactaaaaatacaaaattagccaggtgtggtggcacgtccctgtaatcccagctactcaggaggctgaggcaggagaattgcttgaacctgggaggcagaggttgcggtgagccgagatcatgccattgcactccagcctgggcaacaagagtgaaactccacctcggaaaaaaaaaaaaagagagagagagagaggacagccattttattaggaaagtacagaggaagaaatacgtagttctagccaggggatttcattacatgggattacagagaagggtgttccctgaactgaatttttaaagatagggtcaaattttcataggcagaaagaaagggtgggaagcggacattctcaattaaggggaaaaatgagatcttatggaagctttaaagcctgagacatttgagggaacagaatttgagaattgagtctgcgatgagacaggaaaagcccacaggcagtaaaaaatgccggtggctgagtgcagtgtagcttccactgaactctgtggatgtttatgcttatttgaaccttgttggaatattcctggtttgttttatgaagggatgtctctcactgaggatattgactcagggacgtttcctctttcagtcaggatggcctccatcagaccaatattgttctcaggccatttttttgttttgttatcttggataaacagagagaggctgattcatttttctagaaaaacaggatgcactaaaatactgcaagtgacaatgaaacagacatgctcacgtacaataatatttataaagggaccaaacaatatatgtagcagacacctctgtggtgtggccgctacccctcctccatctcacttgccttgagtccttggccaagtgggttgtttctttcgatctgtttcctcagatatcaaatgagaccaataataccaactgaacaggcatgtctcaaggaattgatgagtatcaagtgctagaaatagtgctgggcacgtagtaagtagccattccaatagagcttaattatttgtgcactgggtacgaaatactgattcgtaattggagcaatatatattcacaatgatttttttaaaactttgtattatggaaatattcaaatatccataagagaacagtatgataatttcccacgtacctaccatccctccacttcagcaatcgtccacattctgccattcttattcattgatccccttcctcttttagaaatgttttaaatttgtaatggttaactgctacctaaattattttaaagcaaattctggagagcatataattttgtgtatagagagtttttaagagtctgataaatcagtgaccaaagaagaaatccttataaaaaaatggttgaaaccagtgttttgaatgcaattttcagagctgaattataggtatttctgcaaccaaattaggacatgtctgcaaatctttaagagtggcattttgaaagttcagtattgtttatttcatttaaggagcatgccacatgctggtctgcacatagattagcacttaggtgcatatgcaaaacacttttttctaatggaagatttaaaacatacctcaatactagtagactagtataatgtacccccctgtaaccatcacctaagctatctttttttttttgagacagagttttgctcttgtctcccaggctggagtacaatggcgccatctcagctcactgtaaactccacctccctggttcaagtgattctcctgcctcagcctcccgagtagctgggactacaggtgcatgccaccatacccggctaatttttgtattattagtagagacagggtttcaccatgttggccaggctggtctcgaactcctgacctcaagtgatccactcacctcggcttcccaaagtactgggattacaggcgtgagccaccatgctcaccctaagctatcgttctgatgtctccttttgaaagatgttcatattgtttgtaagagacttcttaggtcaaaagagccttaatgattttggaggaagatgtagaatcaaacatttatattacactacatgaaaagaaattcttattcatcagtgctattgcctttgaaaagtacagtcagtactgcttgatgtgggtatgttctgagaagggcatcattagatgttttcatcattttgtgaacatcatagaaagtatagtctactacacatataggctatatgcatagcctattgctcctaagctacaaaaactgtacagtatgttactgtactgaatactgtaggtattcaatggtacagtggtacaaatacaatggtaagtatttgtgtatctaaacatagagaaaggtaatgtgttgtgccacgacatttccacagctacgatgttgccaggcagtaggagttatttagctccatcatgatcttatgggcccactgttgaatgtaccatctgttgttgacccaaaagtcatgctgcacatgactgtgtgtcagtaatagctctcagaggaactgattttcccagatgaaatataagtaaaatctgatgtttgaaagcagttcaagcaagacccctcaaaagacatttaagcaagaacacatttggaagccagtactgaagtgttagtaatggatagggaagttatgtattttctcttctttcttttttccattcatctttctctctctctcatttttgtttatctgcattttacaattttttttttcaccgtgagtgtggattttctttcaccatgaacatggattatttgattgttgaaaaataacaaaagcccagctgggtgtagtggctcacaccactaataccagcactttgaaaggtggaggcaggcaggtcgcttgagtccaagatttcgagaccagcctgggcaacagtgagacctcatttctacaaaaaattaaaaaattagctgggtatggtggtatgtgcctgtagtttcaactatttgggaggctgaggtgggaggatcacttgaactcagggagggtcgaggctgcagtgagccaagattgtgccagtgcactccaccctgggcaacagagtgagaccctgccaaaaataaaaataaaaaagtaacaaaagaatataagttagtaaatcaaagaagagatgccgggagtggagattggctgtattgagatgagtatgtcaggggcagatagataatgtttctgaaccagcaagcttttacccttcatcttgctgcttgtctttaaccctttccttggtccctgggtcttgcctctgcattctcattactgatggtagggagtggtactcatcttcatgacataatctcattaggccaagagagaggataattggccatagttcctaggccagtcccctaagctgtgttaggctttcatatatgattctgtctggtcctgtgcctttacatttcctggtcttgccttctgagactgcccaggttttaagaggtgggtgttgggaaaggctaggagatggtggatgctggaagacaaaacactagcagagtgtagtctctccccttatgatcctgaaagtataaaaagccatctctgctctgctgccagcctacccacctgcactttggaagaagagctgttggatatttcagaatggttttcagactggcattggaaccgtgttctaaagttaacgatgatggaaataatttagttgtagaggactctagacaggcttgtgtaaagcaagcaggtaaaggaataaaacattaaaaattgtgtaggaagagatgttttgaggtatcagtgtaggtggattgtgagtggagtgacatggggagggagttaagaggagacgatgttcatggttaaagaaaccatttatacagacgtgacgagtgcaggaattctgatctctcatatgacaaatgctgagaataactcctattttccatgctaattgctaatttactcatcacattgaatatcctgctggtggaaaaattcagtgttgcagcctcatatcctcctgcataggaagtactcagtgacccaagatgttagagtctcttttatggcacttccctgaaaagaaaatattattacttaattggcaggcaacaggggcttttaagggactcatccgaacaccacctgtttacttacaagtacaaaggacaggaaaattaattacaaatgatacctttctcttaagggttctaggtttccagtgcaaaataatgatgatccaactgccaaagtatatactggtaggtggagtttttttttttttcttttcccctcctataatggattaagttaatctgtgagaacgtttacccaatgcccattgtaacaaaattatgtgaattgaccagatttcattaagtataaaatgaatgtacctcgaacttggtctttgatgtggattttgagctactatcaggccacagttcaggtatagcaaggatatgccccaaaaaagcattcctgtttgattatttggtgtttgattatcagaatttctggtctagaatacagtccaggtggtaacctttccaatatgagtgtcttcctaaggtgggtcatgagatgggttggagaatccagggttctaagccagtctcttgcccctgacgccatatgggacatgaggtgagttgcccagtttttatcatttgtcaagtaggaatagtaatgtctgatgtgattgaggattaaatgtaagtctaggcaataatgtaaatagaagtgtttttgaaattaaactgacatgcaaacttttgattgatcacagtaatcaatcagtgaacaaacatatttgtgagctatggaattagccataaatgtgaaggaagctagagaaaaggggaatgacatttccagtaagctagcaaacactctggagctatgttattaactgttaaaccatgtagtctgggtaggtatcattagccactttgccacaactccccacctcatatcctgtaccccattcaaattcagtcctttcattgctcagactcatctcgccttggccattctgcccctcacaatatgattttcccatttctgccttttgaaacgttgagtaatcaaaacttagatcaaatgtcagttctttcatatagtcttctctgattactccagttggattgatccctctctggcctatgtcagggataggcaaactttctgaaagagtccagattgttttttggctttgccagacacatggtctctgttgcttccactcaactgtgccattgtaatgtgaaagcatctgtagacaatacatagataagtgagtgtggccatattccaataaaactttattcacagaaacaagctgccagctagacttggcctgcaggctgtagttagctgacccctggcatgggtcattgtcttgctacgcagctttcttggttctgcgtacattttgccttaacctgcatgttagtggccttctttttaaaaaaaaagtttttaaaaacttttactattattcttatttttaaagatgaggtcttgctgtcacccaggctggagcagtggtgcaatcatagcttactgcagccttgaattcctggggtcaatctatcttcccacctcagcctcctgagtagctgggatcacaggcatatgaaccaccatgcccagctaatttaaaaaaaattttttttttttgtacagatggggtcttggttcactgcccaagctggtctcaaactcctgacttcaagcgatcctcccaccttggcctcccaaagtgttgggattacaggtgtgagccactgtgcctggacagtaaggcttcttatgaacagcagtgtccaggctgttttcttcttttgagtcccccggatgttgtataaataggagagtgttcagttgatgtttgacaaatgagtgaacagtgaatgaatggtggctgctttcagaagttggcaaccctgctgtccttctggatggctgagctcttccagccttctggcgtcctgcctcctttccctggcctgccctgctagaaagagaggagagaaggcatcttttctctgtcttcctcagccacccttccacttctttgagcaactactatttacaactcaaagaattctttatttatactgtgtgagagactgtttacccgtgttgaactaacattaggtttctttaaatctgctattaaaacgaagagtggccatttgtaactttaggagcataagagctgggttcatgatgtaagtgaacagagacacccttaaagttatttcccaaggccctgggaatgcgattttcttagtttatttgttacaagggagtgttttgtacattggtagaggaaaatactatgaaacaaaatcaaacaaaaacatcattacattttaaaatcattttgcaacactgagcaggtatgaatttggtactttgcttgtaattggaaaactggaaagttgaaaatttaagtatggatattatgattttcaatttttagaagatgtatagtatataatggcagtttgcatttgatgttagaaagaatagcatctcaagggaaaacaaaaatgctttccgttccagaaaatgttaaacattcctttttttcttaggataaactcactactagctacttttcttctgcctgagcccttcattgtaaaagtgaattaatgttgtcctctgaattctgttggggaaaatgacacagaacccctgtgaatgaagaattgcttttaatttcactggacgtgaggcagaggaggaccttggaaaaggaaggttattatttcctctgtggaaacgtttatcttcgttttctgggtgactggtaaaaacaatagtttgctgtggagtttcagtaatcaaagaagaggaaatagcatgtgagtgactgcaagttggtggggacaaccctggctcttttgaaggtgaaacttactaaagccacattagctatctcctagtgcaaaggtcgagaaacattttctgtaaagggctagaggtaaatagtttagacttcatgggccataaagtccctgttgtaaattttcagctctgctgttgtggtatgagagcagccatagacagttttagaaacaaatgagagtagctgtgttccaatacaactgtatttatggacacaaaaatttgaattttcatatgtcacaaaatagtattattttaatttgttacaattatttaaaaatgtaaaaaccattcttagattccctgttgtacaaaaacaggtagtgggtaggatttgggtgcagggcatagtttgctgaccctatcctggtgaactagcgcaataatttcttaggtggggaggtgtagtggataacacattacacattctgtaccttttagtaggtaatccgattatgattagctaacccaaacttgtgaagaaaatttcctggtggagttggatggctttgaggagtccagtgttcttgtccctgccctgttagtgtaaagctgaatggcactttggaccttggctgcccatctggtacatgatgaagttggactagatgacttctagggcttcgtgtagagcttaacattttattttaattaattaattaggttttttttgagacaaggtctcactttgctacccaggcaggagggcaatggtgtgatcagggctcactgctacctctacctccaaggctccagcaatcttcccacctcagcctcctgagtggctgggactacaggcacatgccaccacagctcactaatttttgtattatttctattttttttcttttgtaaagacagggttttgccatgttgcccaggctggtctcaaactcctgggctcaagcagtcctcctgctttggcctcccaaagtgctgagattatagcgcgtgagccacttgactgatcttaacgttttagaccctttatcacttgtgttttggttcttcttctgataattattgcaatttaccttttaaaaaattatttaggcctggcgtggtgactcacacctgtaatcctagcactttgggaggccaaggcaggcggaccacttgaggtcaggagttcgaaaccagcctggccagtatggtgaaacccccatctctactaaaaatacaaaaaaattagccaggcgtggtggcacatgcctgtagtcctagctacttgggaggctgaggcaggaaaatggcttgaacccaggagatggaggttgcagtgagccaagatcatgccactgcactccatcctgggtgacagagcaagactccatctcaaaaaaaaaaaaaaatttagatatttgttgagaaactaatatgtgctaactgtgcaggctctggtgatggtggttgtgtgtgtgtgcacatttgtgtgtgtgcatgtgtgtgaaacagatggtagggtagttacaatacaaaaatgtacatattagtattctaaataaattttttttctattttgtgcagtctttcttgaagttataaaaacaatataatgggcaattaggcatttacactatttttattaaaaataataaatgtatatgaataattatactcagaattcaacaatatcagatattgatttttgcagttactttagttattcatttatttattcattcatgtaacaaatagttcttgagtacctaccatgtacttcaaggcactggcttaggccttgaagactaaactatttgccctcacgaaacttgcattctaatggaatctcctgttgaagatgctaggtagatggttttattcgtacttttcagaggaggtgtacttattcattacttatttttctttttttgtttcagttatctcttgggaaatctctgagtaatgtttttgaattaccagaggaaattttacagtcacacaggtctttgttgacttttgcagtcgcctaaagttgttaatcattgaagagaactctgattcctcactgacaaagaatgaattctatcgttttagttatattagttaatttggaaagtacttcaatcaatttaaaactttagggaagatcaattcagtaagttctttagaaaatcactacgtcaaggctgggtgcagtggctcacacctgtaatcccagcactttgggaggccgaggcgggcggatcacgaggtgaggagatcgagaccatcctggctaacatggtgaaaccctgtctctactaaaaatacaaaaatttacccgggcattgcggcgtgtgcctgtagtcccagctactcaggaggctgaggcaggagaatggcgtgaatccaggaggtggaggttgcagtgagccaatatcacgctactgcactccaacctgggcaacagagtgaaactctgtctcaaaaaaagaaaagaactatgtcaaattctcaaaggtcactgaagttaacccgtgttatcagtcttctaagcagcattagtggatttatatttatgttacacatttctcctcataaaaaaagatttcacatgcatttattcaatgaatactaaaaaagatgaatatttcaaaaagtaaaagcaactgaaaatagtaatatctgttaaaactgcgtcatggctttgccttgatatcatgagttttgtctgcttttatgagggtggcatttttgggctttacaaataaaaaaataccattgtaatagtagtattataaccgtaaccaatagtccaacaatagcgaaagcattcactgtgtatcactcccctccaggccaccccggctttgctctgcttctagtcagagtggatgcctcgcagttctttttgaataaagttaaatctgacttcaggtctttcacacacacatttgccgccctttggaatctcttccttctctgcctttatcatctagttaattcctggtaagtctcaacttgaaaggtcttctctttatggaagctttccctgagttttatgtggactgaagtttcccctgttagcatccttacttcttctgagcaactgtaattgtttatgtcattatctgacaagaagctggatgaaggcggagtgtgtattgcccatcactctattctcagcacttggtttgaatgagcctataagtggtattttacccacccctcacaaaagaagctatatcaatataagctattattcgtgtaatttagtgagaaatactgatgtttcctcaccccatagttttgtgtatcttttgtagacctcagtgtttcatgacctatatattataatgtttactgactagatttggtcagttactatttgaggaaatgctgggatttcttagaaattttaatgataaaagaatgcatagggccagaatgtttgaaaccaagactgccttagagaaacccagggcatatagcagacacatttttgacctgaaacgcttaaagcggaatgggacaggaaaatacatatgcatgaaataattagtatgtttctcagtctgtccaggctactataacaaaaataccataaactaggtggctcaggaaacaacaaacatttatttctcacagttctggtagctaggaagtacaagatcaagacaccagcagatgtggtgtcttatgagggcctattcctcatagatcatgccttctacccgagtcatcatatggtagaagggataaacaagctctctctggcctctttcatgagggccttaatcccattccatgtgggctctgcccccatgatctaactaccttccaaaggccccatgttgggaggttatatttcaacatatgaatttggtggggacacagacattcacaccatagcagtatgccacctgtgacagtacctgtttgtctttatagctgtgttctcttgtttctccagtatctcagtggtattggacaggatattagattcaggagaggacttcagaatgttaactagtggtaagaaagcagcttcatggggtggctggggcttgagggagtctgtaactcgggaccacattttagtaactagagaaaatgtttcagcaactgtatggtgataagtccctagtctaaatctctagcacaaatctttcttttgagtgctggataccctattcttttgcccattaaacacgtctacttgcatgcgccacagtcacctcaaaggcaacatgtccaaagcaaattcattatctcactctcgaacttgctccttctccgttgttatggaactcagtaaccacattgctcaaattactgcctcacccattatttcttcctcacctatcacatccagtcctccaagttctctcagtcccgcctcatacatttcctccataacctgctcccttgtctatgttttctagtgtaggtcactacactagaaaggtcatcctttgcttgtgctcctgcaatagtcttctaactggtctcctacctggtagctggtcttactctcctctgatccactctcatgctgtggccaaagtgattttctaaaaagacagatgtcttaattatgcatgtgctttgaagctcctcgtttggcatttaggataaagttcaaatgccttagcttatgagaggccctgtgaccaggtctccactctccaaccatattgatgatcttacagtttctcctgtgtattgtgctgtctccggcctctggacctttagtgctgctccttctgtctaaattacttgttttctcaattagtgacccttccctccttcagtgcacaggcttggaagcctatccatgaatctcactaccctgaaatccaagggataaggtgaccatgaacctcagcacctcaagccttccattgacatttccctcctttgctccatgggtaagaatgcagaacgtatggcttcagcttctgtgtgggcctttctctatgcctggtttttcctggcacctgtcctcccacctgccttctggcctgccagtgtgtctgatctgagcagactgggagggtgtgaagaagggccagtaccgcttcagcaggaagggcagcacacggaaggccagcagccttgggctggcctgcatctgcccctcacataccctacagagaaacactgagcagctggtcagcatgtgggctgggaggaatggggctgggctaggggactagggattaaggcagcccttgtagcagcaactgtgacacaaggagcacctggccctcctggaagtcccagggctctttctttgacctccttccttcacttcctgcattttctaaattgtagctaaaatttgagatagaaccctaagagtaaaacctggccctgctagcattgatttcctgagattaacttctcttttagctaaggagcatctctggatgatgagtagagatggaagccaagtcatgtgcccttaaagtcctgtgcaagctccttcccgggatgtggtggggtgtgcatgcagtgagctgtgagggggtggccctgtcacagggaatgaggcctcagccattgtctggcagtgttggcagtgtgattttaagccagttatttaacttctaggtctcaggtccttagcctataaagttgggataatacttatcttacagggttggagcatgaaataaatattaagagaatcaaaagcaaaaatgctttgcatattatgtaatatgaaactatttttcatgtactactacttatagtattactactatttatggagtttaaaaagtttctgtgttttgaatatatttaatgaactcagtctttctaattatctgtatgtatcatgaatacaacataaaatctatgaccgtggcaaaatactatcactgaccttagatgtggccaatgtgttcttgactgagatctgtacagcttcacatgcttttttttttttttttttttggtatgccgcttatgtagcaccagtagaggatttttttttcattgacattatcttatattcccctcattattaggagaaaatgtcagttgattttctgcgttactaaggacatgaacaaagaaaactgtgtaacacaaaactttctgtgtggaatagagaaatttaatcactgtcatgatttcatcagtggggcagttcacagctttagggcatgccaatgagctgtatcacttcagagttaaccaaagaaagaaatgtaatgggggatggagaatgtaattagagtggagtacaaggggggggtggggaacctttgtaactaaattattagcattatcatgaagaaactgtcttttgaattgtttttaagctaaagaaatcataaagcagtgtttttatgtgactatgtaattccccttgtatttgaggttaatatgctgcaaattcttcataaatcttcattaagatgtcaaaattccttgtgaagcctgtcttcatttgcattcccttgtacagttattaacaaagaccctttatgtctctgcccagcttgatttcagtcatgaactccattttccttttattatttcatagaatctggttccttgattgaacttagtaaatcatttcttgaggacttggtgggaagccagagagtggtagtgaggggggcagtttatgagcccagggtgggtggagacccttgttcctcaaagcaagacattattaactttagagtctcctcttatcagatcttaaaaattcttgcccaaagttaatagtttttgaagtttgcaaatagatttctacagttgaaacctagagtagaaagaagcctggttatttatttatttatttatttatttatctttggctttaaaattaggcttttctggccgggcacagtggctcatgcctatcatctcagcactttgggaggcccaggcaagcggatcacttgaggtcaggagttcgagaccagcctggccaacatggtgaaaccccgtctctactgtaaatacaaaaattagctgggtgtggtgatgctgtaatcccagcaactcgggaggctgaggcaggagaatctcttgaaactggacagcagaggttgcagtgagccgagatcgtgccactgcactccagtctgggcaacagagtgagactccgtctcaaaaaaaagttgggggggaagccttttctcaccaattgagtgtcagtgtggccagtgtaaacaaggatgaaaatagctatttgaggggtttggtggccactttaaagttgtgtcagggcaatgatcaacactagagtttcagttcctgttgagatctgtgctctctacctttcagtctgtgagactgagtcggaatgtccccaagtatttaggaccctgtgactgctggaatttcagggttgctcagggtccagagtgaaaagaacgctgctgccaataacgccttcccatcttgggttgcctttgttcacatagctttgcttattctttaatccaaatcatcagctcattccaaaatagttgctagcaaaaatacatgtgaatgctcattcaagaatataaaggatattaaaatatcctcttatatcatgactctgcagacggaaaattctacctgaactttgcctttggttttcttaacatttcctcttagccctacgtagatacatttttctcctgtgggggaaaatttattgtttcctcattttcccccagcattatttgagtgtctgcaaatgcatattggtagtttttctagtaggacctggtttgtggttgttaatggtaaatgtgaaaattagatgtagtccaggctcaaaaggagtttaaaatctgatagaaataagactttccacaaccactagtgtggcaaaatctctgtgggtaaatgtaacttcaagcataatgtacccatctctcacattttgctcaagttgaatttcttccgttctgaggcagccactccctctgtaccatatgattacatggcttgcttacttgctgtactgcctttagcattgtcggttgggtgttttaaacctgcacgttttatttctcaagtagaccggaggatccttaaaaggtagccaaagaatagaattatataatattttaaaaagtaaaaaaaaaaaataatttttttcatattctgggtcattgtagctttgtttacaaggactttacatgttgaagaattggaggatgtattagttttgggttttttaggttggtttttagagaagtattaggaagttcccaaggggattgaccttgtagtttcaagaaaaggagaaatggtcatgcctgggcatttttgggtgctttgtttgaaatatgcatccacttggctgggtgtggtgcctcatgcctataatcccagcattttgggaggctgaggcaggtggatcacttgaggttaggagttccagaccagcctggccaacacagtgaagccccctctttactaaaaatacaataattagccaggtatgggggctcacctgtgtcacctgtggtcccagatactcaggaggctgaagcactagtattgcttgaacctgggaggcagaggttgcagtgagctgagatggctccattgcactccagcctgggcaacagagtgagactctgtctcaaaaagaaagaaaaactataaaaaattataaaatatgcatctacctcttgaaattgatacatttttgaatttggaaatgttgaataattagagcctgagcataggtctatgttttgctaagataatgtacttgggagggtggttaaaatagtcattaattttggtcacaaatttaaacagagcttgcttgacagggacagcttctctctgtttcatgcagtgtcatttggagtggcttgactgggggacaagggattaattttcaagggggctcacccacatgactagcaagttggtgttgactgtcagccaggcaacattttctttccaagtgggtctctctacaaaatgcatgagcttccttatggcatggtggctgggttccaagagtgagcattccatgaaacagaaagtaggagccatgagttggtgccggaaactggtacatcatatttaccatattctattggtcaagcagttgataatgtgaattttaaataggaaattttatgactcatggaaagactttatttggatttcatttaatgtatcaaatgggtaccccagggtggctattgccttgaggaaggtgctttatttccactaatgtataaaggaaggtgccaggcccatgaggtacaactaatgcttattatcaattttattttattcttccccttcaggtgagtggagtgagtgtcaaggacagaggactgaggtcccagcttgaggtgcttggagggacagagaagaatcagggtgaggaagctgtcaggctcctcttttcccttttggccctgtgactttattagcttaactaatacttcatagtgtttgctatgtaccaggcactttacatatattaactcaattatattcccatcggggactgtgttacaggtagaatcttaattaaagctactgctactgattcttaataatggcattacttgaagagattattattaataggcccttgccccatttgattacactgtgtgatatacagttgtcccttggtgtccggaaaggattggttccaggaccctggaagatacaaaaatttgacgacgctcaagtcctttatagacaatgtcatcatatttgcataaagcctatacacatcctctcttatactttaaatcatctctagatttacttataatacctgataaaatgtaaatgcaatgtaaatagttgttatactgtatcattgtattgttttttatttgtattcatttttacaaattgttgtactatcattatttattttgaatattttcaggccaatgttggttgaatcccaggatgtgaaacaggtgaagatgaagggcccattatataccttgtcgctatttaaagatgtctcaaactcttggaattttgatgtttttgaacatgtaacttaatggatcctccttcatattattgtagtttctcttaatactaaagtagatattattgccttggtgtattttacttttaagtttaaaaaatttttgatttaatgatactcttgaggattttagtttgggatattaccactgtcaaagctggcaggttcttcacttgattaagtcttatttccactcaacaccatttaagtagtttgagactggttataatgagcattggtacaggactggcccctcttttcagtcaaggtcagttggcaacagctatacactgtttctttattttggaaaggttttgcttgcgcaaagacttactcttttaaccaaatcctgcttttcatctgtttttgatggcaacagaccatatttcccagccatttgcaaacagtgcctgtctggcgggatttcctggacacagcccttgacaaccattactggccaacttttgaacttcagtgtttaacctggttatttgttctgtgttttctgccatgggccatgggaaccataagcttatccttttgagactagcagaaggtccaagaacaatccatttgctaattggacccattgctttccccagcccattaaccttcatgaatcaaatcttccttccaatatccagctattcatctacaagtcagtactatgcagagtgatactttctaaccaaggtgcctatggtagaccttggtcattgccattttggaatctttaccttatggactgatataatccaaacatgtcagtgtgtcataaaaattggttggccaattaaagataatttgatagtgcaaatatcattaaaattgttcttatgtacaaataataatttaaaaatccatatataatgacttacaagtaataaggccgtacttttttcactctaaaaaaaataagcaaatgataaaacattcatgctctttgacccagtggtactgattctggggctctagcctaaagaaataactcaaaacattgagaaaagcttatgcttatggatgtttgttgaagcattatttgtaatgaataaagaaaaatataaatatctaacagtaaggaattgttaattaaattatgatgttgatgaaagtttttaacggcatttgaatattgttatgatgttaaatgaaaaaaaaatggaatacagcattttccacaatatggtcacagccatggaaaaaacatgcattagaaaaaagacagaaaccagccaggcacagtggctcacgcctgtaatccaagcaatttgggagacactaggagacactagaaagaagattaaagaaaatttcaagagtgcttggcttgagtgccagtcagacttgggtccaaattcctactcttttacttatgagctatgtagcttcaggcaagtcttttaaacttttgagcctcagtttcctcatttataagatggggataataatttttccaggattattgtgagtattaaatgagataatgatacaagtaaaattcttgataatctataggcaaccaacagctggatggtggcaagtactaattcgtagcttcaagatgttctcagttgtattcttgactttggcattcttctgttacgtttgcactgatttttgacatgctgctaggagacaggtaatgtgaaggatctattggggggtttgcctttacggcttttctggtacattgtaggtcaaacaccaacacctgtgttaggccctgtcacatattcagggaccttcactgttcacctgagcttaaccaacaacactcacctgcaggcatgcacttgagtacagatgctgcttgttttgagtgaagcagatacagaaaatctttaactacaatcccatttataaaagggtggagcttatttcttttaaaaaataatcattccaaaaagatttgcacagaattaattttcaaagggtgacctctcttgtgcatttaaaatgtgattcaagcaaaccaaacaaaaaaaggattcggcctacactttcagtggcacgaagtaaagtgcacttgtgtccaaggttggactccttgcttttcttccaagcatctttcccagtctcatcatttactagtttatattttaaacttagcttcagaatgcttatgctgatgttaatgagtctatcttcaaatgctattttagtttatcttttttactttattttatttttttttgagacaggatctcactctcacacagctcacagcagcctcaccctcccttgagctcaggtgatccttccaccccagcctctcgaggcactgggacttcaggtgtgcgctgccacgcctagatagataatttttctttttttcttttttttttccttcttcttcttcttcttctttttttttttttttgtagagctggggtttcaccatgttgcccaggctggtctcgaacctctaggctcaatctatcacccatcttggcattccaaagtgctgggattacaggctcctggcctattttagtttctctctgttctttatagtggatccttaaggcatagagaattttaggaagagtatgagcatggaatagtaaagtcattgttgtcagcatacgacagagggaaagtcactgagtctttttgatccttggcttccttatcaataaaatactaatattggcactgtttacctaacagttattgtgaagccaaatcacaatagctaacatttattaaacaattatgtgttctaggcaccatgttaagagctttgcatgctttattaactttaatttcagggtaactttatggagtagatcattgtgtcctaatcataatggtagctaatatttattgatagttttctatctgccaggttttgttctaaggtctttgtgtgtcatagatattggtagaaaatggaggcaccaagagattaagtaatttgcccaagttaatttaagtagaaagtgtaggagctactattggaacacaatctgattccagacgtcttaaccactgtgcaatatctccactgtatagatgtagaaactgagaaatagaagcacagtagcttatccaaagtcacacagctagtaagcggcagatcttaccttcaaacaagattcgccattgcgcacatcattatctgttatgcaacatggcttcaaagtctgagtgatggcaccaggtactgctctgagtgctcttcagcctctgtcctcagagtcaagaaaatgtgtaccagtggcgggtccactagaagatccactgcactacggctgttgccttgtgtattcaaatccacagttcctcatgtcctgaggtcagcgagccacagagaagtgggctcaccttttctaacttaatcagtgcactgacagaggaacaggttacagagggatttctctgggaaagctgtggtgccagggcttgcttgtgcccagcaagggaattagaaatgccagggctaattccccagtggagaatgattcagaagaaaaatgaattcctgaaggctgttgtgttatcagtgccaggtctgagagagcagggcaggaatatgatggcttgtctttggaaaacatccaaacaactttcagtttcagaacagacttcactacttctcttagaacacttactgtcctttactgtaatttttgttataactggaggatagaaggaaatatgctatttgattttatgtacaaagaattttgagtccattgagctaataatgtctcccaagacaataccagtttatggagaacttggttttttgtttttgtttttgtttttttttgagagatggaatctcaccatgttgcccaggctggagtgcagtgatgtggtgatctctgctcactgcaacctccacctcccgggttcaagcgattctcctgcctcagcctcccgagtagctgggattacaggtgcgtgccaccatgcctggggtaatttttgtatttttagtagagatggggtttcaccatgttagacaggctggtctcgagctcctgacttcaggtgttcacctgcctcggcctcccaaagtgcagggattacaggcatgggccaccgcgcctcgcccaattatggagaaatttgaaccataatatgaatgttaatttgggaggaattctactgcagttcattttggaaacttgaaccaagtaggaaggattttattgttaaaaaaatctgatcacattttatgtaataaaatgtcaaacatgcaaggagagagtaatagggtaatgacccaccatataccccttgcctagatttaagaattgttaacatttggtatatttgtttaatatgttatttaatagtagtattttcaagcaaataaaatatatgatattttactcctaaatacttaaatagttgcctctaaaaaagaagaacattttcttacataacaaaattactatttacatgtgtgacaaaatcaacaataacctatttttttcttttgtttttgaacattttcaaacctgaaaaaatgttgaaagagagtttgctctttatctaggttcagcaattgttaacctttttccaaaagaagttataggcaaggctgggcgcggtggctcatgcctgtaatcccagcactttgggaggccgaggtgagtggatcacgaggttaagagattgagaccgtcctgggcagcatggtgaaaccctgtctctactgtaaatactaaaattagctgggcgtggtggtgcatgcctgtagtcccagctactagggaggctgaggcaggagaatcgcttgaacctgggaggcagaggttgcagtgagccaagatcgcgccactgcactccagcctggcaacagagcgacactccgtctcaaaaaaaaaaaaaaaaaaaaaaaaaaaaaagtaaaaaagaggttataggcaatatgagattttccctaagtactttagaatgcatttcctaagaataagacattcttttataccataacaaattctattattatacccaagaaaattaaccttagtacaataatatgacctaatatttagcccttattcaaattcccccagttgttccaaaaatgtcttttgtagctctgtgtgtgtgtgtgtggtgtgtgtgtgtttgtgtgtgtgtctgttttccccagtgcaggatccaatcagattcacatattgcatttagtaataattatgtttctcctgattcaaaaagtgtctctccccttgaccattttgtttgtttttcgtcttaacctgttttgaaaaaaactttagaccactatcacacacgatgggttctttatgattaaattaggttaaaatttttcacaaaaatacagcataaatgattttgtgaatttcttattgtatcttatcaggatagaagcaataatttcttaaaatattatttaatatccagtacatattcaaatattcctaatggtctcagatgtgtttttttacatcggcttgctcaaaccaaatattgtacaccatttaaaaaaaatcgacatagaaaaatcaattacagtctttttgagggggagggggaactcctaaaccagaataagttcagagaggccccctgaccacagtcttaatttctattccttgtaaatgcctcagagtaattcttaggcttctgctatatggaaactacatccctttgtcttttatacaaattacttgaaaaaaatggaggtaatttctcttgattactttaagaaatgaagtagaatttttgtagaacagtatacaaaccataaataaacggcttgatgaatttgcacaaattgaacacacccacgtaagcaggtctctgacccaagaaacaggatttttcccagctccaaaaagcgccccttccagattccccaagggtacctactctaacatccagcgtcatgggttcatttgccttatgcaaatttcttctctttccctgaaaaaggaagcacgaagtagagaagccatacaaaatatgtatattttaattaggtattttgaaagcccaccttcaaagacattttaaatgatatactgtatatattttcacacaaaataattcccacaacaatgttttacataatggtttcattcaatggctccccctgcttccctagaattgggatttcatccaaaacactaaaggttaagttatcaatagaactcaaagagcattttgtttccatttgtataagtcgtttaatgttttttaagtccacgcatgtgttaacaaaggaggcagtcaattacaggggagcttagcaaggcattcttagagttctcttcagtggtgagcagtgtcgaagtggaatcaggaaaagagcaacccttttcactgaaggaaattattttaattagtaattctcaaagggtaataaacagtcaaatatttctgaaatctcctggctttggggcaagtaattacaatgagcatgcaattaaaaaaaaaaaaagaaagaaaactaagacgagggcatgtacaatcaattaaatagaagtaattacattatgagggcttcatgagtagtgtacggtgcattaacattgtggagacaaaagccaccagacagcacattgtatgtgcaagtcttttgaatctgaggttggttttcatggtcttctcgattctacgttgtggggctctgccactggtagtcggtaactttctaatgcactgaactggcaggagtgatggcagcatgcctatttgtggtgtctagggaagccttcttaaatcattggtatgcccagcctaaatcagatcacgcggatcctgcagtcggtatctgggtgatactgtgattggtacatgagtgtaacttggctcggtgtgcctggagttttttttagcagggataggaatctaccatctctggtgtgtttttcaatgtggcatgccccagtgacattagtggagaagggacttgctaaagttagaaagtaagattgaacagctgggttcaaggccttatactaggttcccaccagctgtttcaaagggatggagaggagccacccagagtgctttgcagcagctgtgaccccgaaccaagggaagctttatttcgaaagcacactaagaatagatacaggctcctgattttaaaatacagcggacgattaaaagctttctgggtataaacagttcaggtcactttttaaaaacacaagttaatttcaagctatatggaaatttacatgtgtgttttacatatgtatatatatttatacacatacatatatgcctgtatatatatattctgatatatgccgattaatctctctaatctatattagctctgctttgaatgaactttgtcgttgggatgctttggcatcagggcttcatagcattgtacttacatttattcagtgcctttggataggaacgcctgtagtttttttagttctggtcagttgggtataaaatattgccatagtgtcagaagcacagtgtgtgttcagacaatgctgttgaatctgaagtcatgcttgtaataaataccataaatagtatattttgcaacttcttaaaatgtattctataggatagtaataattaagtgaaaaaagttacacataaaatgaattacagaaatgtgggattaagctaattgaaaactagaatcttttatatgcatatgtattgtataaatattaggagaggaatataacattcagtgttttccatacttatttgataacagaacccttttgggtgcaggggtgagggggattatcttctaggactgatgttttatagaacatcattgaggttaccttgccccatagctgtgtctcctcacagtctggttgaacctgaaagcatttgttaccggagaagtagattttaggtggaaataccagatgcagttggcagaatcagaagtgtctctccctttgctgaattcacaatgactttgtattcactaattctttctcctaccccctcccgcaatgtttctcacatttggcaacatatgataacatttgtacattttcccgcacttttgtattaatatatttattacgggtctgagtatttaaacatgaacttttttctcaagtcatttaaaatgactacaattcctaacccagaatgaaatgtttcttctaatataactatttttaatttcagaatacattgcaaaaatgttttttgtgtaaatgttttaaaacataagatattatcatgaaaaggtaatttcttagaaaaattggaatttatctctactacttttttttgtttagagaaaatttaggaaaagtgaatgtacatcttgaattttagttaagtaattacagttatatagtcaattataaaggctggttacatagcttattatagactgaacacattttatacaacagccctatttgaatattttccctagttattaaaataatgaaaacattaataaaaactaaaggcaatatgatattaaaagcattaataaaaatggaaggcaagttaggctaaagttactatcagagactggcttctgaaggaacaggttttggctttccaagtggcagggccttaagaatcacatccccagctctggcttagggttccagcattgctcatggcatattcagctgttgccttgcatctccaaatctatcttcagagtccttttacctcttccttttaggtcatagtggagagttggcgttccgctttgtatttatgtttttttaagtagtatttgtatttctttctttcctttctccctaacaactacaggatcacatggacctaatttgttttattgtcacaagagtcccttttcttgacaggatatgcctaattaaaaccagggtgttaaaaaaaaaaaaaaagctaagttttgcaggcaagttgacatactgtgtgactcaagggtttcaggagggacaaggagggatggtggtgtgttattgaagcaagaggaggaccaagcctgcaggagatattgttccaggacaaagtcaggctatcagcagtgctgacggtccacctccccttttccttccttcctaatggcccaagttatgcacgtcagcctctttgggttcacaaggcagtattgtatcatggaaaaagccctagaccttattatgagaacaagatttgactctgctctgccacatggaaactaagaacttattaagtaggtttacttcacccaactctgtttctgtatcttttttttgagacggagtctccctcttgtcacccaggctggagtgcaatggcatgatctcggctcgctgcaacctccacctcccgggttcaagcgattctcctgcctcagcctctcgagtagctgggattacacccgccaccatgcctggtgaatttttgtatttttagtagagatggggtttcaccacgttggccaggcttgtctgaaactcctgacctcaggtgacccgcctgcctcggcctcccaaagtgctgggattacaggtgtaagccaccgcacccggcccatttttatttcttaaaaacagagattagtaagcctgttatgtaatgatcaagttaagatcatttttgaagccataaaatggtatataaatgtcaactattattatcagacattaacagcatggttattgtgaatattatgactaataattaatatgaataattattattgtaactatcattattaccatgattgtcattattaggaatataagtagcaattcattcaacatacatttattatttagtgtctattgtatgctagatatggtggactttcaggacccatggtgtatagtacctggtagaggctcagccgagcagtttgcagaatcaacaggaatgaattgagaatgacttaatttgtttaatagaatgtgacagcattctctagaatttgttcctttctggggcaagtaaggaacaaatcttcctagattagttttatgagtacttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagttggggctactgagaagttgaaagctgctttaaagtctcctttcattttaacaccattaaaaaaaaaaaaaactcatggaaaggaaaaatctaaatgtatcctgtaaagaaaataccatttcctctggtaattatgatggtctatatcctgtttaactcattgcacggggttcctctccaagtcaatgaggattgcgtaaagagtctgaaggcaggatgtgcctcatagtgggatgagaaggagccttgtggctggtcgtcagactaaatttaaaccattatttgttgtgaatatatgattaacgtgggggttaaaaatgaaaaatacagctgcaagagtaggtttcttcctttgataaaaacagaaaaagtcaggagggacaagaagaaaacaaacacagttacgtgaggcatgcattctctttcataagaacagtcaaatatattttagcctaatctttctttctagatacaataaatgccgctcccttctggattaggcagatgacagcaataacagtattgcagctgggagtctcccaggctgacaggtgctggatataagatgccccagattgtcctgtgaagtacaggacatgctaggccctgctggatctgcccaaggagagggcagctcctgtgtctgttgacacctcgtttagattctcccgctcactcaaacagctgccagaggcagccgtaaaatattgcttaattatagaacttcccttgatcctctttatcccttccttctattgcatttttcccccttttgtgcctctctctagttcagagcacctttaggctaagcactcatgggagtattatggtggcgccttttccaactcacagttaaggcagagacaagattttcagtcctgcactatagctgtggaattattttcagaggctgtaatgagcaggtataggttcaaatgtggaatgcagcatcattttttaagcaggaaatgggttcattttggggggaggatagctttctcattttttttctgattagaaaaataatgcttattgtacaaaaagaacaaagaaatgtaaagatatgaataaagcctacttcccccttgttcatatgtgttctatttaccaaaacgggattatgttcactcccacaatatattttagcaaatacagatccatgtaatttatcatgtctgttcagtcttccactgtctgactgtaccataatttgtttaaccattctatcatcatacactaaagatagaaacaaaaccgctgtggacatccttaagcatacattctgcatacttgtattggtttggagtcatgtttgtgatttacagggatgcgaaatgagatcatttatttctctaacattaaggaaatctgaattaaggaactcaagagctggtttgctggctccgctgcacctttctgcttagttgttcttactgagtggcttccattcctcataattccagctgtctgctgcagctccagccatcacgttcatatgccaggctggagaaaagatggaagggtgggaagcagaaacgtatgtctattgcttccgtttaaaaacctttcccagaagcccacacagcacttctgttcattgtctagaacttagtctcttggcaatacttagcacctaaaaagggagagcagatattccaaagcaacaaccatctctgtcattcccatctaattgttttctgggaataaaagctttgtgcaaatggacttactggatcaaagcttttcccaggtttttgttgcatattgatatactgctcttcagaaagatggtaccaagttaagtctagtaatatgcgagaataacccgccgtaagttttcaggttcttttgtgtgcattttatgggcatttttaaagctatttttctgaagctgcattttttcttttgtttattaaatcatacattctataaagagtgaggtggagattttactatttacaattttgtcttcaaaatctatgtctgtacaagtagaatattcattccaagcactggaaggacattttaatgttattcgcacgtatttcctctactcctaagaaaacttatttggaggttgccagttgaattaatacattaatcaaagtaaggcagctctctcctgttttgaaaaacttcctgtcaattaaatacaaggcacagtgtaaaagtggctctgcccaagttagtgtttagacagaaatgtttgtattacaccgtggtgtgaccatcagcagctccataaataaaggaatcatctgccggcgcttcccaccttttgggtggggtctgttttctccttcagtggaaggacattggggtcatcatcattactgctgaaatgttattactttagattttatcaaaaaacttggtgtcaccaggtctgaagggaaaaaaaaaatcaaacttttttctttttaccctcacacaccatccaacacagcacttccgattccctagcagacaccaactgggtgtcctgtaatttcattcaattctgacactacctacccagagatagtatcagatctcacaggctaagggcttagtcccacaagactgcaccccctccagcccacctttttagatgccaattgcaagctacaggtggtgacctgtgcttctgactaactccctccttggatttgatccatttgctagaatgactcacataactcagggagacacttcacttacttttacccatttattagaaagaatgttacaagggattcagatgaacagccaggtggaagagatacataggacaaggtacttggagcttccacaccctctctggatgtgccaccctccaggagccttcacatgttcagctatccagaagctctctgaaccctatccttatggatttttatggaggctttattacataggcataattgatttcatcactggtgatcagctcatccttcagcccctcttcccttccctgaaggttgggatgtggtgtgggactgaaagttcgaatcctccagccatgtggttggttccccctggcaaccagccccttcctaaggctatgtaggagcccaccaacagtcacctcattaaaacaagagaagttcctatcacccagaaaattccaagggattagaagctctgtgtcaggagccgaagtcaaagaccaaatattaaaaccaaagattctcctagcacccctatctacaagggttataggaactctagatcggcaatggtgacagagatttatttcttaatatatcacaatatcacacatggtttcccgatttggttattcaaattggtttatattagctttttttcatctttctttatcttgcgagtgttacagaataaaactcacttctcttcaaagttagaaaagtgaccagccaaaggattactatcactgagggatcatttagaaacaagtgattattctaatgctactaacttaaataaaaaaaaaaaagttggtgaatcagtagatggccgtgccgtatatattcttgcaactttcctataagtttaaaggtatatcaaaacaaaaagttatatacgcacaaatagatgttgattttatatgatttttatctgctactttcatgaagaaggatggggtttgaagtcataattgaaacaggtacatatttttgtactttgttaagtaaaaaattaaatcaatcatgtattttttattaacatccacttgtgggtacaaagatacttactgtttggagtttgcataaacatacttgtttaaaaacaacagcattttttaggctaaatctgtttttccattagttgaagtcatagaaccttcaaggcttcctgcatttctgtacctggtatgtcccctcacattttggaactattatctccttgtaaattattagaaaaattaaattagattaaaacttcttgagcatttctttattaggaaaaatggaaatccattacatattcttttgcttgcattcaatcttactgtgctttttactgcaagctgaagtcccctttctactttaaatgggagagaaaatcttgtgctgacatgagatgctcattaccaccaaggcactcattaccaacaagggcagtaaaggaatcgcagctttggctgcctctcacactgaatctgagagttgctattattagaatgcaaaaaaaaaaaaattgtggggtgctggtgggggaactatgtgagacttgtggttagctagacctgtgttttaagaatatttttgtctctgagtcaattgttacttaactactcgactatatgaaatcaagtatatcagccaggtgcagtggctcatgcctgtaatcccagcactttgggaggccgaggcaggcagatcacctgaggtcaggagttcaagaccagcctggccaacatggtgaaaccccgtctctactaaaaatacaaaaaaattagcctggcgtagtggcgcatgcctgtagtgccagctactcaggagactgaggcaaaagaatcacttgaacctgggaagtgaaggttgcagtgagcagagatcgttctccagtctgggtgacaagagtgaaactccatcttaaacacacacacacacacacacacacacacacacacgaaagaaatcaagtatatctgtagtttttgcagtaaattgatgtctaccattatttctctccattttcttgtgttcattgtactataaggtgtttattgattttttttctttttttgcatttgaattactcagatccctttaaacagtttggatagattttcacaagggaaaggaagggaactaatatttatagtgtgtcatgcatatccggcactgtgctaggtgctttacttttgttatttgatgaaattctcaaaacagcctcatgtaatggatgttcttatgcccattttacattggaggagaccaaggcttggagatgttacttacagtagtctcttagtcagttaatggcagaaacagatctcaaatccactgtaccactctgcctcatttgggtgatattttcgactgaagatgccaagaaatacacgtaaagaaacattgtaggctgggtttgaaatgtgaaccataagctgtgtttcctgataattattttcaaggtccccagtagcactctccccttcctctgaagcctaagttggtccctttcgatgcctcagtttttgtctttgatcctccaaataatttcttgcaaaatgggaacctcactctgaaaagcacctctagtctctcttgagatgccggggttcatgccagccctttttccagttcaagttgtgtcatgcctttcaaacatgtgcaaaaagaaagtggctctgatggccagagccagggtggctcatcctcttcccagaattgaaaaaaacaaaaccaacaaaaaggaattaaatctcttcacatgaatagaggagaagctagcctaacccaaaagaatttttggttttaaagaggatttgccttcttttttgggatgagtgacatttaattcacttggccccattagaaagaagagaaaggagggcagtgcagctttagcttcgacatatttcacatttggagtggcttcggagcagccaagcactgggtcagtgtcccatttaagaacaactggaaaaaacaacatgttaaaaacgtgttaggcacagagagcatggaaaaacaattgtcaaagtattttagcatttagagtagcttagtggctactctaaaatactaacttctttttaagacttattgtgagattgaagctgattcctagatgttagatgcagttgatatgggaaacatttctaacatacagctgttgagacagagtgtcaggctctggaccatttataataacaaaaacaatagagtctgtgctgtttaccaccatactgctcgttgtttcactgccaccttctccctgctcatttgactgccagctccttgagggcctaggtattacaggcactcatcaccgtatgcatgttgaagtgtcgtgaattcatcactgagtgcctagcaaatcccgacatacatatttgggtacagcatcacttcatctggatcttgggtgtagaaatagcaccatattctaaccctggaagaaactggctgcattgggcttactgaaagataatataatgtacacaaagcctagtggactgtatattcaaaagtttttcagtggtaatttttaccacactccacatttgccaaaactgattttggggagcagagcaaggtggcacgcatgtgtagacccagcctcgggaggctgaggcaggaggatcacttaagcccaactgttggagtccagcctgggcagcatctctttcaaacaaaagaaaactgagtttggaactgaatccctatggaagatgtaccccactgtaaatacttgtctaatgaaaaaatggatgaatacattccacttcctattaattattctagaattcactattcatgtggctgggcgtggtggctcatgcctgtcatcctagcactttgggaggccgaagcgggtggataacatgaggtcaagagttcaggaccagcctggccaacatggtgaaaccctgcctctactaaaaatacaaaaattcgtcaggtgtggtggcacacgcctataatcctagctactcaggaggttgaggcaggagaatcgcttgaacctgaggggcggaggttgcagtgaaccaagattgtgccacttcactccagcctggttgaaagagtgaaactccatctcagaaaaaaataagagtaataataattcaccattcataaagcgtctcatcttttctctacttctgattctcatcccatgtttttgtttgtgagaaaggagaaaagtgaaataaagactctaccaagtacatattttatacttgacatctggaaataatatcgtgaaatagactctcacattgttgtggagttccaacacaataaacttaaggtgatttatacatcttttatttattttattttattattatttttgagacagagttttgctctgccgcccacactggggtgcagtggtatgatcacggctcactgcagcctcgacctcccaggctgaagtaatcttccgcttcagcctcccaagaagctgggaccacaggcatataccaccacgcccgactcatattttgatttttttttttttagagataagatctccctatgttgcccaggctggccttgaactcctatgctcaagcaatcctcctgcctcagcctcccaaagtgctaggattacaggcgtgagccactgtgtctggactatacattttttaatagcattattgatcctggcatgagaggagaaaaaaaaatgctggtactaataataaaattgtttgcaacgcagccaaagttctttaatatggctcttggcccaaatcaaacaagcaacagaaactcccagtccttttttttttttccttcttatgttttcacaaaataggaaaaatgaggttaagcaagaattttgctcagtttgcagaggcaaagtgaggcttgccagggccgggtgctgttggggtgcgtgcagcatatgacggggtgtctctaacacagtgactgaactgttcaccttctgaagtgaggctcctgagtcacacctggggctgtcttgatgagtcaccagccttccaaagtggttttctctgggaagtggcacttcacagtgccacttttttttcccaccccagggacaaaactctggtaaatgaatccctgcaggaaccacgggtattacagtcctgatttggctcatctgctctttggggctgacagcagctttgcttgactcagcttctgcctgactgagtaggttcagacagaatgagtctgcagaaaagtcggtggtgctcagtgggaaggacgtgagggagatggatcaccacagctggccagggcagaggcactaggagacctttcacatggctgctgtgcctactgctgctaacttaaacaagtggaaacttcttggcaagtctgtgagggaagtcgaggattagagcctggtagttaaaaatacaatccctgccattcattcagaattccagagaatgctgaaattttttgaattggcaagtgaatggtagagaccggaaccatacactgaaataacttctctggtcttgtatcatcttttattagaggatcctaaaaaaatcccctatttatatatcagttattatttctgtgtcatagactgcagctatgtttgatgagctgcttaagtgaaaatctgaccggaaactttcaactataaattctttgtggtttcaaagaaggatgaactttctcatctaacacatttctgctgtgtgaagagtcacctttattatatggcatgagtctttttttttttttaatagctttggggtttaaactctgaatgctttgctaatagatgtgtcagctgtgcacattggcagcttgacttttacctctttgtatcttctattctgatgcattaaaaatagcaggagatggtgccgtttaggatttgggcagaatggaagaatcattataaccaataatagtgttttaaaagctgccttgggacaaagaattattaattagggtggtagaaagaatgacaacgtgggaggaagattgattagggtttctagaaatacagtaaaacctaagctatgtatctcttcaaccatgtgaagagctattactttatttctgattgtcaacatatcgaagttcaaaagccgactccacattatgcaaatagactgataacgttaagcagaggagatcaatgtactggatggctactaatcttaatattgtcgccaggcgcggtggctcacgcctataatcccagcactttgggagcctgaggcgggtggatggcctgaggtcaagagtttagatcagcctggccaatatggtgaaaccccatctctactaaaaatacaaaagttagccaggtgtggtggcacacgcctataatcccagctacttgggaggctaaaggaggagaattgcctgaaccggaaggcagaggctgcagggagctgagatcgcaccattgcactccagcctgggtgacaagagcgaaactccgtctcaaaaacaaacaaacaaacaaaaaacctaatcttagtattacaaacatgatcaggtcgggttgctagtttagatgtgggtggtgagctgagcatccactgcgatggggcttctactgtcatgggctccctctgtgatgtggcctcccttctgtgatgagctccctggggtttctcctgcaatgggctcccactgcaatgggcttccactgtgctcagctcccattgcattgtggttttaggtgacagcagagggactacctggagaaagtgtgcatctgggcctgggagaattagtaagtgtgcataccacccctgtctttgttcttgtggttaagactcatctctggtgttggttagcagagctaagtaccgttggcaaaacaaaaggtactactaaaagaaatgtaagatatgagtaagatatatgtcatttcctaggtcttgaaatctaaataagatcacactaatagaatgtttaatttgatttaaatgcaaacagtatttatccccaacatacaacgagaaagtaaaccaccttttgcatacttgtattctaattccagttgaggaaaattttaaaagtttaatataagtcttcggcaagactccttgccatctggtacaggattaaaaattggcatagcatttgttgtctactgacagtgggtcagatttacttggcaggccctatctgggaatttatcaacctcatccaaatctgtttcagtttccatttttaacactagtgggtctaattggactgagtcacaagaagcaagttgcaaagctgtttcatttagcaaattttaagctaattgtcttcagtatgtacatttgttttaacattaagaggatggtgaattggcctagtaaatcaaaaaagttttaaaaatctgattttctgaaataagacagtttgcttatacttaaatggggattgtaaatatcataggcttggcagctttttttcttttttgttttttaagagctagggtctttttatgttgcccaagctggtctccaactctggggctcaagcagtcctcccgcctcagcctcccagagtgctaagattacaggtgtgagccaccacacctggctagcattatctgtggaacatttcttctggaagagcttgtattctactggaagagaaaaaaggaggtagtaaggacagaggctacagaggaatttcactgaggggatgaagacagggagcagtgagtatgattgagttttaaaccagtctgccttggttttatgaccccaggctgtctttaaattctcatctcattggtgtggttctctttaactgctcagctaggttgtggcaaaagaagaggcagtttggaggctgcttccaggtcccgtcctaaccactctgctgatggaggggagccctgatgtctgacactgtatgaaactctcatttattaaataaatggtgggcagaaaaaagacaaaacacttatgtttgaagacaaaatctttgcccatagaaataagcaacatgctgctaatagttttaaattctttcaaaatgaagcacttgtaatcattcctatttttatatctttgtatgcttccagcaatacaaaatacattacatgggattctctatttcagaaagtccttgttatacggcttccttcatcataaagttagtgtgggtaaattcatccaaaaacaccaggccttttcctgggtggtaagaagctggaggattctattttattttattttttttgagatggagtttcactcttgttgcccaggctggagtgcaataatggcgctctctcagctcactgcaacctccgcctccccggttcaagtgtttctcttgcctctgcctcccgagtagcaccaccatgcctgtctaattttgtatttttagtagagacagggtttctccatgttcgccaggctagtctctaactcccgacctcaggtgatccacccgcctcggcctcccaaagtgctgggattacaggccactgtgcccggcctgattattctatttttacagataagatttttatctttgcctttactatgtttgcacaatgtttttgatttttacacctaaccagtacatcacccatcatgcataataggtatacgatctatggttgttgaaaaaacttgaaccaagtgttgccaaccttggaaggccagagctgccttctctgcactcactgctgagtgagtttgggaagccaggagaactggccatgaaatctgtaagtgactttggtggtcataatattcccagaacagacctgctttatcctcacagtgaggaaccagtatattgttagcttttttacccctgtctcatgcatatgggtagtgtgactaggatatccaattagatcacacagggtcagagctaatattaaacccgggcacccaggtatatgtgactccacaactgcgtgtggtctttgcagagcccacagagtctggcagtaggctgctgtgtctgggagatgcctatgtgagttgtgctgttatttcatgggccatggtgacccagggggacttggataccaggtgtccttgggatatgtgcctggaggtgagatagtgaatggattgtcaggcagagagggtggggggagggaaggaggaagggaggaaaaccagaaagattggcagaagggaagcccagaggccattgccctcatcaaggtgaaaggtcatgaaggaggtagaaggaggtagcagtggcttgagaggaggaaactggagcaaagttaacaccccctccgcaggctgatggggaggccagtctgaggggagggtgacttggagggtgggagtgccaccccaccaatttcaaaacattttaaccccaaacacacaatttacctgttaaataaaatggctttctacatttgcgtctttctggaggaaaatattaatccatgagggaaaactgatttcacacgacatggtttttcataacctaccatttccagccaaatatcttctcagagacgtggtgacctttcttgccccttagcaaactccatgcttttgtccaacctgggcagttctctaagcagagactcataatgtaattggaggccaggaattggttggtctttctgggactgagagaaggaggctgtctgggaagtagtggtccaaggggctcttgaaggaaggggaaaaagcccactcccgcttatatttgttacaggtaccgttaaccccacataccaccagggctctccatgggaagcacttgtagaggatttttcttttttttaagtcgaggaaaaaaatgtttactgtcaagaaaagcttttcttccccgtaggaactgctattctttttctttataaacagcatgggatcaggtgattgattccatttgtcccctgatttgagccacacgaagataggagccaaaagtgtagtttatcttcaggaactctttttgtttgtttgtttgtttgttctttgagactgagtttctctcttgttgcccaggctggagtgcaatggtgcgatctcggctcaccacaatctccgcctcctgggttcaagcaattctcctgcctcagcctcctgagtagctgggattacaggcatgtgccaccacagccggctaattttgtatttttagtagagacagggcttctccatgttggtcaggctggtctcgaactcccaacctcaggtgatctgcccacctcggcctcccaaagtgctgcttataccttatgacctgtgtattcatgcatcaattttcttttttgtctttttgtaccttcattagtatttttgtttttactggttgtgaaaacaatacataatcactgctaaaaatctggaaagtacaaagcagtttagataagaaaaaaaaaattaccagtgagcctgttatttgcatatatcaccataaatagtttgatatgtttctttttccttttttgttccattttcaaatatgaaacctgtacagtgtatgtatttatacaatacacatatataggcaggttaaatatatttgtatatgtgtgtgcatttccaagggaagttatacttttaaaacagcagagagtttttcttgaagtagactaagcaagggagtgaagccaggaaggaggtgggagtagcggggaagtggggattaatctagctaaattgtgggtcctggcaaacactgagattacactgtgaaatacgagaaaggaaatgactcagtaacattgagagagggagcagagatgagacagcagagtgaaagagtgaatggcgtatcctgggtttgggaagtggtgggaagtagggggagctggagcctgaggcactaagtgattagaacaataggagaatttagttttcagatgaaatcatcaaggctgtattaagtgcctcttgtgagcaatagctcactcttacttgttgcattcagcctgggagccactcttgacaccatgttagcgcagccttacagctgatgtcaggtcgactggtctgcagagccaggaatttgggctttcttctcagagttgttttggagcaatgagaactgctcacttaagaaaggctccctcttgtactccagcctttggggaatgctgtgagtgacacttttaattaacaaatccactgggaacaaaactcctttaaatgtgttggctgggtgtggagtttgaagggtgggccgtggaggctcccactgcactgcaggagtgctgggacttcaagccatgggtaagctcggtcagaactgtcaggatgaggtccacccagaaggccccacactctgtcccaggggatttaggctggcaagctgtgctggcactcctggggcaagatgagctcatctgccacttcagatgctgggcttcctatgctagatgttcctgctcttgccgcattcaggagccacagcccacttgttcagaacgggaggggagagtgggggacgagcatttaggaatgcatcattccagctcctgtattattcctagagctggtagctgaaattctgaccacggaagtgtccttgaacatcttccagcaaatgatgtatatttccacatctcaccggggcctgtgctgatgttggttctagcacagcatcaatatccatgatgtcagagagtctaagaaaggtttatgaaagagagaaggattcttttccttctggtaccagagtgaaaactatttatgtagcacatgtctgccttggaaaacatgctgctttaatagaatgagttctgaaggaataatcaaagcatttcttaggtctaattattttgctaaagggagttacttaattttgacatcctcatcaattagttcctcacttggaaggcctgtgacaagcctgaggctggctatgagtttccacctgcccagaagttgatggattttatgaaagctttaaacagaactacaattgtgaaactgaaagtgtaaactaaaactattgtttttattattatttactttatacttagggaaatgattttcatctctttacttcagtatttccccatcttttttttttgggggggatggagtctcactctgctgcctaggctggagtgcagtggcatgatcccaactcactgcaacctccacctcccgggttcaagcgattctcctgtctcagcctcccgagtagctggggttacacgcgtgcatcaccatgccggctactttttatatttttaatagagctggggtttcaccatgttggccaggctggtctcgaactcttgacctgtggtgatccacccgcctcggcctcccaaagtgctgggattagaggcgtgagccaccgcccccggcctttttttttttttttttaatcacatttattctaaaaccttagacctttagacccaagttttcacgcaaggcaatggatgagttccccttggcaataccttcaagtcttgcattaagaaatctgaataacaattttagcagaggaagcatttaaaaatgaggagacagactgaaaagaaaacaagacaaatacaacttcaatgcaaggaagtttctagactgattaaacataacgaaagtaaaagtggtttcctaccttaaagattcaaaggaggccattgttattcaaaagtgaggtgtgtttaacagaaacaacaatcatgctccttttgttgtatgtctaaggaaggtcaatggtgggggcctgactggaagagacccacctggttgtgaggcccaaaacaaagggctaacattcagtttcttctatcatgtttgttgtctttgatggatatggaaagatctctgatactgggctgggtgcggtggcttgtgcctgtaatcccagcactttgggagactgaggtgggaggatcacttgagctcaggagttcgagaccagcctgggcaacataaggagacacccacctctacaaaaaaaattttttaaaaaaaatgagccaggtgtggtcgcaggtgcctgtggtcccaggtactcagtaggccaaggtgggaagattgcttcagcccaggatgtcggggctgcaatgggccatgattatgccactgtactccagcctgggtaacagagcaagatcatgtctcgaaaaaacaaaaaagaaggagaaggaggagaaggaagatttctgatactgtttataaaacaaagtagaggaacgggatgaatctactcatcatatatatatatatatcacaaactttcactaaaggaagagtttgatggagtgggacagagtctctaaggtaccaggagtgacctgcaatgtgatttggaaggtggtaggcaaagctggaggccatgtccacctttcttagaatgtactggaaactctgagcagaagctcatgtttcatgttgggttagtttctctgtgattaagtcacagtaacaaactggaagttgtatgtgatcaaacatgtaatcatgtcttctcccttgtaaaccttcatgcctcaatatctaagtttctccataagctggcactagttgactttcctactattattttctaatactctgccttccagctaccctattgtcaccttgcttggtgacagtgagcttcttgagggttttatgtgtcacctttggggaccttgaaataccttacactcctactgtgagagctcactaatgtggtgttcagaagctggtttcatgggcccatcttttgcttgatgacagccaaagggatcctcattatgtcaattctatgagtcaggagagtatggggtactggctgggaaggtgagcatggctccccttccaggaaggagctcacactatggcactccagtgattggatggctgagaagcaactgaggtgctggggaatacaagctccacgggccgaggggaagttcactggggctcactgcatgcaagggctgtctggacagcgatgtcttgggcttgtgtttagagagctgcttgcagaatccccagtgtggcctaaccaggatgcagggaaaaataggcaagtatgtccttggatgaaaccaagcacaatctatcaaccactcaagcagatcctaagggaagaattagtgtcattaactattatgctgttgttggtgatgatgataatgatgctgacaattaaaaagataattaattgttttccttcttttagtcacatagaaaaaatcaccacatggcaagaccctaggaaggcgatgaatcagcctctgaatcatatgaacctccaccctgccgtcagttccacaccagtgcctcagaggtccatggcagtatcccagccaaatctcggtaagcctcaagcttttttaaaattaaaaaagatattttttttttgtagagttggggtctccctttgttgcccaggctggtgttgaactcgtgggctcaaacaatcctaacacctcagtctcccaaagtgctgcgataacaggcatgaaccactgtgcctggtggagccccaagctttgactccaagctgaagaaatggtgttcaatcaaggggtggcggggctcataagtggttctggctgtttctatgtctcttcatgcacccagacggtgtttgctccttcttcttggctgcaataccgtgttacccttctgccggctttttcttctttacttggtctctttaccaccaactcatgatactgctgcctcagttttaaactacagttctgaccttccctccaatggccttaattggggtagaaaaatcagttaggcctcctgtcttcatctagcctgaggcaagtaggacacatacacgctttgggtgactttggctcctggcgactgcctacaggtacaattctagtctcaaatccctatccttatttcccttttttcctttttttttcataattgctgcataacatgtgtcagatagcatgccaagtgcttccatgccttaccttatgaaagccttccaaaacccctgcaaaaagtagcaggctctccagtttatacatgaagaaactttccgaaagtcttgcagcttgtggagagcagagctggagagcaggctagtctgattttagaagggagttaaccattacataacctgcaggtggcttctccccatacctgccgtgggataatatggctcactttttacttcatttacaatacttaataagtgcgattttagacttgagaagagaatattttctgctaaaattatccccactagagataatcaccagtgaattaatacactgcagcaacggaaccagtcagcttttttggtaatcattcccttccttctcccccagggctaaaaataaaaaagggccaattttaaagttttagaaaagttggtgccattttcagataacatttccatttaagatcagatatccagatatgctttatacacagaacagttaattttagggagtgaaaagaatctcctgttggattttcaggaatgaacaagataaaaatggaagcgttattcctggacacccttccctcatactgtggcttagccaaagtgagtatgaactcaagtagaccctagtcagcttcaagtgtcagttcttccaggaagtctgaacctactgctttaaagcttgcagatgtacagtttccaaaaagcaaatgacatggaacaacctctgtggagttccttatctaaagggcagatcaaagaaaatgcaaccagttctggtaccagcagtggtaaaccaaagcctccagtgagttattttgtcccaaatatacaggagctcgtgtagaaatcagatgccactgtagtaaagagaccccaaattaggtggcattagactggtttttacagtttgtttaaccatttaattttcatcgaaaattctaaaaactgattattaaagttttaactttaactttgtaatcaattataatcggaaaaaaatctttcatgaacccagtttacaaaaaaaaaaaaaaaaaaaaaagaaaagaaaaaaaaattcaaacacttcctccaatctccctttcctcagtccccaagtttgtttcctggagccaaccagtgtttctagttgtgtgtgtgtgtatgtttaatcatactaaggttagcatatcataaccactgttctgtatcttgcttttttcacctgcctgtccatacatatagagctgcttcattcttttaaaaatttgcctattagtctactatattaatatgctataattagtttatttaactaactcctatctggtagatatttaggttgttactagtgtgttgctagcatacaaatactggagtggatatcctttgtcatgttcttttatgcattctccttaatttttaaaatttgtgcgatatgtaggaagtggactaattaaaagaagcttgaatgcttggaactagatattgaaggcacatgtgagtctgcctgtatgtgcatacatgcatgcatatgcacacacacacacaaagtccaattgcactagtaaagtatatctaaagaagttgtaatctgaacattctgaaacaaatttacctgtagctcagtaaaataccttagtttccagatttctatttttatttaatttttgttattattattattattattattattattattattttgagaaagaggctcaccctgtcatccgggctggagtgcagtggcacgatctcagctcactgcaacctctgcctcctggttcaagcaattctcatgcctcagcttccccagtagctgggactatgtgcatgtatcatcacgcccagctaatttttgtatttttagtagagacgggatttcaccatgttggccaagttggtcccgaactcctgacccctggcgatccgcttgcctcagcctcccaaagcgctgggactacaggcgtgagacccggcacccagcagtttccagatttctaataaggcagtgaatttctcaagacgcacattctggggtttttccaacaatatttgtgtatttgcccattgcaaagtgtgtttctagcttatggagaatcacagatgtgtctgaaggatggaaatacaacttggaatgccaagtaagttccaaagaccaggacttaatttagagagtctcaatacagtcagaataataaatgatttactcagactatttcatttcaagccataactctgcctgtggttcatagtctttattatatatctttaaacatataaaaataaaaagagcagagctgggtgtagaggtgcatccctgtagtcccagctacttggaaggctctgaggtgggaggatctcttgggcataggagtttgaggccagcctgggcaacatagtgagacccccaactcttaaaaactagaaaaagaaaagagcagattcttctcctcccactcttccttcttcttaaatctagaactttggtacttttcaatggaatgtagctgtcaaataagtgaactaaagtgataggtcttctttaatgcaaggcatttatatacatgtgaaaaggatgtcaaaatacagttaatagcattactatcagatgatagaatagtaccttttataactaattttatttatttctagagccgtgatataatcagtggcatagttaactacattcagaaacaaatcttgtatttggtccctgtatgtttctgtaggttaggtacatggacttgggtgtctgactgccagaatttgaatcctggctctgtagttactagtttggtgacccttaagttatttgtctgtgctttgatttcatcatatgtacaatggggattattaatatatgaggaacttacgagtttatatatgcaaagtgcttagaactatgattgccacatagtaagctaaaatatatgtttattatcattatttttatggcaaaaaatattttatattttatttaactatagcatgttatattttaagacaatttaactgttctttataagtgctttctagaataaaaatgatttattttgggctggttagattgcaaagtgttttaaattaggaacaatgtattcattaccttcagtgaggatagtgccctctggtggaaatgtttaagttacctctcccaggagaaacttcttatcactagacaccttattttttataagagctttagatgccgggcgcggtggctcacacctgtaatcccagcactttgggagaccgaggtgggaggatcacgaggtcaggagatcgagaccgtgatggctaacacggtgaaaccccgtctctactaaaaatgcaaaaaattagctgggtgtggtggcgggcgcctgtagtcccagctgctcgggaggctgaggcaggagaatggcgtgaacccgggaggcggagcttgcagtgagccgagattgcgccactgcactccagcctgggcgacagagcgagactccgtctcaacaacaaaaacaacaacaaaaagagctttagatgtattcctgtaatgcgacttgtaaatcaaaccatatttttattgcaagaggaaagacccattacttagtcatcctggagtgagtgactttgtaaaaacagaggattctttctgcaggttggcagatttgttgaacactgagtctaagtaaaatgaaataagctctgaaggggaaaattgcaaaaatatggtttttttttttttttttttttttttttttttttttttgcactttaattcaaatagccatctccagtttcgtctagcttaaaactaaaattttagtttttgtatttgccaaatcaggctttaccaatttggattctgtctgagcagagtaatggcctttaagcctgaattcccagacatatgcaataaatggaagaagaaaagacgaccttgggggactttagacttggctcactgcaacctccacctcccaggttcaagcaattatcctgcctcagcctctggagtagctgggattacaggcgcccgccaccacacccagctaatttttgtatttttagtagagatggggtttcaccatgttggccagggtggtctcgaactcctgacctcaggcaatccgcccatctcagcctcccaaagtgctgggattacaggcgtgagccactgcacccagccagaagtttgtatgttttaagtaggttgtgggccttccttactattaatacttactaaaattttaaaaaagagaataagagggaaacaaaagagggaaaaaaatagactgcctacacaggctctgttataatgtataaaacaatgggcttgagaaaatgaagcctgctgcagatcttagtccttggttagagtggtggcgaagtgggcatggaagtgggatggagggtggggactgttttggaagaacttgaagtcagaactgagtttctcttaatttagacgtttatgtattgggttatttaacctctgagtctcattttccttatctgtaaaatggtgataatgatagtacctatctgataacgttgttttgagtatttaggtagtccatgtcttggtacctgatgtatagtaagctgccagcacttgtattgttatagctattattgttagccagttgcctcatttttcctcccctttctggctcctgtgtaatcagaggaagatcctttgatatgctctgttagaaagccattccattcctccttcaggaagacccaaccatggttactgcaacttatatttgtttgggcacttttgcttacaaattgtgaaactagctggtgtggtaccaaaaaataacatttaacctcggacagcaattgtgagaagatgaagaggagcaagcttgtgactgtcaggtcattcacagagggagtttgtgaagagcagtcacacttctgagttctaagtgaagaacattttcccctctgcaagtagtgaagtgttagattttcccattcctcagcagacaaatactgaaaacatgcaacaacttaaagtagctccatattttaaaatgtttttaccaaaagaaagtgtcatgcttttttcctttctttttttttttgcctttttggtgataatcctagtgatcataaaccatggtgtgctgagctgctgtcacacactaatgaggctttttgttggaatgagaccctgacctgagatgctagtatccttcctgacagtacaggaaaaaataaagactataacaacttcaccagcctgcgaaccctagccaattcagaaacttttggtaaagtgcaactagagtgtattttcaatactataggaaatttttaaagttacatatacacacatgcacacacacgcacttacttacccctttgaagatgtgccatccaccagcccagagtctaagtcctccaggtctgtgtctcgagctgtacttcaaattataaacacatgtgtgtttttttttttttttcttttcagggcatacttttcaagacaagatggaaaatcttgtctgtgctcagtttgctaagttggcttgctgttctctctaggaagtatacaaagaggcttagcattgtatcaagagcaaataaaatagctaagggatatcgaagccctgggttgcttaaagcacttggaaagacatgctgaaagttcactagaagtcagatttctacttaggcatcttatgttttcctttttttccattagtttttttcttaatcaaatttacatggtgagttcacggcagacacatctggctactgtgatttttccagctctgatgttctcactgcttttggaactttgtggtttatgcagcatagattagcctaaagtgcaccggcacatacacgcacaaacccagagacaaacaaacaaaaaaatacccatacactttttgggagatggtggaagtgaagtgttgggtgttgtgggtgttgtaggtgttgtaggattgttgtggtggaaagtttgtgtttatggaagaaaaggaacactggtgggcacaggacagggggaaaggtttctatttaaaaatgattttcttgattaaaaaaaagaaggaaaagttttctaaacactgtagaaaatcaattttctttttattttgtagagattggggcgtctcaccatgttgcttaggctggtctcgaactcttagtctcaagtgatcctcccaccttggcctcccaaaatgctgggattacaggtgtgagccactgtgccctcaattttcttagattttgaggaagctatctattgtcaaatacactctagttaatcagcattattgaaggctaccttctttggggtttcgaagaggagattcttttttttttttttttttttgagacagagtttcgctcttgttgctcaggctggagtgcaatggcacaatctcagctcaccgcaacctccacctccccacaacctccacctcccgggttcaagcaattctcctgcctcagcctcccaagtagctgggattacaggcatgtgccaccatgcctggctaattttgtatttttagtagagacggggtttctctgtgttggtcaggctggtctcaaactcctgacctcaggtgatccgcccacctcagcctcccaaagtgctgggattacaggcacgagcacccggcctgaaaaggacattctttatagttcctttcttttacggtttttaaggaatatgtgaaatgagactgaaaaaaattaccaaatcaacggattgagttccttttatgtaataaagcaggacataatagcatataaaaaataaatcttatgttttcatggctatgttccacttatcttaatgtggatgagtctttattaagattaggtgatggagacttataggttttattatatgaaatttagaaatttaggtagaaaatttcttctttgataagaaataataaaagccatgaaaaatgtctgatgccacaattttccttaaaaaaaaaaagtagtatgctaggtgaatattttgggaaccatacacaaagatgtgttagttataatagccagtaaataaacaaatgcctgaaatatgaaaataaataaatttatttatttatttattttctgagatgcaatcttggtccgttgccctggctggagcgcagtggtgtgatctcggctcactgcaacctctgcctcccaggttcaagccatcctcccagctcagcccccgagtatctgggattataggtgcccaccaccacacccagccaatttttgtactttttagtagaggtaggttttcaccacgttggccaggtgagtctcaaacacctaacctcaagtgacccacctgcctcagcttcccaaagtaagtgctgggattacaggcttgagccactgcgcctagccacaaatatatttataagcagtgaaataatggatatagaccatgtagacacatggaaaactttgttgtaacattctaattttacacagcatgacaaattgtttatgctataattatacttctatttttttgaaaaacacattgcttagattctttccattttttcacaagactaagcttcttgaggacaggaacttgatctccatctgtgtatttctagccccaagcaaagctcattaggcatcataggtgtactcttctgtagaataaatgtgttgagtaagtcagttatgtatttttaaatgttaatagtgattatagttaagcctttgagttaagggtgattccctctattttctctgtaatgcggttatattacttttgtaatagccaaaaggagaaaaaaaaaaaaaaagagtgagaacaacaggggagaaccttgagctttttgtggtggaagaggagaacagtgtgttggaaaaaaggctccaggccccatgtgtattaaagacaaaaccaagaatgctcaggcctctgcagttgagcaagtctgcctgtggcaaatagattattcactagtctctaagatcagtgtttatccaagcgtggtccagatctaccactagctggatcacttgggggcatttgttaaacatacatttttagaatacagtggtttgtttgctcccaaaagaattatcctgggctgctgctaggaggaatatgccctggaaatttctgtgtcagtaaatgtagggtggaatctggaaaggtatgctgttttcgagtgctcagatgactctgatcatcagccaggtgtgggagccacaatcaaattgtgtatgttaaggccaagtgcagtgtctcacacctgtaatcccagcgctttgggaggccaaggcgggcagatcacctgaggtcaggagtttgagaccagcctggccaacatggcgaaaccccgtctccaccaaaaacacaaaaaaattagccaggtgtggtggcacacacctgtagtcccagctacttgggaggctcaggaaggagaatcgcttgaacccaggaggtggaggttgcagtgagccaagatggagctgctgcactgcagcctgggtgacagagccagactccgcctcaaagcaaagcaaaacaaaacaaaacaaaaaaagaattgtgtacgttagcacagtgatgggaaaatgccagtataataaaaatacaagaacctactcaatcgttcagtctttaatttatctgaaaaggacttggagtatgcccaccaactttttaactgattctttgtctgaaatagacatttactagggcattgacttttgtcattttggtgcttggtgttagtgcgcacatgagcattgggtaagtgaatgctgaagcggcttcccagagcatcttgaccccaaatattccaagtaaacttcaaaaatgaggaggaaaattatagcttgggatccagattcttgaaatgtattgtttaatccactgggtaaatgtacaagtctgcttcagttttgcttgcagagagtgggcctgagaatccatcaggccttcgtaagcctaaaccgtgacgaattccagagaagcacccccacacctggggaagagggaggccttttaggaaggtgaaggctaggtcaaacttgttttcttttttagtcctttctttgtttgcaccacattaattaattagttaattaattaatttgtaatggagtctaatttcttcaccgagctgtagacctctgttgagagttttaaaaataattttgacaattttcatcctgtttgctggctgacttccaaaagtttgccctcaggagcttccttgctatggagaatttcacccagttaagggtgaaaggcaggcagtgggattcgaggtggtttgtcattcagccacttgttccaaattgataagtgctgagtgatattttgacacttctctttgatctcctctttggcgtccctggtaatattgctcccgcctgtgtgtgatcatcacctctcccacccaggtaccaactgattgatttcttcttcctttctggaagtctaaatttattccctgggtgttttgcagttgctggtggtcaagaacagctgttcttccatgctttattctgaatagttctccaggatgaagtcagcaaaacaatatcatttaagtgaagcctcaggaaaacaaaagccttgattgtctttctccttaagtgctaaaaagaagatcacccctccccctttgtgtgtgtgtgtgtgtgtgtgtgtgtgtgtgtgtgtgtgtgtgtgtctgtattttaaggcagaaaaaaaaaaggttctaaacatttttgaagcagcaagattcaagaatgttatttttttccatattacataattgctatttggtcactgtagaaaatgctgattggcaaaacatgagaaaataaaaagccatggtaccattcaaaatgacactagtgtgttttcatatattttcttgactttcttcaatgcaaacataaaaatagttggaaactcctctatattcttttttgtagcttgtttttaatataccatgagcatcttcccatttcagtaatttttttttttttttgagacagaatctcgttctgtcgcccaggctggagtgcagtggcaagacctcggctcactgcaacctctgcctcccaggttcaagccattctcctgcttcagcctcctgagtagctgggactacaggcacacgccaccatgcccggctaatttttgtatttttagtagagacagggtttcaccatgttggcgaggccggtcttgaactcctgacctcaggtgatccgcccgcctcggcccccaaagtgttgggattacaggtgtaagcaactgcgcctggccagtaaatatttttctataatattttttgatgagttgttttaattagaaaagtaacacacgcatatggcaaaaaatccaaatagttccaaagggtatttatgaaaaattaggtctccttcccaccatgacccccagcccttttctcctttccagggaaacactactaccagcttcctgagcattattctagacatgctctacatacacatgcatgcttgggcatatacagtatgtctttttaaaacttaacatatcttagagagccttccaaattagtacttactgatttgttcattgtttgtcagcaatatgtaatgttccactccgttgagatactgtacttggtttaaccagtcctgtgtgctggatatttagtttattttctggttggtcactattactaaacaatgccacagtgtgcagccttggacataaatccttgtgccatatgctgtttatgtataggataattttgcagaagtggaattcctggatcaaagagtatgtacatttaaagtttttaaaactgttgttccatttctttccaaaaaggtataccaattgacacccctaccaataaagtgtgttttcttccccgtaccctggccaataatatctatgattaaacttatagcctttactattctgatagctacaaactagattctcagtatgttctttttttttaacttatgaatagacttggacatacttcttttgttcataaaccatcacatcatgttaatggctgcacagtagtccttttgtgaatttatttaaccaataatgccataatttatttaaccaattcttctattgagagacatataggttgattctattttttatcattataaatgatgtttcaatacattttcttgcacacacatacatttttgtgcccacctttaatttcctcacttttccagtttctttggaatgtttctgaataaaatataaacatttcttaaaaaatacaattttgacatggtttgcttttatcaaactaaggaattgtctaaagatcctggagcaggggattttttgcgggggggggtgttactttcttttaaaaaataatgtaacattaccacaaaaagtgtatttttaaccagccacctagctttcccactaactctgtttttcagcttgtatatccatatgtttttgactaagccataaatggaagtttcgttggaagttattttgcttcccagtacatgtcatgcatttcattccatattattttcgtccttttccttttcagtattatatttctcagataccagtgaagagtgagttgtgagttttgaattttgccaagacttaaatatttgcagcgctggaaagaaagaaagttaaaaaaaaattaatgtggctgatttagtcttggttcacaaggccttcatttagctgcttcaaagctcacacttcaaatgtcaagaaaaatattctcttaatttctgccgtatcaactgctgtaatgcctgaattaattagaatggaactataatttctctccaaatggaattggatcatcccatcctaacaaaacaaatgctcagggcggctccatgctggaggtttctggacaccttccctatatcatttctgcctgggtcactgcagcctagggctgccccttgggagacttctcttctgggatcctcagcatgtcttctttgcttgtgctttctcctctcctctgtgtctcctctagttttaagtacacattatatttttcctgcaatttgagggaatctcagtgtcgaaactacgatatattaaaatcagatggctttcgcctgaggcattccctatttcatatgtttgcattcactggtgccttctccatcctccactcttagcttgctcatttttcctcctatcaagaagacctaaatggagcaatgtctcagctctgaccctgggatgtaaggacctttcacaacagatctcaagcttgacagtcaactctcttggtgtcccaggtccttcccaagaaaacctgcaatttcctattctgggtgtctggtcctcaggggcagctatccagtggcgtttcttctgaaagacctccaaccggtctgttggggtagctctttgtcctgtcttcctaggctgtctatgttttaaaattagaatcatttaacagttggggttggggatagaggtgggaggctggaaggaactatgagtatgaggtatcagaattatgtagcacagattgcagctgggattctgttccatccaaattccaatcagttatcaaaagcattgtttaataggagtttcctcaaagttcaacagtgccacagaacaatggcccatacataacacagtttctctggtccctgccggactgagaattctgtctccaggaggtttgaggtatgtgtagagaggttttatttttttaaatgtcactatttattttgaaagaattgtaaacttacagaagagtttcaagtttagtctaaggaattcccatataccttttccccagatctgcctttgttaattgtttgcttataaacatagccacggttgcatctatccatctatccatctatctatctatctacatatttttttttctgaaccatttgagacaaagttggagacatcattctcctttacccagaaatacttatattttctcaaaagactttttctttttttcttttttcttttcttttcttttttttttttttttttttgagatggagtcttgctctgttgcccaggctggagtgcagtggcatgatctcgtctcattgaaacctccatctcctgggttcaagcaattcccctgctgcagcctcccaagtagctgggactacaggtgtgtgccactacgcctggcaaatttttgtatttttagtagagatggggtttccccatgttggccaggctggtctggaactcctaacctcaggtgatctgcctgccttggcctcccaaagtgctgggaatacaggcgtgagccaccgtgcccagctggacattttcttatataagcacagtgtaggtatcaaaatcaggaaatttaacattgatacaatactcttatctaatagcccagattcgaaatgtcttcagttgtcccggtgatgtcctttgtggctatttttgtttctggcccaggatgtgattgaggatctcacattgcatttagttgtcctgtttccataatctcttctaatttggaacaagtcttcggtccttgtgttctggaccttgacatttttgaggaatatataggccagttattttgtgaatcatttttaaatttggatttgtccggcatttcttcgtgattttggtttaggttataaatttttggcaggaataccatggaagtgatgttgtgttcttctcattgaatcctatcaggaggcacacgatttgttccactataggtgacattagctttgatcacttgatgaaggtagtgtctatggaaggtggggtgggggcagcagagcatgcttgtgccaaatggctcctctaatgaatatgttctgtaaagctaatgaaatatgtggaaaggctttttggtctaccaggtctctataaggtatggcctaaaatcatgtaaactcttcccctcgggatgactaacaagtaaaatttccaacctgctcagttaagcttcacagaacattatttatttgacacataatatatctgtgcagctatatacacacaggtaggttttttttttaatttatttacaaaaggtaggctatgtttattagagtcacaagcagttgactgtctcagtgtgactcaagaccacaaaaaacccatttctccttcacttcattctgagtcctagactggcaggtgtactgcttggggcccattcacaggtttacaagtttctcattgagggcaatctgtgactgacacacgagtagttttaaaatgaaattatgatgcttccattcatttgttccctactcttgcatcttaaaaaacatataattcttttttttttttttttttgagatggagccttgctctgtcacccaggttggagtgcaatggcgtgatctccgctcactgcaacatccacctccctggtccaagtgattctcgtgcctcagcctccccagtagcagagactacaggcacacaccgccacgcttgtctaatttttgtatttttagtagagatggggtttcaccatgttggccaggctggtcttgaactcctgacctcaggtgatcctcccgcctcagcctcccaaagtgttgggattacaggggtgagccactgtgcctggccaaaacatgtaattcaaaaggataaaaataaataattgaattaagttggggtaaaggactgtggctgagaaaaaaagccagggaaaaaatgcataccatggggccttgtgtggttgctagaggtacctacagatttggctgtgagattcctgggggatcttgtaaagaagataatatgctctgttataggagtcagatcactcaagagataaaggctttcatggtgttgaagagaaatgtagtttttctagacacagagatgtaagagggagttctcctgtacttccccgtaagtcatctagactctgtgatctaggggacaatgtccttaaaaaagaaattacagtagtggcctggcacagtggctcacgcctgtaatcccagcactttgggaggcccaggcgggcggatcagctgaggtcaggcgttcgagatcagcctggccaatatggtgaaatcccatctctattaaaaaatacaaaaattagctgggcgtggtggtgggcgcctgtaatctcaactacttgggaggctgaggtaagagaatcgcttgaatcagggaggcggaggttgcagtgagctgagaccgtgccattgcactccagcctgggtgacagagtgaaactctgtctcaaaaaaaaaaaaaaaaaaaaaaaaaaagaagattccagtagggaacactaggagttttatggggaagttttctatagtctttttaaatactgggtagtggcatgatctcagagcaccagccagtgttcacagaagaccaaaatgagtgtatactacatatgcattttgattcaaggataacatttagaaaatccagaactgtagtttttttgttgtatgttttgttttcatttttaagaaggaagctccttttgacacaccttctcaaataaaatttagagctacaggcttttattttgttttgcttgggatcagaatctcctctttgtaagtgtttaaaagcagagctgctttggtttctgtctgttcccccatccttgccccaaaccttattcctttccttcccaaagatcctgaaccactttacagggctgagagacaacaaaccgagaggcattgatcccaaggagtggcctctttccttcatggtttgtttgtttgtttgtttttgagacggcatctcactctgtctcccaggctggagtgcagtggcgcgatctcggctcactgcaacctccaccttccgggttcaagcaattctcccgcctcagcttcccaagtagctgggactacaggcgcgtgccaccatacccagctaatttttgtaattttagtagagacggggtttcactatgttggcaaggctggtctggaactcctgaccttgtgatctgcccacctcggcctcccaaagtgctgggattacaggcatgagcccctgcacccggcctgcttcacactttttgactcacttcactgtgtgcccccagagtctctggatttcttcagaattttaaattttaccatagagtgtgaaataatctggcagtttcccatgcagtccaggcagtcagctggaaggagatttctatcagtctggaatagaggccaaccacagtgctcaccacaggcaagaggcctcaagggacctggtcccggcccctcaccctctgctcctcagccacatgggctgctctgattttgcacaagtactccaagctcacagtttccaccttaggatctttgtacttgtcccccaccctgatttccatacttcattcagatttagagcacacatcactgcttcacagaggcctttcttaacttccctgcctaaaatagctccacatttctttgttcaaatcccttatcactaaaattattctgtacatttgttatagcctgtcttttcgttagacgataatctcctacagggcagggaccttgctgtcttgttcatcattgtatctctacttcctagaaacaggggaaatgaatagctaggtgaaccgtagatcattggaaagaaaaaaaatcatctatagttctataagcgaaacaccaccactgttaatattctaatactttttcatttcaaaggtaattaactttttgggggtcactagaaatcctataagatatatgggtacagtcctcaatgaaatgcatatttatacaggtttccaaaatttggcatatacttctaccagatttcctaatcctgttacccctggttacattcttctttcgttttttttttttttcctgagtggtcctggcccaatgcaaagcacctaaaccacactattgtttttgcttatttgattgctgaaaaaggctgtttctttaatttgcattagtgtgattccttacgaagctgataatttgccatattttattactaattgcatgttctcttttatgaatcgttcaagtcttttgactacctcttggaatcttagtatctgttacatgatctccataataaagatgtttactaaaagggcatgctattaaaaaacacatgcacacattaaaaactagcaactcacgctggcaacttttcttccattccgtgtggaacacagctgtagattcgttttctcttagcttgggcaactgccatacttcgcacctggagtagttttaaaatgattcaggaaagctaaccaataaaaagctacaataaactctctactgactaaagaaaaataaatgcatgaatcagagtttccatttcctgctggataaaagtatacctattgtctgaagataacaaaacagttgtagttgtactgctattgcccaaccatggaattatattcaaaatcacaaggacaactttgtgaagcagcaaagtgaataactaaatttcctctttttcacaggctagataattgtttttctaaattcactaactccatagaggtgcttcctgccacgggccacttgtgataaatcttgagatatccctgcaatcaaatggagtcagagtagcacattctgatgctgctttaggtggaagaaagagttctttctttacaggaaaaaggatccagaagaaatcagcctgccagaaagatgtgatttttttttttccctagacttccctggatatattataatgatgagaactaatgtctgaatcctttaaatgccaataaaatatacatttggggtaatgcagttattatgaaaatataaaagccagtgttacaggcatttctattttacacctgaaaaaggagagttgcctagatacttgcacactggtgtgtggactacattattgtttggatgggcaggcaggatagcaagtaggaaaatcatttcctggtgctaaaaattcagggtttcctgtgaagtaaacgaagcttgggttacaagtctaaaactagacaggcttggggcatctggaggaccggaggcccatctggcaagctttggggcacctggaagtggttttaaggcttgaaacagtgaagctgggaaagtgtggctgaatcaacatatattccagagctctgtgccttatcaactgagccggctgagaaatttccttgcagttattctcacccagaattggaataaagggctcagtgtgaagttgggatagtacaacttctcggtttaatactttacagatttttggaaccaaatgcaccctgaagtgaaaagctgctttttttttgctgaccttgttggatggctaatactgtttctgggaaataagagaaacaagcggctcattgttggcaggagctgagagagacacaaggagggcgagagacgcgtctgcagccctttttttcccttcattgtatcgtgactgagtcaaggctggattgtggctgggtttttcttcctacctctgtagacatatgttttccatcagacagggctgcgtgacacctgacgttggccagttcacatgagttaagccatggacggcgcataaacagaggaaaagacccgcagctgcacccagacactcttgatgctgaaatatttttcaaagcttgatgtggctgggtctgcacataagtcagaaacgatttacacctgtatgttttggcttgcttctttcagttgcatatcattattcccacaaagcctctatggccagaaggtctaccattggctgatggcagcacctctccttcccatatataagcctttctaaattatgaaatgtgagttttcaaagtttatttgatttttgtcttttttttttggaggattgaagaacaaaatgctctaccatttctataaagtgaggtcacacaaatggtgtcatcaaaacatgcgattcacgttgatcccatcattttaaagtaaataagttaattaaaatagtctgttagactttttcatgaaatagggaaaaggaaacactacttggcctcatcaccaaatttaacttatcacgtatattttgatgactacgaaaaaggattgggcagtgattggtgatccgttggtgatcattgggcagtaattggtgatccatgcagctgatgccagctgtagtattctagcaggcgttccgggtttcctaggtttgtcgcagcctgttcctgagatctgggctgaggcatttaatcttccaatattcttcatctctaaaataactgaattagtctaaatcattggttttaaagtctgtcccaaagtcccatgctagaatctcagggggatgtgagcagaagctaaccttagtgttcagtttccaaaagctgggccctgttcaatgtgttttaaacatttgtttaaagtttcagcatgacacttgagaaatgcctgaagggaaagcagagtgaaagcaagaccaagatgatttagagaagacagtcaaaggtgctgactttaagtgctaatttcctcagctgatgaaagaaccctgggacataaggatagcctctgcttcaagccgtacacttggctctggagaaggattctactactaaagaaaagtttgagaaccattgctctaaatggactaagacccttctatcctgaatttctatggtgatagcacaaactcgggtaaatacatggccctcacctataatgagtgctgtggggaaagtgatgagtttgtaaatcatgtgtgaaactcagaatgaaatggggctaagcaggcaactatgctctggaagtaagaggaagcagcaactagaatgtggtaccctttggatattcccctatgaaactctagaggtaagggttaaaatgcatcctctagagaagatgagttatgggtgaggcgttgccagtttttttctcagttctcatcttgattatgtttctatttgaaatttaaaaagcctatgatgatcatcttgctataaatggaactgatattttgttaccaatttctaacctcccttaaccttactttggggagaatgtatttagtgcctactctgtgccttaatcagatttgaaatgcactaaaattatttttgttccatttttgtaagaaaggaagatccatatcattgtgattggtcctgaggggtagggggagactttgctctttcccaggtcttgtttataaagagcacaagtccaggaacatgagagttagttcaaatcacaggaagagaatagttcaatgtttcttaaaagagctttacttcagatgtatggctcaaccaggagtccaacaggaaaggttttcctgacttttgcatttaaccaagtgcatgtttatgggtgatataatgcagtcataaaataaatgtcataaatagtgcttgatttccttcaaaaattacagacaaaatgagtatgtaatattcccattccaattatcacataatatggatacaaaaggacaaccaccaatttttaatccaaggaggacacactgacagctaatctggatagcctgacagttctgaataatgaaaggtcattttgtactggctcctggttctctttttaagggaaggcattagggtggaaataggaaatttgagttctgctgccctgagttagccctaggtctatggatggccataggcctggagtgaaaaaccatcccatttgcctgggactttcccagatttagcactgtgacctgtgttctgggaaacccctcagtcccaggcaaaccaggataattggtcaccctctgtgacagagaagaagagaatgaggtgattgtaaagctttgcattctaacttttggaagcttttatgctcccctctcatgttgggtttaggttcctggaaagtgtttctgatgaagtttatatgaacttactggcccaaatatcaaactgaattaaacacttgttccaaggaggaagtttcccagatgccatatcaagtgtattacccagtgtatgcctttgaatgttgcatatttacctattttgaagagactgcattcaagttttaaaaacaatgtcagcctctacctgttctactcttttttttttggagacgaagtttcactcttgctgcccaggctggagagcaatggcgtggtcttggctcaccgcaacctcctgcctcctgggttcaaacgattctcctgccgcagactcccgagtagctgggattaaaggcatgcaccactatgcccagctaattttgtatttttaatagagatggggtttctccatgttggtcaggctggtctcaaactcccgacctcaggtgatttgcccgcctcagcctcccaaagtgctgggattactgcctgagccaccgtgccggctttacctgttctactcttaaaggatgatgttagaagtgttatttggaatagttgatgtggttttattatagaagcaagctttttaaagaaaaaaaaaaactaaaagatagataatttggaatatatgtaactgaagttaatttagcaaggctttgctaactacctgtgaaaactgatacggaagttaagccatctttgaaattttctttttaaatcatcacgtgcttatggaaaatgtcagcagatattcaagcagtcttttataacccttgcttttcctgtattttgttttgctttgtttttctattactctgtatcttgaacagcagtccctcattctaggcacatgaaactgctttgttcaacattccctgtccgcttttttcccttctctggctccgtgtcctaaacagcttctttaattaattttaaagagctaagcacacagtagggacttaatataatattcattcatatttaatttataattcagtactctgccaagacatccactgagttacagtggaccagcatttcctagtattcctatccagaagaatatcagccttgcaagtttgagaaacgagttgttgaattcatatatctctttcagaaagtcttggtaccccctattactctaaagactgacaaatcttccaataaaataaattattttaactttctttagcccaacatttcccagtcttattagaccagggaacacttctagaagcaatttaaaaagttttagcttaatatctatttattcccctgggacacattatagaccagattttctcttaaagattgtgtccatttgtacataccccaaccattgactattaaattaatattgactattaaaaagagagtagccagcaaagttcctggtattcactgggcacgttaaaatttgctgtttttcaaaccagttttagttttatattaaaattgagaagagagttcctatacactcactcacccagtttcccctgttgttagtgtattacattaatatgctacatttgttataattagtgagccagttattattaaatccatactttattcagatttctttagtttttatctaatatctttttctgttccagagtcccatacagaataccaaattacctttttgttttgttttgttttgttttttgttttttgtttttttgagacaaggtttcactctgttgcccaggctggagtgcaatagtatgattatggctcattgtagtctcttcctcctgggctcaagtgatcctcctgccccagcctcccaagtagctgggaccacgaatgcatgccaccatgcccagctaatttttaaaattttttgtagagacagggtctcactatgttgcctaggttggtcttgaactcctggcttccagtgattctcctgcctcggcctcccaaagtgctggcattacaggcgtgagccatggcgctcagcccccattacctttactcatcatatctccttaggctccttttggctgtgacagtttcttaaactttccttgtttttgatgacctcaatagttttaaggagtgttgctttcgtattttgtaagatgcctttctattgaaatttgtctgatatttttctcttaggtagactggagttataggtttttggaggaagactacagatataaagtgttattctaattacatcacatcaagggtgcacaccattatcatgacttgtcactgttaatgttgaccttgatcacctggccaaggtagtatcttccaagtttttgcacagtaatgttgccccccaactcccatcagccaccactcattcaatcctgtgttctttggaatgaactcactatttgcagttatgttgcctcccatccccccggcctttgagcatggtgtgtctacataaatgattttgaattcctctgtaagggagatttgtctctccttcatccatttatttgtttaattatctgttcatatgaatatggatttgtggaaattacatttttagtaaactaatgaaccacagtctacagcctgtgaaaactccctattattgttggaaccgaagtactgttaggaaataggtgctggggatggaaaaagtcatggagggcttggggaggccttacccattcacttaaatggaattgtgcctctgacacattaacaaaaccacatattctaaaaaattcacctcaaagtgccaagagtagagatacctccactgagaagtttgttgtcgaaaggagagaggagggagatacaacaagaaacgcatactagccgaagatattcttcttcaccttccaagactcacatgtgaactgaggagaaggatttgaagggagccaagtaatttctgtgtcttcctagcacttaggtgtgacttctagccactgggcgccagctgttctttccatgatctactcagagccagccccttgcaggcctgtccgctatggttttcgtagttgagcctacccttatggttttgttttcttcacttggcattgtatatgtgtatgtgtgtaactaaaacctattttaaaaatgagggaagcaagcccaggacatagaagagcaagccactgaaacctgccgaggccaaaaagacgtttgtgaaacattccaggaggtgctctgggcagcctctgattcactggcctccctcatcgtctgcagctcctggcttagggaagctgccaaaagcactttctctacgagctgtggctctctgtttcctggtgttgcaaaaggcaaaagttcaggattgaagcctttaccttttccatgtttgcttcttatatagcaaatcttgtgctggcttagaattgagtccgggcgactttcttgccttgagcatacacttagagctttgtagaaatgaccaagtgtatattgccccaggcagcactaaccagagggtcatgtcctacgtaaataaccccaccccccgccccattcccgtgttgactgtttgcttcaccaaggacacagtcattgaatcaaaagtgtgtttgtatctcagatgccttggcactggcggttttgtgtgtgtgtgtgtgtgtgtgattttttcctttatattgaataatgccaattaaatgtttctggtcacacatctgcagagcatggttttatcaatttccaaacacagaagagaaagccaattattaaaaaaaaaaaaaagaaaaagggaaaaggagatgaaaacaatgaaaaagaaaaagataaatgggaatctaaatttaaattctgactctcttggaaggaaaaacaaaaaagatgtccctgctttagctttgatgcattcctgcttctatggagaaatcttctgtttgggttattcctttctggggggactggcaacggtctagagctgacgaggtctttagcctttttgaggcagtttgtggcagtctgcccttaatccggcttggcctcagatactgcatttggaatactctgccttttcttttctttttttttaagctggagtttcgctcttgttgctcaggctggagtgcaatggcgtgatctcgggtgactgcaacctccacgtcccgggttcaagccattctccctcctcagcctcccgagtagctgggattataggcacctgccaacaagcccagataattttttgtatttttagtagagacggggttttactgtgttggccaggctggtctcgaactcctgacctcaggcaatccatctgcctcgacctcccaaagtgctgggattacagacgtaagccacctcgcctagctcttttttttttttttttaatggaactattgttctctccctaaaatgttctggaatattatcccaaggagtattttgttcatcacaaatttagatgttttgccttcccatgctctgctgaggactttgtttctctttttctctgccttaggcctcctctgccctcagtgtcaaaagcggtggttttaaggaacctcaaccacaagtgaagctcatgagctccagtgtcaatgatggttcagtatggtttgaaattaaacaactagagggagcatagtggcaaggtgaatggtgggttcctgggttgagacaagtcacctggcttctaggataccgaccggttttatgaccttgataaaattcactttctctgagttttggtttcctcatctccataaggagaggttgcaccaagcagactctcagctttgacagtcttgattatatcctaagctgtatttgttgtttttcagataatttggggcttctttctttcactctaccaacaaaatattgagtttgaagcttacatggccatgtttttgttttatgctttaaaatttttattttcacttatgttttacattaaatgataaattcatgtgggaaaacttaaaatagtacagaaaaggaaaaggaagatctcccatccctgatacccagtttcttctgccgaggtgctcgctgttgccggtctcaggtgtgcccttctgtggagatttgctgcacatgcataacatgccccaccttttctaaccacaactagtaacatgctcataatacagttctgtcctttgggtttttccccttctggacgatctctaagaaacattggaatcatcatacagaatttctctaaatgggtggaccatatctcccactgatggacattaagatcatttttaatcttttgcaattataaacaatactgttttgaatatccttgtacaaactgctctgttgatatgtgctttactttgaaaacaaagctatcatctaagttccacccttttccagactctacagttaataatgagagatgtttagtctgaaagatcaaatctaaattaaatggaagaaaccagtgtttccaccattacctcctgtgaatgtctcaagtaggggcaagtgttttaaagactcacatagatgtggcttgggaagagctcctctccaagtctgaaactcctccagattaggattcaggtattaataaaatctgctgagcaatatctggttgctatgtggctttcagtaatacagtacactgcttgagagtacgcccaatgcagcattttgtacaccgacaagggcagtctacctaagtgactgatgatagtcctactagaatttgttatgtcagtaagtcacctgagtcagttataaaattttccaaagtatctaagttataaaaattaacatagggctgggcgcggtggctcatgcctgtaatcccagcactttgggaggctgaggcaggtggatcactcgaggccaggagttggagaccagcctgccaacatggcaaaatcctgtctctactaaaaatacaaaaattagcggggcagggtggcacacgactgtaatcctagctactcgggaggctaagacaggagaatctcttgaaaccgggaggcagaggttgcagtgagccaagatggcaccactgcactccagcctgggtgatagagtgacactctgtctcaaaacaacaataacaacaacaacatagggttaacaacctgtgcctttgaagccttgttttcctaacctgggtatttctgatatcagaactattgggcatcttttttgtctctagtagttgtgtcagatactaccatattaaatataactactagtaagaacatacttttatagaaggttcagaaatgcctgttccttgaaataattatcattcttccatctgcgcctctcttccctggcttgaaataggtttcatgaattaaacccttctggatgtctggattttgtcttacttgaatctgtacttaagggaacttttcccctgcgacaccatctgtgcaaaaccctttacctcccaccccaggccttcaagtagaagttgtaattatactataacaagctctagaagtgaaatactcatctcaggttttttggcatcaatcatgactgtgctttttctcttgttcttaatctaagagtgtaagaaatgcccaactgattttattcattcatcagatcgtttcctgagctttccctgtgtacctgggattgtgccaggaggtgagagtccttggtggcaggcttaattctaagggggaaacctaaactgtctaggcaatatacactgatatcttcccttttactagcatgttattgggcccagagttgtaaatctatccaggctttcctcgagcccttcctcttagtaacgcaagcaacatttgggtccctattttgatgacctgctgtgtgtgtggtactttcttgcaaacaattgaaggcagattgtctttacagggttgctctgaggcttcagcagttgttcctcttcttcagtctaagatgtgacagaaggtggctagggacagttggacggggtacaagaggatctcgattttggtcttggctctacttgccactaaccagggcacatcccttaacctttctgggttacagtccctattccataaaataaggggatggactagataatctcccaggttccttatgtagcctaacagtttcatgttccataagccactcataaaaatccatctcatttcttcacacctctcttccaccagtccgttagttctcatgaaggcaggagctatttttccaagtttaagcccagtgcatgacacgcagcaggaattgcaataacaatttcagtgagcgtatggacaaaaaagaacatttttatcccaccctcacctccatcctggagaaatctttgccattgaattcttcctcaaagaaatctattcttctctagaaaagcttcagtgttggtattgtctttcaaatgtacatatatgtcgttcaaatatacacatatattatacatttaatacatatatttaatatatggagatttgggctacttaaattcatttaaggagatttacttgtaaatcatatttctacataatatgcatagcaaactgaagatgaaaagtatttaacttaagccaccaggcgtggtggcttccacctgcaatcccagcactttgggaggccaaggtaagaggattgcttgagcccaggaattcaagaccagcctaggcaacatagtgaaacctcgtctctatgtttaaaatatatacatatatatgaaatattataaaaaatatacatatattataaaatgttttaaagttaatgataccaaatatagcaaaaattgagaatttttttctcagaaatgaagtgagtatataaaattataccttgttttctttgaccctgacctaggaggaaatagactgaaaagcatggttttctttattacatgacattgcccagcagaagttaagcaaatttgactggtaaacaattttgagaaaaactagcacttttataaatgcatttttgcagaaataccaattataaaatttatttaaggattttaaaattatttttgtaaagtgaagttctttttttttttttttttttttttgagacagagtctttctttgtcaccaggctggagtgtagtggcgcgatctcggctcactgcaacctccgcctcccgggttcaagcgagtccctgacctttgcctcctgagtagctgggactacacgcatgcaccatcatgcccggctaattattttgtattttaatagagatggggtttcaccatgttggccaggatggtctcgatctcctgacctcatgatccgttcgccttggccttccaaagtgctgggattacaggcgtgagccactgctcctggccgtaaagtgaagttctatatgctgaaatttcactggttgttaaatgcagataaatagagcattttaaaaaaattgaaaatatttctcatgcgtttatccaggcacaacatgtttagcatttctgcataatttctttctcactaatttctccctttgaagaaacaaacatttttttctcagtcagatatttgttcctgagtttagctcatagctcaggcttccttgcagcatgcttttcaaacaaaggattaatggagtcctccttatatgtcggctcctgatctaggtgctttgtgttacatgttgtttgtcaattcactggtttgtgtaccaaagatcacatgccctccttacctctgccataaacacacaaattaactgagaaagtatacacatgcacacacacacacacacacaaatgatctggtgaaattatctcataacttgtgataacctttgtggaatttgctttagaccactatgttctatgtaaggcttaaaatgtactctagacagggaggtgtgaaatgagattttaacagaaacaaaagccgaggctagatgagtcaggattggggccagtattcgagcctccgtgaattgaattaaggtaataattacttaaacagtaatggttaacaggaaagtactttggaaggaatctcaggaatctatactccaaagcagaaaacattctgatggtctatttttgataaggtattgtgggccctggtcattaatctgtatgttcttccctcttgcagtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggtatggctttccatggtgtctggtggaggctccctggccttggtgccaaagctgatgggtaggtagctgcttaccttcagggtaattcttctagagaagaagagacaatagggctcaaagccctactccaagcctcttgattaaaatccagtttcttctctcagtgttctgcctgccttttcagaacgaagcttaagggtacaaggacgagctgtattagcatggctgcctttggcttccactgctagtctttagaaggagagaaaggagaaagtagagagacaagagtctgttgttgtgtaacaaattatcccaaaatgtagttgcttaaatagccatttcattatatcgcacaattttgtgggtcagaatttagaaggggctcacctgggatattcttctgctctacatggcattgactgaggtcatttagtggtattcaactggtaggtgggttggtctggatagttcacaatggctttacctaagtgggtggcatgatggtgaggattgctggaagactgggctaagctggaacaaaagcctgggatctatggtgtggcgatctcagagtagtggtactcattccatagcagctgggttttcaagaaaaagcattctaagagacaggaagtagaagttgccaatttcttggggcctagctctggaaacggtcgtggagtcgcttttgccacactctcttggtcaaagtagtcacagagaaccccccgagattcaagcagatagtggagtggatgttcctcagaagaaatgacaaaggatcttggtccaccacagagcatgaaaaagagggaagctgaagggagaatgagaagggaaagtggtttgtatatggactccaacagagtgctctgcaaaactgcctgggcatcaatcaggcacttttgtaccatactccattcattcagttttcattccgtcagtcaggagtgtgttgccgtgtgccctctgtgggtcaggctcagtgctgtacttcaaaaacgaatacaagagaattcctaaaagaacccacagtgctctccctgtttcagtggcttggtctatggaagagcagaattctttcttctgtgttgctaaactaatataacccatgttttcaggtctcatgctttttttctggctacatttttggggagaaaagcttcagtttattgttttaacttttcagactttgttttgtgactcacatgaagcaagatacatgaataacttccttttgctactttagagaaattagagaaataagtagttttaacattccagagaactttcttggaggaaaggaccgagcatgttagggtaaatgctgtttttttaaagctacatttgatactttcaaaaatacacattgacttccatgaatgaataatgtatttctcatcaaatacattccaggatataagaaatctatattgtgtgaggtttaaaatgcatggtaaattaaaatcatttctcagatatagtctttgaaaataaggaaaatgaatataaattgtgctttgttgctcagctgaactttcctccaaatttgaggaatacaacttaataattaggtaactacagttgtgtcttttaccctgaggatttatgtttgaactttcacggttatttcaggctaacggttgtttatactgattttagatatatagtgtcatgtttcttgatgggaagtaattgtattgttaattgttttctgtctttgaataataattttatttggaataatttttctgttttataatgtaaggtaaattaaacagtatcccaacagcattttatacattctcagttttatacttaaatgagctttagtgagttttttctttacacaaagttgtgaccattctgcaaagaatgacttgcttctctgtttttgcgggtgtgtttctctttctcttgcttctcctccttctttcccacagaaagtatttctgaaaaggggtgggaaaagtgccccaaattgtttcctttattccagctgtaggtgcctttgaaccaggatgtagtactgatggttcatattacagaaatgccaaccaagttccttaaatgctgatccttggaggctgtggaacgtggggcgttgtgctgcatcatagtgagcaattgcattgttgcattgtatatgaagcaggagaaaagattgtccagatttgctcacagggactcatgtagttcagccttgactctgtgtgtgtgtgtgtgtgtgtgtgtgtgtgtgtgtgtgtgtgtgtagttaggaggagatggaatggtggagtggttggttctggtgttctgatgcctttttatttttgttagggagtacaggaaaaggtctaaatagactttttaatcatggcagattttttccccatgcagaagcagcatgctcctgattgtcaaagatatgatttaagaccatataataaatggcattggagtgttctataatagttttctggggcatttgccaggacacctgattattcagtattcaggtgtgggctctgtgtttcatcttggtggattttttgaactcttttggtgattttctgcttcactttttgaacctaagccatggcagcagcagggaaatggactggaattaaaagtgatctttggctcacttgtttagttgccttccagcatctggtaggaatttggagagatgggggaagtggtggttctggtgaaatttaaagattatctgtacacttctgtttgttctctctgtcctacccctatgtcctgggtagtcaacaactgcctgaatatcccttgctcagtggacagtttgtaattacactggctctcctcttgcttgtaggcggccttaattgtacagcctgtcttcttggggcccaggccctgcaggtaggcctagacctacctgcccttctaccaactgagcctgtctgggagcaaggccccaggctatgctctctttctgtagtagaaagggaggttggcaaaatttaataagtagatgaatttatcccctaattactaataaattatcacgctgtctatagttttatcattcttgaatgatacgacgaatctgaaagatccctgtggagaatatgctatataaatattgtttcatttttcttcctgttccttctgctatgccgttgttccactaggcatatagtttgatgatgttgtgccatgaaaaaaacaactccttggtccttgttgcatgatttgatgtataccacaatgccaaagggtcacctattaactcattggcattgaaatcatgcgagaacattaacaaaatggatctgaggaaactttgattacaaatctaaagtgagccttcattatttcagtatggaagctcatattttttttccttccttcattcctttatctcttcattcattcaatcaatatttatttagtagaaaataacagacaggtaaatgggatgtgactgccttcagataacttgtatttttgcagaaaaggaaaaataattaactttaatccaagttaaagaccagaagagtaaattaaaaccattccctgcttcacaggggcccagtggctaccatctttgactttcattactggaactgagaccagatgcacctgagcagagttctgtgaaagtgagcatcagatactcctttttctttccagtgacccctcaggttactggctacagaattaggatcaaaagagccagtaaggtttggtatctctgctgataaggaatcttctgaagcaggagaatttccttaaatgcagtccctccaatctagcattggctggtgtagcaacagagctgagctacttgtatctgataattgatgaattatcttggaatgcggcagacacttcaagtggaggggtaccaggaatctaacatggaagacataaagagtgcatttctgtgaaaggaagtcttttgtctgtgatagagttttcttttatttttactgaatttcccaaaggctgtgaggctacttcaggttcaccaaagaaatggcaactctagaaaaaaaaagcaattcttattgaagttttgctttctcttcatttttttaaggaaattaaaatttgatttgttgagtttttttaagtagaaaaaaattttaatttttgactaagcgtggtggctgacgcgtgtaatcccagcacttcgggaagccaaggcgggcagatcacttgaggtcaggagttcgagaccagcctggccgacatggtgaaaccctgtctctagtaaaaatacaaaaattagccagacataatggcgggtgccggtagtctcagctactcaggaggctgaggcaggagaatctcttggacctgggaggtggaggttgcagtgagctgagatcgagccactgcactccagcctgggcaacagagtgagactctgtctcaaaaaaaaaaaattaaaaatataatttactgagttactttagtgattagcatttaaaaaagtgtttttgctaagtgcaagaaaccagacttccccccaaaactacatcctgtatgattccatttatgtgacgttctggaaaagcaaaactatggggacagagaagagatgagcacttgccagggttgacagtacagaaagagtagactccaaaggggcagcactgaggaattgtggggcagatggcacagttccgtgtcttggttgtggtggctatttcacagctctacatttgtcaaaactcagacatgtataccacaaagagtgaattttactgtatgtaaacaaaaagaataataaaagaaaacgaattgctacacacaaaaagacaaaacgtatgtttatggtacggaatgtataaaatactaaacaacaaagaaggaaattataatcacctatactcttacctagaaagagtggctgtaaatatgctgatgatttctttctagtctttttgtatgtatcatgtgtatcaatgtgtctactttgttttttaaaacacaaaagtggtagcatactttaatactgctttgttgcctcttcttaatatattgggaagtcatttttttattctgtgtcagccatgaagttgtgctgtgactttgtatgtacccattccaaagcgcctagaatcctttctacaacaggccgtacataaatttttaaatgtcatgagccacacacacccacaatgactacagagtattctgttgttacaactgaaaaattcaacgcaatatttgctcagtatcctaaaaggcacaattgcaactttaccaaatgaagtgggaaatcgtagtcacaggtcagacattgagaaacaggcttctcaatgcctgtttatctaaaagaacaattccttgacatgaaaacaggcatatggctttacctgaagagagtatttcttttcatgtgtgttattcatttaaatataacggtttggggccatctttctggaagattttaacctcgaggaccaggacctggaagacgagtaagtggcaaagccttggctcccccttgtcccttcacgggggctgccttgtagagaaatcattattcccaaagcaaattcagccctgcttttaccctcaaccttttctttctttttttttttttttttaatttgggggttgggggacaggagaatgcagtttgtcaaacaaaaatgctgactaagcctggcctcgggtcgccggggcaacagggacgagaaaagagggaggcctcggaattcttttggcaggtctgtgggatttctgccaggcttgacagccaccaggcgcggcgggccagctggctgacctcgcacagccatcctgacagagggctcctggagggggacacacctggctgtgagcagcactggcctggggaaggttctgaggcccccccctttttttttttgtcatgcaaagaatagctatttagcgagctaggagagtgtcgtattggagcagatcatgaagcataaatgtaggctatttcatagcctttgcttcagaacaggggactatttaacttttagaaaagcatttcatagcattaggtttcagagttgactgggttaacagaggtcacgtagtctaatattttgtgaatctataaatccctccatataagcttggctatttaagttcattcgttcatatatttgttttacaaatgctctaggcattaaaagtacagctgtgaacaacagaccccagccccttccctcacagagcttccattctagcttgtgtcaagcgttttatttgcttacatgtcccagaaataatccattttccaaaatgtcccagtgtgcccttgttgttgaacaatagtatcaattcaagtctttttttttctttttcttctctttttgagacacagtctcacttcatcacctaggctggagtgctgtggcacaatcttggctcactgcaaccttcacctcccaggttcaagtgattctcatgcctcagcctcctgagtagctgggattacaggtgcgcatcatcacgcctggctaattttttgtgttttagtagagacggggttttgccatgttggccaggctggtctcgaactcctggcctcaagtgatctgcccaccctggcctcccaaagtgctgggattacaggtgtgagccactgcaccaggcctcagcctttttttttttttttaagtgaagacagacgagtatctaaattataatgttttctttaatgtgatttgaaaggacaacagaaaccagttgtggaataatacaaatttgctttatgcactctgagtaaaaagagcaacaaatagaccatagataataatgacaaacttagtaaatggcttcctaaaagtatcgcagtttcgattgttcttttgtagggacagtctggcagctgagcattagtgatgagttgtttcaaaaaggcagtctccgggaagtgtgacagtgcattttagaatcccttggcaccgaattaaaaagaaatatacatcagtaatttttttttgttccccccgccgtcccccgtaaagaaggtaaataattcggcattctctctctgaagtccctcagggttttggcagagaaagcaatttctctgcatccagaataactattttaatgttaggatttcaaaatactgtctttttttttttcattttctttctactcaccccaccctttataattaaaacaatccaatcttccatgtttgtagagtccctggccacacacacttaaatcaagcagagcagcctctgaagagctgattgtcatttgtttcccttttgaagtgcattctggtgagggcaggagctggctggcagagtgttccctcagccaaggcgggacagagctgcagatgctttcagctgccgtttactttctcacctcctctgttggtttattccacaggcaagctgcaggccaaggacctagaaggagaggaggtttgaggtttgcttcctgggacaccttcagctcacaaataatcatttgtctttcacatccttacttcttcagctattttacacatcacccgtcctccagctgctaggaaagggtattttttagcccataaataattactcacttcagagagctagatagttgaccacaaactcaccaagagattcttgagcccttattttgcaagtctttccaccccaagcttggacatagacaaaaataaatttgttggaggagggttgggtcagggtcagcagggagagctttccttctgaaaagtgcccttgaaattggaacttgtaactttgcttgatgggttgtgaattcctaggacatgagctccactcatatacgttgaaaactatcattgaatacatccagttcattctgttgccctgttcagggaggaaaactatgttcaggaaagttaaatcggctgtttcattaaatttcctctgaactgtctgaggtagaggggttggtctttctattttattgctgggaaaacaggctcggaaaagtgaagtaacttgcccagttctcacagccagcaggtgaaagggttgacaatttgaggtctgtcaacctcaaccctcaacttttctttctctgccacactgagactttgccacactcttaactctgagcctcagtttcctcatctgtaaaatggagacaattgggttgtcacgaggaagagatgaaataacacgtttttcttttcttttcttttctttttctttctttttttttagacagagtctcattctgttacccacactggagtgcagtggcactatcttggctcactgcaacctccgcctcctgggttcaagcaattctcctgcctcagcctcccaagtagctgggactacaggcacatgccaccatgcccggctaatttttttgtatctttagtagaaacaaggtttcaccatgttagccaggatgggaaataacatgttaaagggcttagaacagtgtttcacacacagtaagcaatatgcaatttttagctagtatctctgcctcccacaccatttaacactatcagcagcttgttctgttaactgcgtcaatgtgccaggtccattataagtacgctttctaatctttatagcatcccagcaagatcagtcttataaaccaccttttttttttcaggtgaacaaactgtcaagaaaggttaagaatttagttcaagatgccacaacatgtagtaactgaactgggatttgaactccaatctttctggttccaaagacagttttgctcttgtgccatgctgccttttcggtgccaagctctggaccccaacttaaaccccaactactgtttcagaaatccggtggctaatagcctggagaattgagaagaaggcagttcctgccctgaactgataagtaactagaaagcccttcatcgtatctgcctcaaatctaggctagaagagatcttccttctttcctgtgacagttcattaataatttgagagccactgtgtgcccttctagtcttcccctgtggttaaatagccccactcttcttcataggatgtgatgccctgacccctctctatcctgattggtctctggtcactctttgaaaagatttcagtaagataaagtgttgggtagggacctggatgcagccttgcacttgaaggttgattggaggaagaggtcagttggactagctagagaagcaatgatgacctgcttcttgagacagaaagcaggttttgagcttggtctaggaaactgaaggtttgtttggagggcagggtggacacagaggggaccctggaagggatctgtgaatatacatgtttaactggagcacagtgggaaatgagtgacaagccagcttagcgtttgttttcctgcctcgactagagggagcagaggaaggaaggggtgctgagtgaaggcagctgcaccaccgatgctcagcggcagaggccttgagttatgccctcagccagccttgaccaactgtcacccctctgtttccatggaagcttacttcatccagtgcctgtctttgtctttgcttcagctgctttagtttcatccattttgactgctgctgtttggtctaagtcagacgtttgcctttcatttttacccacgcaagggtagtggatgtcatgtggcagtccaaatcctactgggtctgggctttaattttatacctaaatttagtttaaaacaaaaccctcccctgtttggatggcaacatgttggtgaggttagcccttttattttcagacctcgggttttgtacagtttctttttctctttcagttcatgagttggaatagggaagtattttcattcaaaaaaaggctagaatttttaaagttctaaatatagaactcgtattataaaatttaagtgaagtaaaacatctcactactttccatttatattcgaacaaattttatgttatataaaaatggtttataaacctctccttgtttaaaaaaaattgttttcttagccttggtgaccattatgatgaatttcacactttggtttaatccctccaaggtgaaagttgaccaggaagaaacctctcaccacttaaagtggatcagttccacatgacagtgtgacttttaaaattgtttattttgttttttttgagattggaattcagaaaatgaaataataataattccttcagtatttattatgtgatcttgagtgcctggcactgttctaagcaccttgtagtgttatcccgttttatcatcacagcagccttcttgggtgggtgctcttattatccccactttacaaatgaagaacagagggttaaataactttctgttagatagcaggaccaggtttccaattcaagcatctagctcctggccactcggccctcctgttcatcctatgtgaggagcaggaaagagtgcagcaggaccatttcttgaggatggagcctgcacctggctagttgggttgtatacaataggctattatttctctcatatttgtggctgaggtgagattgcatgttcttagtttatatttccaagtacccactgtatgcctagcactgttaaggtagttgggtacaggagtgaacatgacaaacaaggccccttccctcgtggagcttacattctagtaggaaagacagagaatgaaaacttaagttgcactgaagaaaattaatgcagattaagagacagaaaatgacaggggtgaggccattttagacaggggtgaggtaggagcatctctgaagagatggcgtctgtaggaggcaggcgttaagtgagggaataagctttaggaagactcgaggaacaccttgcaagcagatagaacagttggcgcaggtgcaggaggtgggaggagcagcagagaaaccaggagactggaagggggtgaaggaggggagcacatcagagacatgggaggaaagggtggccagggctgttatgcagggtgtggtggtctgcagtgaggacctgcctctatttaccatccaggtggaacaagaagcaggtcgctttagagcagggggtcacgtgagcttcactttggctgctatgtggaataacttgtgacctaagaatgattttggaataatcttagacaaagtgtcctattataaataataactttctaactcagactggcctaatttatatttcaaagctattattcaggccgggtgcagtggctcacgcctgtaatcccagcactttgggaggccaaggtgggcagatcatttgaggccaggagttcgagaccagcatgggcaacatggcgcaaccatatctccactaaaaatacaaaaattagctgggcgtggtggcacatgcctgtagtcccagctactcgggaggctgaggcacaagacttgcttgaacccggtaggtgaaggttgcagtgagctgagatcacgccactgcactccagcctggctgagagagtgagactccatctcaaaaaaaaaaaaaagcaatcattccgggtacattcaacaccctttctgatttttctcttatttgttagtcagttgaaggtagaaaatgatactgtgagccccctacagacagaaggcggcatttgcccttaggatgacttggtgattaagtcttcagggtagttagggaaacatcagtgctggagactagagcttctgttctctttgatttagaacagatggaacaaatgtgaaatggcacagtgaaacatttcctccaatatagtataggtttttcagctttggttatcataaataatcctttaaattttatttatatattttatttatatatttagacacacacaagcattattttatgttttatttactggaaatagctaggagtaatttaaattaataggaaagtttagaactatttattttatatctaatttttgatatttgttcttataattttatatattattacagataacaattcatgtgtgttatatatagtgtatttttttatcccatgaagttccagaaatgattcttaccatatataaatttagaactcctggaaattgcagattcaacttgtattttttttttctttttttgagacagagtctcgctttgtcgcccaggctggagtatggtggtgcaatctcggctcaatgcaacctccgcctccccaaattcaagtgattttcctgcctcagcctcctgagtatctgggaccacaggtgcatgccaccacacccggctaatattttgtatttttagtagagacagggtttcaccttgttagccagggtggtcttgatctcctgacctcgtgatccacccgcctcagcctcccaaagtgctgggattacaggtgtgagccaccgcccggcctcaacttgtattcttaagacatatgttgataaagttttttcaatacaaaggaatgcagccatctcatcaacttttaaattaaaagtgtatttgtttagaggtaaactcccacatttattcagaatggttgaaaaatggaatattctagtaaagttcatgtttttggataatgagggttatgagtcaaaagattcttgcatttatggttaataaagtattagaaatttaccattgatgagatacattttttcaaactgtggctcagggtgtatgagtgtgcttgagggatggggactggtgggactcaggctttttatgccagattcaatccctgttgttccttctgaggctttcaggaaaactttggttggataataaggtttctaatgcaccctgcctgccatgttaaaaacaactatcagaaaataatttgatttttctaggtttattcagaaggcacttccaagatttagatgatgaaaatcactttttaccaaaaaaatctccagtttttggtttgctttttgtagattcctgaataaaatttgttagttaagtatttgattatttgcaatctagatgaacagaagtgagccaaagaccctttccagctagatttatttcagtataagttaacaatacagtttttttttaaatcaatcaggtctctcatggtttgtaacagtgcaaccaactctagtaactgaaaatttttatagccgatgacttcactaggacttgtctagacagcagctaccctctaaagtcacatcatgttagggctggaagagatctaacgaagatactgtaatttagaagtcctaaatgttctgtttgccattgtagccatggttttagggtttgagggacagtgagaccaatgacttcagcatggaaagtgggaaactgataggcataaatatggggaaaggcctaaccttggtttgggatgcaaatgtaaacatacaaaagtattctctggaaacatcagcaaatttgaaaggaatttgatgtctggttatgtttgtcaagatggagagactcctggagattatacctagagaaagtagttgcagtcagtaaatttgtagccttttggatagactcttcttagcaatgtaatgctagcttttataaaataatgcttgtattatttgtttctgctaatgaaatccatatgctgtgaaacagttacttgtctgtgggatttggattggatctacatggttccccaaccttcagcattttagtcaacaaagtagtcaaatagattgacttttttgtttttttgttttttttgagacagcgtctcactctgtcacccaggctggagtacagtgtcgtgatctctgctcactttagtctcaacctcccaggcacagggctcctcctgcctcagcctcccaagtagcaccacacccaactaatttttgtattttttgtagagacagggtttcaccatgttgcaggctggtctcgaacttgtgggctccagtgatccgcccacctcgacctcccaaagtgctgggattatggacgtgagccaccacccctggccactgattgactttttaaagtaaactttcaactcattgttttgctttcctgtctgtaaacataaaactgccagatgcaatttaatgtagagcctggactctgtaattccacagttttactggcctgtaagtggcaaagaccagaatgtactttatagtccagaggagtctgattgctttgattgatgtagatttggtttgagaacctgagatagaaaaagccttgtctctgacaaagtgttttgagagggctttctatgatttgggtgtttaaataattgcatgggtgggatgattgcaacattaagtgcccttagatcaaataatagctgagcttcccattaactttgtgaatgtgaagtgacttatgtctgtaagactttcttcggagaaagaatactaatggttgcctggtgattttgacttgctgggagtaaatacacagtgctttgtatttggtgaaaagttttgatgtgaagtacactttgctccatgccttgtgacaatgagtgcatgactcttgcttcccattctgactgtaggaagctgccctctgtcgacagctccccatggaagctgagactcttgccccagttcaggctgctgtcaacccacccacgatgaccccagacatgagatccatcactaataatagctcagatcctttcctcaatgggtaagttaatatttgggggccacttatttttattctctttattatgtgatctagactataataggatctttgtttacattgggaagaggtggggagcttgagggttgagggtgagaataaagggaggaagtgggaggagctggcagaaaaaagaaaagcaggggaaatcatctgcctgttaaaaaatttccaaattaaaaaattggtgataggacgtagagtaaacccctagtcaagaatttgaaaatgggcatgaacttatatttttaaacatgatggtgtcgtctagtacttatacttggaagaatcttctggttttatgtaaccaacaggggataaaagcatgccatatggcaaattgagaacagaacaattaagagattatgttcggccaggcatggtggctcatgcctataatcccagcactttgggaggccgaggtgggcagatcacctgaggttgggagttcgagaccagcctgaccaacatggagaaaccctgtctcttctaaaaatacaaaattagcagggcatggtggtgcatgcctgtaatcccagctactcgggaggctgagaattgcttgaacctgggaggcggaggttgcagtgagccgagattgcaccattgcactccagccttggcaacaagagtgaaactccatctcaaaaaaaaaaaaaagaaagaaaagaaaagagatgatgttcagggtgaaatgtgaataagatctatagtttagtaaataatattctacagtgtcagatttctgattttggtaattgcactatggttatgtaagatgttatcactggggaagctggtgaagggtacatgggaacgctctgtactcttgttgcgtcttctatgtgagtttaaaataatttcacaatttaaaaagtaattaaaacaaaggagcaaaagggaaagagaatttagccagaaatatcttcatgagcagaagtagtttttaaatcaaataaaaagggcaattctgtatttcctgtgccttttattctgcccttgcagagacgtctggcaaacaaacaatacaattatgaacattattaaagatagagataaaaacaaatagtagctgaaataataattaatggaggttttaaattgttgattttaaagtatttgaaacacagagaagtacaaagaataacatgaattacccatgtacccactacccagatttgccatagttttatttaatcttactttttaacaaataaaatattacaattaatatttgaagccatccccccaccactgaaatctcgtttcttttcccttctgtccccagtggtagccactattcagaaactggcgtgtgtccatcacacagacttttataccccttactgcccgttagtgtatgtatccataagcaatattcaacatagtttttgttttttttttttaaagttttacataaatggtgtcatactctgtatgttgaagaatgttcaaatggttattttgaggtgaaaaggaaatcaatgtcaatttactgtgaatggccacacatgattattttcattttcatgagggtatgtatttcaaaattaaaactttccttcctccctaacctggaaagttgggcagcatggcacaactgcactagtttagagcttttgtgactgtgttttaattttgagatttatttagtgggctcatattgaagtttcttcatcttttgctttgcagagggccatatcattcgagggagcagagcactgacagtggcctggggttagggtgctacagtgtccccacaactccggaggacttcctcagcaatgtggatgagatggatacaggtaggagcaaagcctgcaagcacttacaatgggtttgtgttttttaaatgatctcttcggttatctcaattttatttttcttttattttatttttataatttcaacttttattttatatttgggggtacatgtgcaggtttgctacatggttatgtgatgccggggtttgggatacgattgctctcgtcacccaggtagtgagcatagtacccaatagtttgtttttcaccccttgttcctccccactcccagtagtcccgagtgtctgtaaaaatgttgaaaaaaaaaaaaatggaatgcttcatgaatttacatgtcattctcatgcaggggccatgctaatcattccagttttagtataggtgctgccagagcgagtacggtcatctcaattttaaaatccaaccagaaacactcaatctcaacgacaacataaaataacagctgaaaagccactgaacccccaggcactattaataaactgtagccccttcctcatagattatacaagtatagttttacatctgggcgcaggattttaaattctgttgttttttttttttaattcatctttgctccatatagtcccttcctcacaattgcatcaagacaccactgtttgtttgccatgtttccacattggggtatttatgctgttctagtttttagttgtaatatatgggccaccctttctcctggaaagtgacactggtttatagttctagtatccaatttttttcatgtcattcactgcatttgaaaagcaattggcagtgggtatttggaatgctgagcaactcagaggattcaaaattgtcacttccaagttccaacatggtaacgacatcctccctcaggaattaaagagaagagagtcagggttactcttaccttgtccccagcctgtgcatccttcaggtccagcctcaccaggcttcccgattacctttctttttctccttttctcaaggagtgagacttccaattgcagaaactgaagttagtcttattagccttacctagacttaattatgaaagtcataaactctaagaagatattctagaaccaaaaataaatgacagccagggtgtccactatttggagttattcatgaaagttccttctccattatcattgacgaaagtaattgttttgtgttgaaaataaaaaattccttcccccaaagtgtttgccatagtgcctgtagttttttacactctactctttgatggcttctctttgtgttgtgagtctaaattgttggaaagatcaagagtcaaactcatagccaggtgtcttacaaatgcagtacattaaagctgctcccctggcgtctttcgtgtaggttgtcatctttgcattgagaagattgcaaagactatcttgtgaggagtgacacaggaatagtttgcactgattgttttactgttcttcagtttattacttcagttcttcccccaccaccaccccctgccacctttatctctctctctgctttttgagtgtgagatttattttgctatctttggaatagccttaggaagtggctccttcctatgtttaataattctttactttcatcttctaaacactgggaagccagtaaggataaaaagcaaagttaaggaaaaaagctcaggagatctaaatctaagtttgacattcaaaaaaaaaaaaaaaaaaccataaaagaggatggattctactctatgtctctttaaaataacctcaagtgggtaagtagggagtgttttattttgaagccgtaatgtggaattaaatgacgtcctgaaaagaacatagttttagccaacaggcagcctgatttgaatccttgcttctccattcctagtagcgcctttgggtaagttgcataacctccgtgagcctcagatttctcacccataaagtgggagtgatatgctcacggcagagttgtgaggagtcatgagatcacagagaccagctcaaagtgctcttctccagtaagaagactgatgtcatacatacaatggacttgataatgtcagagtgccacgttaacctggttaagtgagaatcagctcattgagtgtgggaatgtgagtgccaagttaacctggttaagttagagtcagctcattgagtgtggggccacctctgtgaagtctttgtaggaactggacatacatcttctcaaggggagaaatgttaattatacagtagcaaaatgagggaagctgtgggggcaggcagagctcaagtgtggctagaaaagatctatcaggcctgtggaccacgcgctggccacatgctgaagggaaacgagccagctgagcactccatttgcaaaacatacatggcagcaacagctgggcttggtgcgaagatccagtaaagggaataacatgagcaaaggctgggaaatcatccatccttccagaatattctgcagtaatcacacccttttaagaattgccttgtggctgggcacggtggttcacacctgtaatcccagcactttggtaggccgaggtgggtggatcacctgaggttgggagttcaagaccagcctgaccaacatggagaaatcttgtgtctactaagaatacaaaattagctgggcgtggtggcacatgcctgtgatcccagccactcgggaagctgaggcaggagaatcacttgaacccaggaggcggaggttgcagtgagccgagattgtgccattgcactctagcttgggcagcaagagcgaaactccatctcaaaaaaaaaaaaaagaattgccttgtgtttgtctcttccactttttaagtggataaactgcaaagaccaaaaagattactatgagattgcagagctgcttctattttaagattgttaactttaatgaagaagcttagccagtatcctcatgccttccatcctgagaagaaaggataagagtaatttttttttttttttttaatacggggtctcattctgtcacccaggctggagtgcagtggtgtgatctcagctcattgcaacctctacctcctggattcaaacgagtctcgggcctcagcctcctgagtagctgggattacaggggtgcgccaccatgcctggcactgtttttttggggtttttttgtttgtttgtttgttgtatttttagtagagacagggtttcaccatgttggcaaggctgttcttgaactcctgacctcaggtgatccacccacctcggcctcccaaagtgctgggattacaggcatgagccaccacacccggcctaggaattctttaaaacagagattttgcttggctaaaaattatattcttgagtatctgaaagttaaaatgggaaattagtaaaaatgaatgattctaactggagatgaagagaaaaaaaggcatccagcacattagatcagattgttttttagacactttttaaagcctcatttttatctgttacactctagtaagtagaagaaagttattttggattttgttttttcgtttaacgttatttttcaatatcagtaacactatattgaggtcatattgttgaatttgatttaatttttcagtttactaccctttgcaatgaaaatactgtaaaatgttacccaggagtcatttatattttgtgacttctagaaaagccattgtgttttgctatcaccaaaatccaaattggatgatggttccttcatcatttggaaggatataatttttctccctggaaaacacagattgctaaagtgaactttcggcaattttgcttaaaatagtgaaacttccctacacacgtttcaggaaggctactgcacttgtaacacacaaaagataatttaacaagtttttaaaaaatgacgttatggtggaagctggccttagttatcaatgcttctcaatttttgaagtagatattatctcttcagaaaattgtttgggactttttgaattaacctgttgttttgatattgtgtaattaatagtggctgaagacctgggtttttctttctctcaggacaatgaacatttattatatttttgtatgtatataactttgtatatatcaatgacacccagagccatggatatgtggcagacactatatggcactttactctaacttttgtaaaaggagcatatgatcccaatttctagatgggtaaactgagaatcaggcaggttaagtgtgtctaagcttacacagccacaaagctcgatctaatgacaccaaagtcagtagtgcattctgtcccatactatgacacataaagaacctatattcttcatgtcatatcccagacacctacttttcctctagtacagcattttctcacctgtgttctgtagaacttcagttttatttgaatacacatactgccaaaataggtttaggtgattaaatgggtttaggaaatagtgtcttaaagaaaacaaaagatttctttactctaagacttaaagccttaacatgctcatatgcactgtgctcatatgcttgtgagaaaggcagatagttgtagggtgtaggtattacagaaagagggaaaacgtctgcagaactgcctttataaatgatgcctaaagtcatcaatgaagacaactttttaatagcctggttaaaagaagcttcacaccattctctttgaacataaagaaggatggtatgggtaaacctaagcttacaatgaaacctgtagattatagttctgtaataagctgtttattacagacaaggcctctctactcttttgtaaaacagttcttcacacctttgtcatgggaaggcacagatcatagatcagatccacagtgcctttcacatgctcctttcttatctccttggccttttccattctggaccacacctatccagaaataattttcgatttcttccacatctctgtacctcttatgagtaagggtcaataatgtggtagttgaagacatgaaggtgagggttatgtaaatacttgaactgttcctccttcaagagcctaaaagaaggaattaaaatggtttcttttcattttgttataggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatcc

SEQ ID NO: 36089 - DNA, 183028 bp, Homo sapiens; identical to SEQ ID NO: 36088

SEQ ID NO: 36090 - DNA, 118936 bp, Homo sapiens
ccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaaggtaggagccgcgtgcacggctccggccccgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgcaggcccgcggcgccaggggaagacgcgagtaagtgcgggcggcggtgccctcccggccctcaccccgcacgcggcgacccggccgcctagcctccctcgctcaggcgcgaccgcggcgttctctgaggtggagtattacaaacatggcgcccctcgagcccggagcccttcgcgcggagccggcggcggggtccgggcgggggggagccggggaggagggaggaggccggcagggaggaggaggaggcggcctgagcgtcccccccgccccccgcgcccgtcgccggctcaggcccgagaggcgccgggcggcgggaaggaggcggcaccggaggggagggccgggcgcggcggcggcggcggtggaggagccggagcataatggtggggaaagctcggcggcggggcggcggggcgggcgggggcgtccgtggagatggcgcggcccgcgcggtggagcctgcctggccgcggcctctggggcggcggcggcaccagtgggtgctgacggtcgctcgcccgctcgcgaagagctccgagctgccggggagctttgtggatggcggggcgggccgggccggcggggcctgcgagggcggcggcggggcctgcggaggctgccggcccgcgcccactcgccttgggcggccgcggaagaggccccgggatgaggccccggaggaccgcgcggggcctgctcgggccgggaagccgcggagtcgcgtgagcaccgcccgccgggccctgtgccccgctttcggtcaggcctcctgggcccgtgcgcagtccgggccggcggggaacgcggctccgggcgtgtggcgggcggagaggaagcgtttgtcggcgcggcacgtcgtgtgctagcccgggagcggcgggcagggctggccccgaggcccggggcggagattcgtcggtcccccggggctgtgagcgaccccggcagcgaggccgccgcctcaacaggtcctcgcggacctccgggacagtcctgtggggtccgccgccctcctcccacccagagctccggggagaagctgctgaggacgcggctgggacgagggggggcgccgggacccggactttcacttgcagtctctcctcgcgcttttctcccgagccgggaggaggaggagctggcgatgtgtgcgccgtgcccggtgtcttttgcagagtgaccgccgtacctgttttattcgtgtgtaccagtgctcgttgtgcagtgcggtgtcctatgcggtgggtacgcagtaccggggattatatatggtgtgtactctgtgtcatatgcagtgtgctcgaagtacccggtgtcgtaccggctatcatacacggtgtgtacatgtatcttcctcgcttaggctgtgcactcagcccccggtattgtgtgcagtaggtgcctggtaccctgctgccatatgagctgtgcgtgtggtactccatgttatatacgagtgtatgtagtatctggatagtattgaatatatttaccttacctgttgtcacatacagtgtgtatgtagtacctggtgtcatatatgcggtgtgtatagtaccaggtgtcatatactgtgtgcacacagtacttggggtcatatatggtgtgtacatagtatcctttcacactgtgtatgcagcacccagtgtcatatacagcccttacgcggttcccggtattttgtgcagtatgtgcacggtaccgtgctgccatatgcggtgtgtatgcagtattcaatgtcatatacgttaggtatatagtatctggtgtcatatacagtgtatatacactacctggtgttatctatgttttgtatatatatctggtggcatgtacagtatgtatacattacatagtgttatatatggtgtgtaggtagtacccaatgtcatatgccatgcatatatggtacccaatgtcatatgcaccatgcatgcactatccttgtcacataagctgtactcagtgtcagatgcagtgtgtacctagtaccgagtgtcatatgtactgtgtacacagtacccactgtcatattcagggtatctagtaccctgggtcatatacagtgtgtacatggtatctggtgtcaagaatgtgagcctggaggagatacccaggtggcccattcaggaccctgctggtaggagggagtggtgcaggttgggtttttagggaggtctagagcccttggtcctcctcacttaggtgttctgcatcccacagtaagctgagtcatatggaggcaagaacattcttaaaaataatttaatctgtttgtccaaaagcagaaagtaaatgtttacttgttttcctgtaaactgagaaatatagtaattttagcttagtaattatggtgtgcacaacgttttcagatttttgaggttgattttaattaatggttggatgttatcagggagatagtgttggttgtactttgaaagttgaaaagttagagtgctttctggtaggcagggtcatctttgtagtttttctgaatgtctttttacaagcaggagaaaaaatatgaatgtctgtagaggcatttaatttgccttgtctttgactaactggcacaggttacattatagttgttatttttggttgactcatctttataagatgaccaggctagagaatcagagatcagaggatatgggatgtgattatgacagaatcaaaatatttgtcttgcttgactctgttacttaaaggatttctgtatttcacatggtgcttttcccccatagagattgctcatatgaaaaccaactcttccttttacagtctctaaattggacaatttatttttgcaattaccatttgtgaggtgtttaaataaatgtacatgtacgagcttccagcttcacaaaaagaaatcaattaaaatgttaaaatttagttctttcattcatactgaataccattctgttggcgtttttttttttttttttgagatggagtcttgctctgtcgctcaggctggagtgcagtggtgtgatctcggcttactgcaacccctgcctcccaggcttaagcgattctcatgcctcagcctcccgggtagctcgtactacaggcatgtgccaccacacctggataattttttgtatttttagtagggggccggggtgggggtggtttgccatgttggccaggtctcagactcctggcctcaaatgatccacctgccttggcctcccaaagtgctgagattacagatgtgagccaccgcacccggccctgttggcgttttgaatggatgtcatgcatgtttcaatgaatgacatatgtttatttggactctcatccttcggtaaccctctgagttttttcttcttagggttgttacagtagtgtataatagaggcattcatactctttggcataccttaattgagacactacttggacctaactaagaattttaatacttgctataaaagtatcaaatgttgctgtaaattgcttacttaaagccctaaccctctggtatcagatttttggtaactttcttgtccttcagttgaattctacatggagaacattattacctttcagcaaagaggatgtatcttggaaaaaaaaaaaagagaaaatagacttagccttatgatagttaaaacttttcactgtttgaaaaccttaaattggatttaacactgaattttcttttttctttttttgagacactcactctcgctctgtcgcccaggctggagtgcagtggcacaatcttggctcactgcagcctctgcctcctgggttcaagtgattctcctgcttcagcctgggattataggcgcccgccactgtgcctggctaatttttctatttcaccatgccggtcttaaactcctggcctcaaatgatccgcctgccttggcttcccaaagcgctgggactataggcatgagccactgtgcctggcctatcattactttgatgaatgatattattattcatctattttaattcatttgaataatacaaataactaaaatacacagtgtgagagttcttattttaaccattggttttatgttaatatttttctgtttttcatatctggcactctgtccataactgcttcaggttgcattttctatatttccttgaagcagatagactttctgaataaaggaaaactggtgttttctcttcattagatcttcattaaaccctcaccaacatttctactaggaattcagcatatgtgagtttatttctaccaatatctcttacatactttcagttacttgcagtgccattatcaagttttcaaaacaaatgtaaatctgctttgatacagtgatttgtgcagatgttagtgacctggaggttgttcatcaggttttcagtgttttgtcttctcttagtctccacttttgaaatgtttagtagctacaattttataacataaatgaggaccataataataatatatcatgtattgtctgtctactgtatatcagccactgtgcaaagttacttacacgtacactgtccaacttaaacttacacatggtccttttttttttttttttttttttttggagatagggtcttgctctgttgcccaggctggagtgcagtggtgccatcttggctcactacaacctccacctcctgggttcaagtgattctcatgccttagcctgccaagtagctgggactacaggcaggagccaccacgcctggctaatttttgtatttttagtagagttggggttttgccatgttggccaggctcttctcaaacgtgtaggtgatctgcccatcttggcctcccaaagtgcagggattacaggcatgagccaccgtgcctggccacacattgtcatcttaaaagcatagcagtcagtcttccttttaattatggaaagttcaccttgtagcacactcttataattgcatcctatcccagacacacacacacacacatacacacgcagaaacagaagagaagtgggtgagatattttttgagacagaatgtgatttgtataacataaaagtttgagagtctctgggataagaggtcaatgatagaaatgaagataatgtgagggagataagaacccaaatcaaaatacccaatacaatagtccttttgaataatcatggcttagctgtggttttaaaaacatatgcagaaatgatttattgcttaaggaaagatttgtgtgtgggcacctgctgttactgtttttccattagaaaatccatagagttatttagtttgtatcatggaaatgctatacaagttttagtatcaaaattatttgcaaatgcaaagaaatctgtaaaataaaaaatatttttagtgtttgtgttatccattattaggtcttaggagagaaatttggcaaattattagacataaatatttaactcaattcaaaaaataacctaattagatatttaatctttcattgcatatatatttttcctgttcagcagtaatttcctgatttttatctcaggtttcttttaaagagaatttagcacattggaaaatattttcataattaaagtgctgggtaaattcttttaaaatgtgttcaatcagatagaagtagaaatacccttacgtgcacatacttaagctattcacactattaggtaattgtgaagttacagttgcattgagtatgtggcacatttcatttaatgttggtaacatctgcaaatgtccagagtgtttgcttcataaatgtctaaaagtttgcccacttttatgtaaaactaaagaagtagaaatgacaaaagtaatagaatactactgtatcagagttttaaaggaatcatatggactcttcgatctgtttgtttttcagagatgagagggatatgtttacagaccacattagcttacacattaattggaaaatgtgtttcgctgaaatacacacagtattttcatttttctgtaaacttaatatttaggtatagtaggtaaactagttttacatcagtgtgtttatagttcaagttacttcataatttgtttcataagatcacactaaaatattgtctattttcatataaggagaatatatgcaattttaatatcttgaccccatttattaatacattgttatttatcgaaactctggtatgtgccatatcttagatgccgaggcgagcaagatgagggagggttcttgccattgtagagttttcagttcagagtaacacatttactgaagcaagcacaataaaatgtaaaggcaagaggactgcttgagcccaggagtttgaggctacagtgagctaaatcagctactgcactccgacctgggtactgtaggacactgtatgaattaagataagtcgtatttgtgttaagattacttgcaaagtcttagcactgatgatttaaaatttatcccaatttgtaactttgagattttactatattaacaacctgagggtttttaaagcaactttattatgattggtaacttttaaagtactctgttgaaaagtagagctgtattaaatatcaaacatatattgtgttctccagatattatctgagcatttaaatgaaaggtagatccaatttaaatttttagttttttgttctctgaggtttggtctgcatgttatgttaatttaaaatataggttaagagcaaaggatcttcattcctagtttaaacatttatcatgtgaacatgaaagatattaaaaaattcaaaggatttctgttgagagcttgtcatacaatattagctctcataactcgggttaaaaaggctatttttaaaaattgggaagatattttggtttatagcaagacaatctgatttgtatacattttaatttggctgtacacattaggtcgctttatgagtctactttgtaagcagtttttaggaagctgggtttaatcatgagagttgtttgtggcagcaccatttgtgttatttgtgttttgttttgcttttagacagggtctcattctgtagggagcacagtggcgagaactctggtcactgccacctccacttcctgggctcaagtgatcctcacacctcagcctccccaggagctagaactataggtctgtgccaccatgcctggctaattttttgtagtgatggggtttcaccatgttacccacgctggtcccaaactcctgagctcaagcgaaccacctgactcgttctcaaagtgttaagattagaggtgtgacccaccttgcccagcctgtttttttaaaggtgtcactttttgagcatctcacatactaggcaattcgcatatcccatttagtcctcacagaggcgtcatgagggatgtgtcattgtaacaatttataatgagggaatagacttagaagggttaagttactggtgcccaaggtcatagagacataatcaaattggtctgaattccaatgtatgactaccacacctgtaacctgctatgctactctgtctccctaaaacccataaacttcttaaatctttacagtgatattccttcattttcccaatgcacttttataagtctgcaaaagtacgtaatattaacaaagtgtaaaactatgcccactctgcttataaaagcaggaggtagaaagacaggagtattaggaaactctgggcaatcaaaacattctatctatgaagttctggttaatgccaactcaccggtaatgacaggtagtaatctgagaacaagcatagataattggttcattttcttgctgtcactatggtagctcacattaggaagataacttggttcaggggcaggagcactggaggcggggcacctgcaggtcttcattttaatactcacataatggtgaaaattgtttgaaaatatttggaattaacaccaacactaaagtattcttgctgtcttggaaagggaagtcattgtcttgaggaatcttgtgtaagttcaatttggattcagagagctaatttctggaaagctgtattaaatgctaaggcttcagcattccactgggtgtgccgtcatctaacataaaataataccattttgtgagaagcgtatggtaaagagagaaataatcgagttgtagcacccacagattgagatcatcctgacactcagcagtgatgctgcaacgggataattgagggctaggcatgggggaagctctcgcaacttttgaaagctattatgaattttttagttttctcttgtagattcttgatttatctgcctcttgcttgtttttctatctcgaaagtatgtctgagaaatgctgttttagagagcaggtccttaattttctattgaattttgacatggagcccttcctcaattaatataaaatatacctactttcactgcccagttcttgcaatacaaaaaaaatgagaaaaatttatttgggctttccattgatgtcatatttaataggttttgagaggaggttatttaccattagagatgttgtctttttaaattatagaggatataagtctacagtatttttttctactgtacttacaatttggcatttgcttgtatgtttagaaatatcaaatttaatattaaagtaccagagatcttttatttcacaatacttattttaccagtctgcacgtatatgttctacagttataactttacgaagcctttcacttgtgatcaatattcatgttggattgtttcaggtaagaaactgccatttgaggcagggtcaggtagctcacgcctgtcatcacaacactttgggaggccgaggcgggcagatcacttgagcccaggaggcagaggttgcagtgagcggagatcatgccactgcactacagcctgggccacagagcaagaccctgcctcaattaaaaaaaaaaaaaactgccatttgaatcatttgaaagtttttttttaatattttaaggactattcaaataaaaataattttagtcttagttattttcaaatgaattaaaagctgaacagccagcagtacaatttaaagttagactttctctctgctcatgctgaggaaaaatttactatcattgcagtagtatttgtacctcatttatttattttaatttttgttttttacgacagaatcttgctctgttgcccaggctggagtgcagtagcaccataactgctcactgcagccttgatttcctggggtcaggccatcctcctgcctcaacttcttgagtagctgggactataggcgcatgccaccacacctggctaatttttgtatttttttggcagaggggagagttttgccatgttgcccaggatcatctcgaacacctaggctcaagtgttctgcccatcacggcctcccaaagtgttgggattacagatgtgagccaccttgcctggcctattttttaaaataaactgtttagaattttagatgacagtgttacacaactcacattaggaaccaggagtaatttagcatagtggttctcagttatggctggctgagcgtctgaattcctttttttttttttttttttttttaacaaaaacattaaatcagaatctcaggggttgagtctgggctctaattttttatttctacatataaaatatatatataatatatatatgcatacacatttcattagctttgggtacaagtggtttttggttacatggataaattgcatagtggtgaagtatgagattttagtgcacccatcacctgagtagtgtacattgtacccaatatttttaaaatattaaatattaaagagatttttaaaatttcttactcctcttccactcttccccattctgagtctccagtgttcatgatactactgtgtatgcctttgtgtacccatagcttagttctcacaagtgagaacatgcagtatttggttttccattcctgagttatttcatttagaataatggcctctagcttcattcaggtttctgcaaaagacgttattttatttattttcttttatggctgagagtattccatatatatatgtgtatatatatatgtgtgtgtatatatatgtgtatatatgtgtatatacatatgtgtgtgtatatatatgtatatatgtgtgtatatatatgtgtgtgtatgtatatatatatatgtatatatatatcactttttctttttccatttattggttgatgggcacttaggttggttccgtatctttgcaattgtgaattgtgccacaataaacatatgcacgcaggtgtctttttgatgtaatgacttcttttcctgtgggtagatgcccagcagtgggattgctggatcaaatggtagatttacttttagtacttaaaggaacgtccgtgccgttttctgtagaggttgtactaatttacattactatacattctcgtaagcattctcttttctccgcatccatgccaacacctattggtttttgactttctgatagtcaccattctggtgggggtaaggtggtacctcactgtggttttaatttgcatttccctgatgattagtcatatttagcattttcttacgtgtttgttggttatttgtatatctttctttgagaagtgtctattcatgtcatttgtccgctttttgatgggattttttttcttgctgatttgagttccctgtagattctggataccagtcctttgtcagatgcatagtttccaaatattttctcccattttgtgggttgtttaatctgatgattattttctttgctgtgcagaagatttttagtttaattaggtcttatttacttttgtttttgtggcatttgcttttggggtcttagtcataaattctttgtctagaccattgtccagaagggtttttcctatggtttcttctagaatttttatggtttttggttttagatttaagtatttaatccatcttgagttgatttttgtataaggtgggagctagggatccagtttcattcttctacgtatggctatccagttttcccagtaccatttattagataatgtgtcctttccccaattttgtttctgtatgctttgtcaaggatcagttggttgtaagtatttggccttatttctaggttctctattcttttccattctgtgtgtctacttttatatcagtaccatgctgttttgcttactatagccttgtagtataaagtcaggtaatgtgatgcctccagattagttcttttgcataggattgctttggctatttgagccattttttgattccataagaattttaggatttttctctatttctattgaagcgatgttcgtattttgataggaattgcattgaatctatagagtgttttgggcagcatggttgttttcacaatatcgatttttccaatccatgaacatgggatgtatttccatttgtttgtatcatctgtgatttctttcagtagtgttttgtggttctccttgtagcaatctttcacctcctctgttcatatactcctagggttttgttgttgtgttgttttgtttttgcagctatcataaaagggattgagttcttgatttgatttcttagtgatatggtttggccatgtcccctccgaaaatctcatcttgaattgtagctcccataatccccacatgttgtgggagggacccagtgggagataattgaatcatggtggtgggttttccccatgctgttctcatcatagtgaataagtctcacaagatctgatggttttataaagggcagttcacctgcacaggttctcctgcctgccagcatgtaagacatgcctttgctcctcctttggcttctgccatgattgtgaggtctccccagccatgtggaactgtgagttcattaaacctctctttctttataaattacccagtctcgagtatgtctttcttagcagtgtgagaatggactaatacactcagcttggtcgttgttggtatatagcagcactaccaatttgtgtacattgattctgtagcatgagactttactgaattcatttatcaaatctaggattcttctggaagagtctttagggttttctaggtatatgagcatatcattggcaaacagatagtttgactttctcttttccaatttggatgccctttatttctttttcttgtcagattactctgactaggacttccagtactgtgttgaatagaagtgttgaaagtaggtatccttgtcttgttccagttcttagggggaatgctttcaacttttccccattcagtatgttggctctgggtttgtcatagatggcttttcatattttgaggtatgttcctcctattgagctctactttttaaaagtaaacagttttattttagcttttcaagcttcaaatttttattttttgaagtgggcagaggtatatgtgcctttttaaatttttttttttggaatagcttatatgaaatgtcataccctaggatttttagttccaagcctcagaaattctctttcaagaatcagatccatgaagttcccttaaaaagaggataattaaaataacctgaaaagtaaatgcatcctagatgaaagcgttaaatctttttggattcctcaaacacgctactgtattgccagggaagatggatatcgaaggtatcattggttgatattccctgatggtcacagatataactataatcacaggtaaatgcacatcagatcttgagatacgttatagtcaggatatgggttgccatccagtttgaatgtctgggcattctggtaatttgaaaagcagcaatacaaaagtgttctgcctgtcctgtagtcagctctccaggatgtctcctaatcctgataggcatcagaaaaacttgaatgtctttccctggggcagtcagatcaaccgtcctggggttatgtcttcagtcaatagtgagaccacctgagaaagtttttcaggctctgcctaggtctctggctagcctcctctttatccctggtgtttatctggatttcaggtgattattggtattcctccaggctgggggtaatatttccatgtacaggtggttctacaggtttggcagtctacaggagtagattagagtctttaaactgagtgtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcctaacttcctttgctctgggaagaagtcttaacttcctttgctctgggaagaagtcctaacttcctttgctcagggaagaagtccttgaggtgtaagactcactgtggctccaacccctaccgtccaatatttgcattcactccttagtaattttattactcacactagtgttttgaggcttcacaggtatcccagtacctaggcagtgcctgataatttccacaggtttattttctctttaacatagtgttcataattcttcactgattccacaaaggccaagatgcatggcaggtggaattttagggagtgaccaggtaagcctccctgggcttggtgctgactgttgacagggtgctcaccagggccccatcagggctcttcgtttgctcttctcacgggacagcacagcctcatccaccattgattttccactgctgtcagtgtccttactgtcttccgggttagaccttaggtgataacatacaacgtctgtgtttttaaagtgtgctaagtcaaattttcttaaatatacataattttgtcagttttaaattaccagatacattcaagaattatattaattgctgctgagttagaattgcattttaaagagaatagttttatgaaatttgaacttgaagaatagagtaggaaatgttagatggttaccctaaacattgtaaataatagggagggaagaggatccgatgtctgactcatggcaagtaattgactttgaaaaatacgaattttctaaaaagaaaggctgaaccgaaacttgcccactccagtctctgatctcattctcctcagctcagtgagaccacacactccctttggatctccatccctgcactgtggcctgggaattgctgtgaggcagaacactgaggtggttgttattattattattattattattattattattattattatttttcagaccagtctcgctctgtcgcccaggctggagtgcagtggcgcgatcttggctcactgcaagctccgcctcctgggttcacgccattctcctgcatcagcctcccaagtagctgagactacaggcgcctaccaccatgcctggctaattttttgtatttttagtagagacggggtttcaccgggttagccaggatggtctcgatctcctgacctcgtgatccacccacctcagcctcccaaaatgtattattattttttaaatgtagtttgcttttgaaagaacaacacaatagtaaatacttaatacatgtactgttaataatatttgcatattaaattgtgggtatgttttagtataaatgggcactaattttatactttatccagtctcacactttaaatagacattgtatcacttaggagaagggcaattattctgttgtgggagtggagaagaaaggctgaaacagagtctaatgaagtacattatttcaacacttctttctcttcctttttaatggaaccctgctcctcagatagagtggtttttgtctttggttctgtttatatgctggattacgtttattgatttgtgtatgttgaaccaaccttgcatcccagggatgaagcccacttgatcatggtggataagcttttcgatgtgctgctggattcggtttgccagtattttattgaggatttttgcatcaatgttcatcagggatattggtctaaaattctctttttttgttgtgtctctgccaggcgttggtatcaggatgatgctggcctcataaaatgagttagggaggattccctctttttgtattgattggaatagtttcagaaggagtggtaccagctcctccttgtacttctggtagaatttggctgtgaatccgtctggtcctggactttttttggttggtaagctattaattattgcctcaatttcagagcctgttattggtctattcagggattcagcttcttcctggtttagtcttgggcgggtgtatgtgtccaggaatttatccatttcttctagattttctagtttatttgcgtagaagtgtttatagtattctctgatggtagtttgtatttctgtgggatcagtggtgatatcccctttatcatttttaattgcgtctatttgattcttctcttttttcttctttattagtcttgctagcggcctatcaattttattgatggccattgctgaggcttgagtaggtaaacaaagtggcctggaggctcgaactgggtggagcccactgcagctcaaggaggcctgcctgcctctgtagaccacctctgggggcagggcatagccgaacaaaaggcaacagaaacgtctgcacacttaaatgtccctgtctgacagctttgaagagagtagtggttctcccagcacggagtttgagatctgagaacggacagactgcctcctcaagtgggtccctaactcccaagtagccaaactgggaggcaccccccagcaggggcagactgacacctcacatggctgggtacccctctaagacaaagcttctagaggaacgatcaggcagcaacatttgctgttctgcagcctctgctgctgatacccaggcaaacagggtctggagtggacctccagcaaactccaacagacctgcagctgagggtcctgaccgttagaaggaaaactaacaaacagaaaggacatccacaccaaaaccccatctgtacgtcaccatcatcaaagaccaaaggtacataaaacctcaaagatggggaaaaaacagagcagaaaagctcaaaattctaaaaatcagagcacctctccccctccaaaggaacgcagtcctcaccagcgacagaacaaagctggatgggaatgactttcacgagttgagagaagaaggcttcagacgatcaaacttctccaagctaaaggaggaagttcgaacccatcgcaaagaagctaaaaaccttgaaaaaagattagacggatggctaactagaataaccagtgtagagaagtctttaaatgacctgatggagctgaaaaccatcgcatgagaactacgtgacgaatgcacaagcttcagtagccaattcaatcaactggaagaaagggtatcagtgatggaagatcaaatgaatgaaataaatccacaagaggagtttagagaaaagagagtaaaaagaaatgagcaaagtcttcgagaaatatgggactatgtgaaaagaccaaatctacgtctgattggcgtacctgaaagtcacggggagaatggaaccaagttggaaaacactctgcaggatattatccaggagagcttccccaacctagcaaggcaggccaacattcagattcaggaaatacagagaatgccacaaagatactcctggagaagagcaactccgagacacataattgtcagattcaccaaagttgaaatgaaggaaaagatgttaagggcagccaatgagaaaggttgggttacccacaaagggaagcccatcagactaacagctgatctcttggcagaaactctacaagccagaagagagtggggaccaatattcaacattcatgaagaaaagaggtttcaacccagaatttcatatccagccaaactaagcttcataagtgaagaagaaataaaatcctttacacacaagcaaatgctgagagattttgtcaccaccaggcctgccctacaagagctcctgaaggaagcactaaacatggaaaggaacaactggtaccagtcactgcaaaaacatgccaaattgtaaagaccatcaatgctaggaagaaactgcattaactaataagcaaaataaccagctaacatcataatgacaggatcaagttcactcctaacaatatgaactttaagtgtaaatgggctaaatgctccaattaaaagacacagactggcaaattggataaagagtcgagacccatcagtgtgctatattcaggagacccatctcatgtgcagagacacacataggctcaaaataaagggatggaggaagatctaccaagcaaatggaaaacagaaaaaggcaggggttgcaatcctagtctctgataaaacagaccttaaaccaacaaaaatcaaaagagacaaagccattacatattggtaaagggatcaattcaacaagaagagctaactatcctaaatatatatgcacccaatacaggagcacccagattcataaagcaagtccttagagacctacaaaaaggcttacactcccgcacaataataatgggagactttaacaccccagtgtcaacattagacatatcaatgaaacagaaagtcaacaaggatatccaggaattgaactcagctctgcaccaagcggacctactagacatctacagaactctccaccccaaatcaacagaatatgcattcttctcagcaccacgttgcacttattccaaaattgaccacatagttggaagtaaagcactcctcagcaaatgtaaaagaacagaaattataacaaactgtctctcagaccacagtgcaatcaaactagaactcaggattaagaactcactcaaaaccgctcaactacatggaaactgaacaacctgctcctgaatgactactgggtacatagcgaaatgaaggcagaagtaaattcattcctttattaagcaagatgtgtaacttttggtgtaagctgtttgtattggaacagattgaaaattcctattgtctctctgcccttgaatacctttagccgtggtactgatgtactgatatgttctctaggtaattcacattccaccagttttgaagtacagaattgttatttgctatttttatcagatatgaagtctactgttatacaacctacaaattatgacaaatctctcaaaaaatttgagaaatgaaacattctcgttaaatttagcatggactagtgtgattcctatataattgaataaccaattaaaatgaatattaataaaaatgttaacatatcatctgtttcttcaatttttaagttcctagtagacagtgattgtgtcattgtaattaacttgttaggaaatattatagcagatgacaggatcacagtaatccctgatctaccatgctggtaattactcaaagttggctgtctcaaactagaaatataacgaagagtttccttttcttttttaaatttacctcttttattggcatacattctatttatatcagtaacatctacagaatgtttattgtatgttatagaaatggcaattcaaagcatttaaaaagcaaagattacatactttattatatttgagtctcattattcatcatagttatgcagtgaattgatgaatgctgacctgttgtcctaggggaaatagagtttggtccctgtgagcctctggtcacaacacttttataaaccaaagtgccatttgcattagatgggtttatttgccagtgtcgttgtaaaacaagccagtttcttccacataacccattccctgtgtaacctttagcaaatattaaaaaatttcttttgcagcctcctgatctgcagaagctgccttgccttcaaatttaacggtttcatgccatatcaccttttgaacatgagacagccagcactagccaagaagggtttaacgttttcctgaccctgtgtaaagagaccatgaatttctttggctttcagcttcacaacattgctgttcaccacacttactgtttaattgatcgtcatcccatgaatccacaaagttagccacttttctataacttcatcacatgctatagatgttactgtagcacttttgggaatggcctcatacacagattagcacattttctcttcatttttctggatatatcatattgttgaatcattgacattgaactcaaggccagtagcactataattcatacctgaacaaaagctcgtctaatacatacacatgtatggtgttatagtgtctctgtaaggcacatcacagccttcttgcacttaggaacactagcacttcagcattacacttgggggccaccataaacggcaaaatcacaacaaaaagcagaaaaaagcaaaaaacctggtgtcatagatgtcgagacggatgcctgttattacagtatgagaattgaaacaagaaggcagagcatggtcacggaggccccagctgggagtgtgcatgctgaatgactcagttttcagctgctccatgcatgtctgaggtcatatgatgtcagaacaccatgagggttgattttgggattacaaataattttagcaggtaggaacatttgcaaatacataacctgcaaataatgagaatcgatgtaggtaaaatagctacagcttttctatatcaggatttttatatcttttaatagatgtaaagattttaatagatataaagatgaaaagattttcacatcttttaatatctcatttaaaaatcaattttgtactgaatttcatggctacaaatgaaatataagaaaatttctcttattttctctcccatccaagtactcaccaggcccaatcctgcttagcttccaagatcaggtgagatcaggtgtgttcagggtgatatgaccgtattttatattctattaattggacatctttttttccatgtaattttctctctctttccaagctaggcagtagtggcttagtatatgatatgctcctggtgtatatgactttaaaagaagaatcagtgtttggcttttggctttggctttttattttatttgtttatttattttcagaaagcatctcatatggttaaaaagaaattcagatttttatgctgaaaaaggtacttttttggtacgtagctttaaaattttaggttgagaaaagtgtacgtaaaaatcttgaaggaaaagatggagaaatttgactacatacaatttaaaaatgaaaaaccctgttgttaacaaagaagggaactggaactgtattggcaacatagatgataacccaaaggataatattcttatggtatataaagaatttttggctgggtatggtggcccacacctgtaatcccagcactttgggagaccaaagcaggaggatctcttgaggccagtagtttgagaccagcctgggcaatatagtgagaccccatctctaccaaaacagcaacaacaatgagaaacaaaaaaaggaattttgaagaatcattaagaaaatcgcgaacaatacagtgggaacacaagtggtacttttctaaagaagagctacaaacacacgaaaaaggttttgcttgaaatgatgtttggcttcgctagtaattttttaaaaagcaaattaagacatggtatgatttttgcacttctggttttggccaagatttaaaaaagaccaaaaatctaaaaagattaactattagccataatatttataatttaaaaactcttgcctttattcagaggggaacttccaccctcttttaccataaccaaagaggtcctcgttgggagactggctgtcatcatggtgatgtattgacattttggtgtacaagagacttaaaccagttctaaaaggacaagggaatcctttgagaaacctatatacagttactgggccattgagtggcaaaccttgagggaggagatagaaaacaacaaatttcaagcacatgagtgcaaaagcctgaccatttaatttacagcagggatttttcaagtgtgatggactttaccctgcagtggttatttgtctctgtgtggagacaattttgatcatcatgccttggaggatactatgggtttcaactgggtaaaggccagggatgctgctgaacatctgatgatgcacaggatggccccacaaccaagaaccattggcctcaaatagctccaaggttgagagaacctgctgtagagagaagcagcccctgtgcaactgagtcgatttttctgtattgttgcatatgatgaccctggggagttagaaaacatgtttatttatactctgtttaagcagatatgggcatttcaaataaacgttacagttgcaatcacatcttaagaaaatttttaatgcttaaatcacttacttggaaaaattatagaatgtatttttaaattaggataaatcaaaccttactgtattttggtgttttatttacacaaagcacataactcaaactcatggatggtagatcctttttcttctgttcatgtgattaatttcttagcataaatatgctatatgctttaaagttctaatcacaaagatgttatatactttagcttaaaggcccttattaagtaaaaacaaaacaaaataactagttccctaaccttcagataatgtgagaaccataaatttggaagtaaactagtggattatattcacttgagaagtaacatatttgtggagtggagaatttcaggttgtttggtctgagttttcatacatatccaggtcatgattctgaatacttatttaataaaaacacaaaaaaagagctacgttaaaaatacaaacaaaaaatacctttctattacttacctattttcaatgatctaggcacagatctcctcactggtatttgaggattggcagtataggctgtcttatgttctttgatatttctaatggcagacaagagggtattagaaagagtcaagtttgtttttttaactgaattttacaattaacacttaagcagttatttttatggataagctactgcataccatagtgaacttttgatgcctagcacttggcaatttcaggaaaataatttagatttaaaatatggtaaaatgttaaattgtagcataaaaggtttatataattctctctagtatatttgaaaatttccgtaatagcttttttaatttttatttttggagacagagtctcgctctgtcgcccaggctggaatgcagtggtgcaatctcggctcactgcaacctctgcctcccaggttcaagcgattctcctgcctcagccttccaagtggcttggattataggtgcatgccaccacacttggctaatgtttgtattttttgtggagacggggtgtcaccatgttggccaggctggtctcaaactcctgacctcaagtgatccacctgcctcagcctcccaaagtgctgggatgacaggcatgagccgttgcgcctggcataatagctatttttaaaagttaaaaattaacagtaatgacaatgaaagcacacgtaagctactttcctagagggtgggggaggtctcgaggaaaggaaggggcaacatgtttaaaaatcaggaatcctggtttggaaattctttgtaattctttgtaagttcataattttaatagacgctataaaaatagtcctctgctgactccttgcttgaacaaagtgacaggtaaatttgctgcagtgacttttagaaaaagtatacaaatcagtggtttctactgtatttacaaggtattgtagccgttaccaccgtctaattccagagcattttcactaccccaaaaagaaaccccagatccaatagcagccatttcccttttcttctcacccgatccccgggcaccttccagtttttctgtgtatttgtctgttctggacgtttcatgtaaatgaaatcatataatatgtggccttttgtttctggctgctttcacttagaatgttttcgaggctcatccatgttgcagcatgtgtcagtaccttattcctttttccggccaaataacatttcattgtatgaatgatattccattggatataacacattttgtttatccattcatcagttgatggacatttgggttttttccacttttaggctaatatcagtaatactgcgtggatgtacatgtacgtgtttttgtgtggatgtatgttttcagttctttcgtgtatatatgtaggagtggaattgctgggtcatttgggaactccatgttttctttttgaggaactgccatactgtttttgaaagcagctgcaccattttacattaccaccagcaatgtatgaaaacaccggtttctattattgtaccagtttctattattctattattcctttttgtcttttcctttttttttttttttttttattttgacacagggtctcgctgtgtcacccaggttggagtacagtggtgagatcttggctcactgcagcctttgcttctgggctcaagtgatccttgacttcagcctcctgagtagctgggactataggtgtttgccaccatacccagctaattttttttttttttttttgtagagacggggtttcaccatgttggccaggctggtcttgaactcctgggctcaagtgatctgccttcttcggcctcctaaagtgctggcattacaggcgtgagccactgcacccagcctattgtatgatttcttgattgaagccatcctagtggttatgaactagcatctcattgtgattttgatttgcatttctgtaatgactaatgttaagcatctttttatgtacttactggcctggccatttgtgtatcttttttggagaaacatctgttcagatcctttatccatgttttaattgcgttatctgtatttctattgttgtaataattttattccaaatagaacttctttatcagatatatgatttgcagggttttttgttttttgtttttttttttttttttacattatgtggttgtcttttcacttaatggtgttctttgaaacacaaaactttttaatgttgaagtccactttattttttctttagttgcattttgacatgatccctctttttttttttttcttaatagctgactgtactccactgtatggatgccccataccgtattcagccagttccttattgatttactattacagatagggctatgataaatgattttatgtatacatcattttgtgatttttgccagtgagattggtgggtcaaagagtaaatgtatatgtaattttggtgattattgccatgttcccctctctagagatggtgacattttgtgttcccaccagtagcgtatgagaatccctatttccctgcagcctgtagagcagagtacattgccaggcttttagagttttgctagtctaataagtagaaatgatatattacatgtaatctaaaaattgctctgctctaatgatgagataaattaagcatcttttaataaatttataggccttttgcattactttttgtgttttctgcttgtccatatcgtttgctcatttttttaaattggattttggggcgtattctgaaatttcagaggttctttacatattagggatattagctctgaatttataagttgcaaatatttcttacacttttgcctattcaatttgtcacttatatttttactttgtttaccgtgtatttgggatgtgcaaagagtttacttttgcttattttggggttttgtgtttgtttgcttgtttgtttctactctttggttttaaaggaatctactcatattttcatctaatacttgattttgattttctgatttttgattgtatttttcattcattcttttgagttttctggatatataatcatatcataggtgccatctgcaaatagaagatgttttacctcttttttccagttctgattcctctgattgccttctcttatgtaattgcattggtaaatacccccaaagcagtattgagtaagaagggatatagtgaggatccttaactgtttccttattttagcacaaaatcttctaatatttctccattaagtaaaatgatggctttgaagctgatatgtatacaggcgtaccctggatatattgtgggtttggttccagaccaccacaacaaagtgaatatcacagcaaagtgagttacacaaatttttttggcttcccaatatggataaaagttatgtttacactttaccatagtctgttaagtgtgcaacaacagttatgtctaacaagacaaatgtacagaccttaattaaaaaatactttattgctaaaaatgttaacaatcatctgagccttcagggaattgtggtctttttgctggtggagggtcttgccttgatgttgatggctgctgactgattagggtggtggctgctggaggttgggatgtctgtggcagttccttaaaataaggacagcaataaagtttgccacatcgattggcttttcctttcatgaaagatttctctgtcatttgtcatgctgtttggtagcattttacccatagtggaacctcttttcaaaattggagtcactcgtctccaaccctactgctgctttatcaactaagtttatggaatattctgaaacctgtgttgtcatttcagcaatgttcacaacatcttcatcagggttaggttccatctcaagaaactactttctttgcttatccataagaagcagctcctcattcattaaagttttatcctgagattatagcaattcagttatatcttcatgctcgacttctaattctagggctcctcccatttccaccacatctggagttaatttgcccggatccatcagaggaatcactatattagctttagatttaggaaatgtattctttaataagacctgaaagttgaaattacttacttttttttttttttttttttttttttttttgagacagggtcgtgctctgtcacctgggctggagtgcagtggcacaaacagggctgactgcagccttgaactcttcggctcaagtgatcctcctgcctcggcctcccaaagtgctgggattacaggtgtgagccactgcgcccagctgaaattacttcttgatcagtgggctgcagaagggatgtcatgttagccacatgaaaataacactaatctccctgtacatctccattagagctctggggtaaccaggtggattgccagtgagcagtaatattttgaaaggaatctatttttctgagcagaaagtctcaacagtgagattaaaatattctgtaaaccattctgttaacagacatgctgtcatgtaggctttgttgctccatctacacaacacgggcagagtagatatagcataattcttaagggcgctaggattttcagaatggtaaatgagcattggcttcaaattaatgttaccagctgcattaagagtcagcctgtcctttgatgatttgaacccaggcatcatcacctctctagctatgaaagtcctagatggcatttcttccaatatgagactattttgtcttcattgaaaatctgttgtttagtgtagccaccttaatcagttatcttagctaaatcttctggataacttgctgtttcctcctgtacttttatggagacagcttttttcctcatgaataacctcatgaatctacctctgcaatcttcagacttttcttctgcagcttcctcacgtctctcagccttcatagaaccgaagagagttaggtccttgttctggattaggttttggcttaagggaatattgtggctggtctggtgttctattcagaccactaaaatattttccaaagcagcaataaggctgttttgctttcttattcatgtgttcactgaaagaacgcttttaatttccttcaagaactttacctttacattcgcagctgggatagctgtttggcttaagaggcccagctttccgcctgtcttggctttcgacatgccttcctcactaagcttaatcatttttagtttttgacttaaagtgagagagatgtgactcttcgttcacttgaacgctttgaggcaattgtagggctattaatgcgccggatttcattattgttgtgtctcaaggaggctcgagcagagggagatagatgggagaatgagcagttggtggggcagtcagaacacacacaacatttattgattaagttcactatcttacataggtgtggtttgtggtaccccaaaataattagtaacagcaaagatcactgatcacagatcaccataactcaataacaataatggaaaagtctgaaatattgtgatacttaacaaaatgttatccagagacatgaactgggcatacgctgtcagaaaaagggcagtagacttgcttgactcagggttgccacatcagattttttttttttttaaagaagcaatacttgcggagcacaataaagcaacttgtaaaacaatgagttatgcctgtatattaaagcagtatccctcaattcttagttattgagggttttttatatgaatgaatgttgaattttgtcaagtgctttttcagtatctctagaggtgatgatattcttcttagttcttctgatatcatttattatattaatgtatttcctagtattgaaccatcattgcctttctgtaatgatacattaaaaaatatgctatttttattctgtttgccaaagtttatttaagattttggcatggatgttaataaacttgtttgtagcataaatttacatgtttattggtatatgtatgtgttgagtccaaggcagttgctcagtttcatgtttattccctggagcccctttcctaagcctggtctgctcttgctgtaatggtgactggacttttttacaggtctgctataaagctcttggtttgggaattcccgttccctgccttcttctgtgttgagtcctgtttcctggacaaggcaagattgcaggtttttctttctcctgatttatttattcatattagtagcttcctgagaaaaggtgcataaatttttttaatatctacatgactgaaatgtctttagtcggccttcactagttgatcatttagagggattagacatttaggttgaaaatactttttctaaagaatttagaaggctttcatctatcattttctagcttccattttgttttatgaccgctccccatcacccccccactacctgggaagcaactctcagtgttttgatagtctaagctgttgtgctttggccttctttctattcatatgttggacagttagttgatgggccctttctatttgcaaatggctatttttcagggctaggaactcttcttgaataattttttccttccattttattattcagatattatatcatgtatttttcttgtctcctattgtgcattccttatttttttgttctactttttgggagattgcctcaaatttattttctaaccctttaacggaatttgttactcctcatattttaaatgttcctgaatattcctacttataatatcctatttatggtttatagataaaattctatttctaactctttcatattaattacatatattttaaaaatgtttactgtttctgcattttctgtttttaattcctccttctcccccaacctttaccctcttctgtttgcctgatgtgtcctctttctttattgagaagctagtctcaaatacctggttatctgtggctgtctgttcacatttaagggtgagacactagaaagctagtgtgaacagttgtcttggactcaacacatacctatacctattctgcgtgagttggatttactgttgggatgtcaggtggccagatggctttttctttagataccttcacatgtcagtgtctaaagagtctttctctgggaacatttaatttctccagaaaggtattgtttggtttcttgcctgagcctgagatctggaatttggctgtggaaagggaatgccaactatttttgattgattatgtagcattttgcttaacactgtgttcccctcacaccctactccagcttaaaatcccttcagttgctgtgtattgctgtcatattgcaatccaagctacttattgtagctttagattctgtatgatttaatctcagtatagctctcatctgcttttcatagttctgtttacctcattccactgtcctttctgcttcaaacataccgagttctttctcaattaacggcttttgcatgtgcttcccctttgcatggctagctctctttcactatttaagtctttcctcatgtgtaatctccttgactttctaggataggcagggttggttaggtgatgctgtgatatcaagcaacctcaaaatctcagtggtttaaaacagtgattgttgctcataatacatgtccgtcacagatgagctgggagctctgctgtcatttgtcctcattctagtatgtaggctgaccagagcagccaccaattggggattgccattacccatagtataaagaaaaagaaagcatagcaaatcatagtgaactttcttaaatcatccattgtgcaagtggtataaatcccgtttactcagattccatttgtcaaatccacacgtggcctcacctaatttcagtgtggtggggaagtgcattgtcctaattaacagtgcattttgattgaactagaaattggagaatgactttcttgagaagaaaaaaggtaggacagtgtatgtgtgttggagaggtatatgtgaaagagattaattgacttaagtaggaagataattacataagggtagggtttgtaaatacagaggtaagacccaaaaaagaaaactaaaatagttgacagtgattggcttagggtggcaggaagagggggtagggggcttgggactatctgatttttgaaaaatcatgtgtatgtagcattttaattaaaatgacaataaaatttaaataatcctagaccttcatgtgacctctcttctgtctctttccggctacttttccatctacctcctttacttttgtcagtcagtcttctggaaagagttctctatttcagtttctccacctgccacttactccttaacccactccagtccagttggggtgctattatttcactaagacagctcttgccaaagtcaccagtgaccaacatattgctaaatctagtggatattttcagttctttctgctttttgacatcctagcaatattctgtactttctgaaatcttgccttcactggacttctgtaagacagctctcctagatttgctcctagttcttaggggcctaggtcactttctaccatattctctcctggggcagtctaatctacatttatggtttcagttaccatgcttaggtgcctcacaaatcttcagcatatatccccagctcactagctctatctccacatacctacttaacatctcccttagatgtctaaaagacacctgaacttagtctgtctgaaaccaaactcagcacacagatacatataccactaccttctgcaaacttagtctccatcccagatttcttatctcagttgaaaacaccccagtgtaacaccctgggaaaaccggaaatctaagcattatccttgacactcacctctcccttcttcctagtccaaaattaagttgtgatattttttcctcattctacaccctgtagccagagttaacttaaaaaacccattattttccaaagctcccattggtcttgcattctttttgttgcttttccttaattaccactctcctcttcctcattttaaaacttactccaaagctacagtaatcaaaacaatgtggtattggaataatatagatatgtagtctagtaataatatagatttatagtctagtggaatagaatttagagttcagaaataaacccatacatctatggctgttgatttttgacaaggatgctaagtccactcaattgggaaagaataatctcatcaacagttggtgccaagataacttgatttccacatgtacaaaatgaaattggaccacctacctcacatcacatataaaaattaactccacatgtgtcagtaacctaaatataaaagccagaaccctaaaacttgtaaaacagtttaatcttcctgacctttggttttgcaatggattcttaggtatgataccaaaagcatgagcaacaaaagaaaaaatagttaagttatattttatcaaaatttgaaagttttatgcattaaaggaccttattaagaaagcgtaaagacggtctacagaatgggagaatgtttgcaaagcttatatctgatactggattggtatctagaatatataaagaacacctacaactcaacagcaacaaaaagacaacccaattaaaaatgggcaaaggacttgaatagacatttctccagacatatatacatatccaataaatacatgaaaaggtgttcaacatcattagtcattagaaaaattcaggtcaaaaccccaatgaggtaattacttagatggctatgattttttttaaagtaaaaaattaggaataatacgtgttggtaaaaatgtggagaaattggaacacttgtacattgctgttgggattgtaaaatggtgcagctgcttatgaaaaagagtttactaattcttcaaaaggttaaatgtagaatttattacatgatctggcaattccacttctgggtatatgccccaaggaattgaaggcagacccaagcagatacttgtatgccagtgttcactgcagtctcattcacagcatctttcaaaagatggaaactacccaagtgtccatcaacagttgagtggataaacaaattgtgatttatccatacggtggaatattcttcagccataagaagaaataaagtactggcacgtgcaacaaaatggatgaacctagaaaacacactaattgaaataagacagacacaaaaggacaaatactgtatgattccactcatgaaatatctaggcatattaatagatacagaaagtggatttgaggatgctaggggcttggaagagcagagaatggggaagtattatttaatggtctgtagtttggggtgataaaaatgttttagaaataggaaatggtgatggttgcaaaacactgggaatgtaaagtagttagtgctgccagattgtgtactcaaaaatgggtaagatggcaaattctatattaatatatatttcgctacagttttaaaaataaataatattatgttccaaaaaccactgaattgtacacttcaaatgggtgaattgtatgtgaattatacctcaataaagcttttcaaaaaataaacagggtaacaattttctcacccaccattttgttttataaactgttttgtcaaattgaaaagtcctgaaatatccttttgctttactagtataactaaaaaagtaattaaaaaattttttaaaaggtgaatagagagttcataatgacctgttttgctatcaggaaccttgatcaatgtgttacatagcagtatttcccattcttaatctaatgtactttgatccaaacaaacaaaaagctaccaggagatccattctaagggctctgtattgccagttatccatgttctatgcctgccacatatggaaagcatacagcagattgattatcttgggggctcttggggcagtattattgatctttacttttcttaatacctggtagttaaccatttattattatagactagattaatttctcctcctatttttaaagttttttttaatgtggcaaatacacataacatataatttattatctttatcatttttaggagtacagtttagtgtatttaaatgcatttataatgtgcaattctcaccatcatccatctctgtgattctttttattttgtaaaacttaaactctatacccattaaacagtaactcttgataccccctggcaaccaacaactaattttttaacatctcaggtttggctggggagagtgttgaatcagtaagtatttatttagcatctactttatggtaaaagttattaggggcatgaagaaggtttaaaatatgggatgctttaaaaaactgacaatactgctgggcagacaatactacatatgcaataattgtataggaatcaatgataacatggaatttattataattataccttgtatatatgtagcttatacatgcaagttataatgaaaattgtggggcaccaataaaagaccaaacacattaaaaaaaactaatgctagtattgataagaatttaatatataatgccaggcatggtggtatgtgtacctgtggtccctcgggaggctgaggtaggaggattacctgagcccaggagaatggagtccagcctgggcaacatagtaagactctgtctcttaaaagaaaatttaacatatgattaggaatgtatcacattttgttggagaagagaaaaatccttcagtgaatcatactagttcagtggttgcttcttcagggaaacattctgtattttcatttaatgccacattcaaaaagtgattccatggtttacagcctggcatgtaaggagctcataagtaaccatgctgtcctaacaacaagtaaaaagctgaacaagcaaaaataataataataaacaaaactcttttagatccatcagggaagtgaaaccatggggtgtactgctgcaccaaaaattggagagacagataggtagatataaagaatcacaacttaccggaacacaaacccacaaggaaaaacctctgtggggatcagtgctggagtaggaaaggctgaactgtaattgatgaatcgctagatgcccagtatggacaactctgagagttagaaacttcagagggacccagtcacgggggagggctgccacagttttgagtttttacctctaggagcttgacctcacagtgaatattgaagaaaaatctccttgtgcttcttggagcgggagggggaaagggatcattttgaaatatgcaagagctttctgttcttaacaaagcctaccctcaggagacatggtattaccaaagcctaacctacctgggggaagggaaatacctaactccagcctactgtagctttctacatggggaaagggaaatatacagcttcaaccccctccagtcatcctgtcccacataaggggggaaactgtacagccctggtgaagttcacagtccagtggcacaggctgtctaaagattgaatctaatcataggactaagacggcctcccttccccacaccttacactatgttattaaagtcctatttagcaagattccttttacccagtacataacgttgacctttcagcaaaaaatcacaaggcctactaaaaagcaaaaaacaacagtgtgaagaaactgaacaagcatcagaactagagtcagatatggcaggaatgttggaataatcagaccaggggttattaaaaactatgattaaaatgctaagagttttaatgccaaaacatgggcaacaagaataaatggacgatataagcatagagatggaaattctaagaaggaatcaagaagtgcgagagatcaaaaacactaacagaccgtaaaaagcctttggtgggcttatcagtagactggacgtgactaaggagagaatctctgaatgtgagcatatgacaactagaaatcttcagaactgaaaagcagagagagacaagtctggggaaaaaaccaatcgacaacagaatattcaagaactacaggaaagctatgaaagatgtaatatatgtataatgggaataccagaagggaagaaggagcgaaagggacagaagcaatatttgagtcaaaaatgcttgacaatttcaccagtatcagacaccaaccaaagatcaaggaagttcagaaaacaccaagcaggctaaatggcaaaaatattatacctaagcataccatattcaaatgtcagaaaagtaaacttgaaagaatccagaggaataaacactttacctatagaggagcacagttaagaattacatctgacttttcttcagaaaccatgcaagcaggacgagttggaatgaaatgaaatgttgaaagaaaaaaccccaccaacctaggattctgtgtccagcaaaactatatctttcataaaaagtaaagatacagactttctcagacaaaattaagggaattttttgccttgtaataaatgttaaaaaaagttcttcagaaagaaggcaaattatttcagttagaaacctggatgtagatgaagaaaggaaggccattcaagaaggaataaggaaatgtaaaataaaaattttttcttcctactaacagataattttttcgaaacaataatagtaactgtgtatttgattatgtgtgcgtgtgtgtgtgtgtgtgtgtgtgtgcgtgcttatgggtaagtaaaatgaatgacagtttatgtgtaagtaaaatgaatgacagtttgtaagtgaaatggcacaagggactagagggaagaattcagaatattgtgttactataaggtactttcactgcccatgaagcagtataatgttattcgaaagtggacttgggttaattgtaatgtatgttgcaaactctagggaaaccactacaaatagtaaagcaagaagtataattgatgtgataagaaaggagagaaaattgaattgcatagaatgctcaactaaaaccacaaaaggtagaaaaagtgtggaagacagaaataagaataacaaagtcaaccaatggaacatagtgacaaacatggtagatattaatctaactgtattaataatcacttgaaatatggcctaaacacagccattaaaagacagagattgtgagagtgggtcaaaaaagtcaacccaacaatatcttgactgccagaaacccactttaaatatacagattgaagagataaagaatatagcatggtaacactaatgaaaagaaaatcagaatagctatatcagtttcagacaaaggacttcagaggtagggaagttataagggataaaggtgggcagtacataatgataaaggagtcaatattctaagaaggcataacagtgcttaatgtgtacgcacctaacaaccaagcatcagaatatatgacacaaaaactgatagaactgcaaggagaaataaatgaatccactactatagttggagatatcaatatgcctctagcaaaaatagattgatctagcaggcagaaagttggtaaggacgtagttgaactcaaaaacatcaatcaactggatataattgacatctatagattacattattcaataatagcagatcacacgttcttctgaaggtcacacagaacattcaccaacatagaccacattcgatgccataaaacagaccttaataaacttaatagaaataatatatctgctgtcagaccacagtggaatgaagtttgaaattaataacagaaagctgggaaatccccaaatatattgagattaaacacacacttctgaataacagggctcaaagaataaatcttgaggaacttttaaatatttgcaactaaatgagaataaaaatagtttatcaaaatcacatgatcttaccaacagatacagaaggagaatttgacaaaacccaacattctttcataaaaactcccaagaaactaggaataaaagggagcttccttgacttgttaaagaatatctttacaaaccctacagctaacatcatacttaatggtaaggaacttgaagcttttccattaagatcaggaacaaggcaagaatgtcccctcaccacactgcctttcaatgtcatataggaagtcctagctgtcttactctattcctgctgctgtaacaaaataccacagactgggtaatttataaataacagaagtttatttctcacagttctgcatgctgggaagtccaagatcaaaaccatcagcagattcagtgtctggtaagggttactctgcttccaagatgatactttattgctgtgtcctcacatggcagaagagatggaatggccaggcacgtctctgaagcctcttttataagggcattaatcccattcatgagggcagagcccccatggcccaatcacctcccaaagtcttcacctcgtaatgccgtcaccttggggtttaatttcccacgtgaattttggagaaacgaaaacattcaaactgcagtactagctaatgcaataagataataaacagaaataagaagcaaatagattgggaaaaaagaaataaaactgtctttgttgacagatgacatgatcatttatatagcaaatccaaaagaattaacaaaaacaccctggaactactaagtggttgtagccaagttgcaggatatgagggtaatatacaaaaatctatcactttcctatttatcagcaatgaacaagtgtaatgtgaaattgaaagcatattatcatttacattagtacccccgaaatgaaatgcttaggtagaaatctaataaattgtggacaagatgtatatcaggaagactgcagagctctgatgatagagataaaagattaaataaatgatgagatattccatgttcatggataggaaaacaatattgtcaagatgtccattcttcccacttttatgtatggattcatgtagtctcaatcagaatcccagcaagttatttcatggatatcaacaaactgattctaaagtttatatgcagagacaaaatacccaaaatagtcatcatactattgaaggacaaagtctgaggactgatactacctgacttaaagacttactgtaaactttagtgaccaagacaatgtggcattggtgacaggacaaatagatggatggaacagaatagagaacccagaaatactcacataaatacagtcagttcaacttttaccaaggagcagaggcaatacattggagcaaaaaatagcccttgaggaaatggtgctggaacaaatggacatccactttcagaaaaaaaaaaaaagaagaatcatctaggcaaagaccttacatccctcacaaaaattaactgaaaatggatcagagacctaaatgtaaaatacaaaactgtaaaactcttaggcaatagcataggaggaaacctagattaccttttgtgtggtgataatattttaggtacaacagcaaaggcatgatccatgaaggagagaattgataagctggacttcgttaaaatttaatacttttgttctgtcaaagataatgtcaagaaaaatttaatacttttgttctgtcaaagataatgtcaagaaattgtgatgacaggctacagactgggagaaaatatttgcaaaagacacatctgataaaggaccatcaagcaaaacatacaaagaacgtctaacattaaataataagaaaatgaagaacatgttctagaaatggacagaagggcaaaggtgggaggatcacttgaggcccagaattggagaccaacctgggtaacatagcataatcctgcctctccaaaacattaacaaataaaacatgagcagggcatggtggtgcatgcctgtagtcctagctactctagagtctaaggaggatcgcttgagcccaggaatttgaggttatagttagctttgactgcacttcagactgggtgacagagtgagaccctgtttcaaaaatactaaaaaaaaaatttttttaagggcaaaagacctggctggacacctcaccaaagaaatacagatgacacataaacatatgaaaatacattcaatatcatatatcattagggaattaaaaattaaaacatcaatgaggtattaccacatacttataagaatggctcagatccaaaacactgacaataccaaatgttgatgaggatgtggaacaatagaagcgctcagtcattgctggtggaagtgcaaaatggtccggtcacttgggaagacagtttggcaggttgttatacaactgaacattttctaaccgtacgaaccagcagctacactccttggtatttacccttatgaattgaaaacttatgtgcacataaaaacatgcacatggatgtttatagcagctttgttttgattgccaaaacttagaagcaacctttcctcgagtaggtgaatggatgaactgtgttatatgcagccagtggaatgttattcagtactaaaaagtaacagtctatcatgccataaaaagctatggaggaaacttaatgcatattactaagtgaaggaggccaacctgaaaaggccacatactgtatgattccaactgtgtgacatcttggaaaaggcaaaactgtggagacagtagtaaaaagaccagtggttgccaagggttagggaaggaagggatgaataggtggagcacagacaatttttaattcagtggaactattctgtatgggcactaccgtggcacatgcttgtcattcatacattggtcaaaacccatgtgcactacagtggcacgtgcttgtcattcatacattagtcaaaacccatgggcattacagtggcacatgcttgtcattcatacattggtcaaaacccatgagtactacagtggcacgtgcttgtcattcatacattagtcaaaacccatgggcattacagtggcacgtgcttgtcattcatacattggtcaaaacccatgagtactacagtggcacatgcttgtcattcatacattggtcaaaacccaagggcactacagtggcacatgcttgtcattcatacattggtcaaaactcacgggcactacagtggcacatgcttgtcattcatacattggtcagaacccatgggcactacagtggcacatgcttgtcattcatacattggtcagaacccatgggcactacagtggcacatgcttgtcattcatacattggtcagaacccatgggcactacagtggcacatgcttgtcattcatacgttggtcagaacccatgggcactacagtggcacatgcttgtcattcatacgttggtcagaacccatggaatgtacaacaccaagagtgaaccctaatgtatactgtggaccttgggtcataatgatatgtcagtgtaggtttgttgatttttaacaaatgtattgctctggtgtgggatgttgataataggggaggctgtgcatgtgcatttgtggggccagggagtatgtgggagctctgtattttccactcaattttgctgtgaacttaaaattgctctaaaaaataaagtttactaatcataattttaaaaaagtaattctccccagcactttgcgaggcctaggtgggcggatcacctgaggtcaggagttcaagaccagcctggccaacatggcgaaaccccatctctactaaaaatacaaaaattacccagctgtggtggcgcacgcctgtaatcctagctacaacgggaggctgatgcaggagaatcacttgaacctgggaggtggaggttgcagtgagccgaaatcacaccattgcactccagcctgggtgacaagagcgaaactccgcctcaaaaaataaaaaacaaaaataaaaaactacaaaatataattgcgtatttttctgatttgagtgtagaaggacttctgatcacaaaagcaatgataaaggaatacatagctagatttcagtaaaattgtatttagtgtttattaagaggcaaagagaaaagcattgtatggataaacctaatataaaaattaatatataaatgggaaaatggtatgaatagacaatgaaaaataatttaaaagtgctaatacactttggggaaaagtaataatatttgatgcaaatatttgaaaacattttatgcagtatactgataaaaaacctgaacctaccaccagaagtaaaaatcgaacctatttggtgttttgaattttcacactgtgctcctccatctctcttccctgcaccctcaactgttcttgttaactattgtgtttatcgtttccttaaagcagttttcacaaatatgtatatatcaccaagcaacttcttgtttaattttgcttattcttaagtttttttctgacgtgttttctcctttattctcccttttgccctcaccccagtttgtgtagaagtagtgtggatataaagtgacacttctgtagactgaggagattgcagtacatctggatttgttgggatagagaatatcagtatcacctaggggcttattaaagttactcagaagtttttgctactttttatttttttttttaactacaggcttcttgagaatcatggtctacttttaccaaaaggagcctgtaatattcctcaaatgtgttggagcagaacaaagattgaagactgtattaatgatctctacaaagagtcttctgttctttctttttgatgtctcaatctttgataaaacataaatgaaggttcactctgggctcttgttatttacataacagctgaaaaaaagtgaatttaataattttatattgaaggtttagtatgttcaaaattgctaggcaccttgaaaaacatgagttataaaaatgaataagacgtatcttagttgaattaaaacaattcttttgaggaattttgtacaaaatacttttgtacaaaagcaatacatttgtaagagatgtataaacaaattgatattagaatacagaggacaattgagttttatttggtttgattccaggagaaaagcctggtcagggaaaattgcattaaagtagatcctagaaaggatagggaaatttttaataattggtaaggggcaggggagaacattccagggagagagaactgcataaacaaagagatggaggtgtgaagtttgggagcataattgggaactgtgagcagtaatgcaatgtgcactcagataaggatggactgtaagatttggtttggccatatcaacaaggaccttaagtaatcagctctctgtacccaggattctaagactttctttttattgatgaacactcaaattgctgttcttttcttatatctagtcacatcactagtcatgtactggatgagagaaggatttttgtccgttttgcttattgctatatccctagagcatagaagagcacctggtgtgtaacacgcatatatgaattatatgttaaatgagtgaatgaatttagatttcataagaaaggataatttatggttgcactttaaagagatcttgcctccatgggtcaagttgtttttggtacctttgtaatatgcctcaaacttcattgtatttctctcacttggatttgtctttccctggcattttttgcaatgttctacgtgggctcttataactaatgatcatcctccttatagtgtacctgtattacaaggtatgtttattttctgtgacttgattcaggtagttctcaaaatctttgatttttaacttcacacctgtttttctgagatgtagcattgcttcattctttaatcttgattttaatcatttctgggaatctgtgacatcacttttagagtttctgctacttagtccccactacattcttctggttatgttatataaatagttacatttactatttattatggtattattttaaaatgttagctttgctgttaaatttaacattttacattttacagctttgctgtattttttatagttctgagcaaattattcatattcttacatatcatgaattgtgaaaaaaaatttacaagttgacttgttacctatacctatatgtattattcttcagtgtttgctctagaaattataatatgcatccttaatttacaatagcctcccttgaattaatatactactacttgcgtaaaatataggaaatttataataatatatttctgcttactcccacttcccttcctttgtgctttggttgttatatattttatttctacgtgtgttataagcctaatgacatctatcaattatttttatctttgctttaaactgccaattatcttttaaagaaattaagaaagggaaaaattggcttttacattttcctacatatttaccattttgcagagttcctcatctctttctgctgaaattttacctcagcgagaagtagtgtctcccttgtctgaatttttatagcacatattgtggaccatttatatgtcatatatgaccttacagttagttccatgtatatgtcaaatttcctctgccagttttagattattttcttggcaagggtcgccgtttatacagttttaactacttcattgtgtctagcacagtgccttagataaagtggacacctgtatatatttttaactatgtaagaatgagtgaaactttgttcatttatctgagtatttatataatctcacaggattgagttgtattattacagttcaccattagatgtcactttctgacatatgttaaatccttaccaatgaattccttccattaaggcatattggattctgaaagttggtgctccaacacaagtgcacttaaacagataaatttttgtacatttaaaagtgattactgtctaaaatggaagtgttcctaagttataatttttatattttcattatgtataaatttatacagaactaactgattttcctaaagttttctttagaacttgaatactggtattgtttttgaattatttgctctgtggagcagcttggaactattagaagtaatagtgtgagaatattcaggaatacctttaaacatgttcaaaatgtattctgatggtggtgtaattctgaaagacatcttattttaggagcctgactgacccagttttctcaggttttgatagcaactatatagtttatttgtgtttgcctgagaaaggaggggaactgagtaggctgtgaagaaacacagaggtagagaaaaaggagattcctgtggctgtcttggccagtcatggaacacagcaaagtgcttccctccctcattctctaaacttaaaagataggaaagggcaggtcaaggagatttcagcaatctcagaaggcttaatgttcactgtatatttaagaacctagattttaaactcagcatgataacatgtatgatctagagagatgtttcagtgcgtccccaatgctaggattcatgacaaacgcttaccagattcctacaagcacgtctctccatgctgagttaagagaatcctctctgtgataccactgctctccggacatccagggtttaacctcttttctttccccatcttgccaggagacagcaggaaaattattgggaggtgggaggtgtggtggcagttttcttcaattcatctggaatactaaaatttgagtaaaataacaatgctgtttcctaatagtgtaataaatacccccaaaacttacacctaatccaagaatgttaccattcttcataatttgtgaccttctagtgttctgtccctcaacctttcacatctcattccaggagtaactttcttatatttaatgttcatggtttgatttaaaataatattgttttcatatatctatgtatgtatataaaatttgatttttaagccatgattataataaactaaagtgccaattagaatatttaaattccattttgtattgatcaaattacaaacaacgcgatgtcaacaaatgaagttttatcttggagtatttctgtgttttagaataaacttaaatgcattttctgaaagtatattggtatgaagtgaccacttatccttcctgggataacctttttaactttttggcttttagaatgtcattcttcatgatgtaatgaaatgaatgatactttatatgaagtaactggtgatgtggatggtagaaaaaaatagaaagtgggcaatactacatactaagtataatcaatagttgagaggtcctgataatgttactcacttatactgataattcattttgtaatctgtttttttcccttatgtttttgtttattactgcagctaaagaagtaaacaggtcatggcacgtttaacaaaaagacgacaggcggatacaaaagctatccagcatctttgggcagccattgagattatacggaaccagaagcagattgccaacattgaccgtattacaaagtaagtaaatttaaacacaaatatctctgtaaaatgtcgtagaagactttgggggaaaggccaaaaaaaattttatctgttatgctaatcaacatatattacaaagaactgaagacactttttgctttgcaggagtattattagaaaaacaaacacagaaacatacacaaacaacttgtgtttagaagtttcatagaaaaattagataaggaaaatatcactatatactatttataatagttttttagttaaccaaatttttaactctatttattgatttatttattttgagacggagtctcattctgttgcccaggctggagtgtggtgacccgatctcagctcatggcaacctccgcttcccgggttcaagtgattctccagcctcagcctcccaagtagctgggattacaggcacccgccaccacgcccagctaattttttgtatttttagtagagagagggtttcaccatgttggccaggctgatctcaaactcctgacctcgtgattcgcccgccttggcgtcccaaagtgctgggatttacaggcgtgagccactgcacctggccagagattcttttattaaaaacacctttagtgaatcacttttatgtagcgaagctatctaaaaacagtctactgtttattactaattttaacataggataggcatggtatgtgtagtaagaaacatcttactactttatagcccactaacagaatttttaacaatttccttctgtattttagaaatcatgttaaataaacattcagttttaaagaagaaaattgtccacccccatcccctagtttctcatgctatttatatgggtagacagattcaggataccaaaaaaaaaaatcaaagtaccttatgaagcttctatttacatgttgtatgctaattataagggagtcttcaattaggaacttggttttgttttgtttctctgggtattcttaaagatataaagctaaatttatcttttttaagtgtttggaattttaaaaataatttagagaaaatttcttgatacttttcacattctttagatgctatgggtagaaatggagaatgggagtaatttacaaaactcacttaaataaatgctttttttggcctttattaataagtaatatattgagttccatgtatttttgtcctttccctgtatgctggtgaagaagattacaaaggctacttaacgatgggctcagtggctcacgcctgtaatcccagcacttcagcaggccaaggctggtggatcgcctgagctcaggagtttgagaccagcctggccaacatggtgaaaccctgtctctgccaaagatacaaaaattagcctggtgtggtggtgcacacctgtggtcccaaccactcaggaggctgaggtgggagaatcacttgagcctgggaggcagaggttgcagtgagccgaggaaaggccactgcactccaacctgggtaacagtgagacccctgtctcacaacaaaccaacaaagaaacccaaaggctacttaagagggaagaaaaaaggagatagagaaggggtgaggatatatgtggctccaattctgtactcgcctttgtggtattttaaagctatgtacaactccttgctcctataagatagtagaagaaaaaaaagataatactatgtgaacaataagaataaaataaatagtacattattttaattattatgcttttaaataaagcacataatttggggtatgataactacatgcaaatgatgttgatgtaaaacattttaaaaaaactcagagtacaaaacagtattttcttatggttgagatttttaaaaaaccatcctttacataaaaattgcttagagaagaatgtttaaataaaataaggttttctttggattcagctttttaaattaaaatcatgtaaacatgacagccgtttcagtttttcagatgacctttgttcatctgtagcatgtttctctagaagctttagggacatttctctaagcagctatcagaatctcccagtgtgaatgttgctgttagattgtgaccaccttctaatctgggagtaagataattaactcccacagtaatgggtggcagatacctgttggattattacaacacgtgtgtgtacatgtatacacatgttaaactgtagtaaaagacatggagattaacaggattgcctgcatctcattttgcattatgtattattgataagcattcttttctctcctttcttcatcagcatagccttaactgatgccaaggcttatttttcttcatgttgtaaggtccatagttttacaattaaatatgaataaatttatttacctaccagatagtcttggtttttattagtctcatctaaagatgaaaaagaaaaagaaagaatcagaggttaagtgcttaagactgggtcccaagtgtttcctcttcctcatctcatctgagaggtatgccatgtttatttttattatgtagctcacatcagagcatcctgtacttccttcataacattaatcacatttgtcattgtttccctgctagacagctccaagaaagaactgtctagaaaattgcctaacccggccagtgcctttgcttcttggctaatattaatttccttgtttattaaacttgcctaaggtaagttaggaagtagcattgcattatggcaggaagtcagatcttttgctctaaagcctaatactcctattctgtactctcggtaggtaaatacttttcaagccttagattcattttcaatcaagtcgctctgcttagtcaagtccgaacataaagataatcttttaaactttgcagatatcttaaggtactgaaggctgtagtagggttactgtcaagaatgcatgttagtcattaagtttcatttcttattttgactgatgagtgacgccattataaaaaaagctacacggtttttgtcaagcattaaaagttgtgggctttggggtgactggctcttagcctggtacaccctaaacactctagtttacttctgtataatggtttagttgtgcttgcttttgttcttttaatctctaggtttctcttcttttttgttgttggtttttttttttttttggaactgattgaagaaacctggccattggttgtgatttttccatagtccggcttttgctgattgcatccctgtagtctagtttaacctgttgctcagtcctttttatttcatggagattgatagctgcatctggtggcttgggggagggggcaagactattccctgggagtggtatgttctaccatcaggacacacatgatgtcagttgtttctcattttgtgatgtacatagcaattgacgctagatccaggaactcattaaggactgccaaatgataatcatccaatctatctttccttttctaactggactgcttctataaggacatagcttcccatcctctgctatttggttaccatgtggtatggttcatatgggaaaagtagaataattcattctctttatgtatttagcagttttaaaaataggatcctttaatggtaaccaattagatttaaaaacaaattgccctttggaattcatgcatttaattacatttcatatatttcagtccattttcgacataccccttattgatgctatctttgaccagttggagcctgtgcagtgctggctcctgaactactttctgcttgttatgaacaagatgtttcaggatcttcttgtacatatcctgccccaggcctggaaccattgatttctcccaggtgctctggtttcttttagttttaaaatgtattttaagagcacctcctggctactcagtgttgctactggtgggtctgtctttctaggcctttggacagagttatgaaatgcatatacttttaaaagataaaaacacctcctgagttcatgctgatattttccattgaactttgtggctactgggttttatttacttaactcttctatctaaaatctttatctactttctgacatggtgagaatcatggttctcagggacatcatctgtgataaaattttagaatctcgtgtagtcagttattttatgcaacattaaatacacagctattagaataagaaaatcttaaatattctatataccatgtatagttatgattatgttattattttcttatctacacacatccttatttagtttggagcctctcttagtatgttggatcttcttttcctgtcttctgtatttgtactttttaattcttttcatcttttttctttttgatttttagtatttttccttcactgcaacctctttttatgtaacattatctggtgtatattcatttttgtgtaccctctaatttagacttcatttctgaagtgattttttttccatttacttcaaatgtttaactcagaattctgactttttcttctgatttatagcttgtttaccttatatcattttcttcatgtcttttctcatgtgttgagaccgtagattctagcttccttctgttttgtcggcttgtctttctggcacatttctgaccatcagggtgtcattctgctgcgtgtgccatagtcctctctgttggtcattcttacgtgaaatcactttccctaaacttgtggcagggcagagtggttctgaatactctttccagatttatggctctaaagttctccctatgccatgtttatgaagtggtaaaaatagagcctaatttttcctgagatttcctgggtttttctccatcttttccccgtttttttttgtggaatcaccttttcttatacttagggtcttttcaactgactgcggtagtagttgttacttttattcgtagcctttctctgtaataccgggctttgtcctggaaaggaactgtgactgcttaattttgagtgtttgtaggccccattaagctctagctccttaagaatttaccacaaattcatgaattaccatgagtcatctgcaaatgggagtgtgtaaaatcctgaccagtttcagtgctattatcaagtgggcctactgtgctttccagcgagtctttgttgggcattttaccctcctatactctctgttccattagtatctgttgtgcctctctgtcttctgtaagggtctcgataccaatcaggattgtagctctcagagatttgttctcacctgctcaaattttgggatacataggagttcgcatgacctaattttgttgtactgtgtatgttgtccaaaggcattttgctttatttggtattcttccagtaactctatctagtaggtttggggagatttaaaaactatgttaccgtcataatcatcccatctcacaacaatcttgtggtttttctttaaaaaaaaaaaaaaaagcgtggtgggggtgggggcgcggggtgggcacagtggcttgtgcctataatcccagcactttgggaggctgaggtgggtggattgcctgaggtcaggggttcgagaccagccttgccaacatagtgaaaccctgtctctactaaaaatacaaaaaattagctgggcttggtggcaggcacctgtgctcccagctactggggaggctgaggcaggagagtcacttgaacccgggaggcggaggttgcagtcagtcaagattgcgcaattgcactccagcctggtcaacgagtgaaactccgtctcaaaaaaacaaaaaaacaaaaaaacaaaaaaaaagacggttgctaaaggcacaggctattttctgaagtttaaaagtggagccaaaagcaaataattccttctgacagaggtaaatcaaaggagtgttctccatgttgtgtactacactggacacatcagaataaatggcagtatcatcttcaaacacaggattctttttttttttttttcttttgagacggagtctggctctttcgcccaggttggagtgcagtggagcgatctcggctcactgcaagctccgcctcccgggttcacaccattctcctgcctcagcctccagagtagctaggactacaggcgcccaccaggatgcctggctaattttttttgtatttttagtagagacggggtttcactgtgttagccgggatggtctcaatctcctgaccttctgatctgcccgcctcggcctcccaaagtgctgggactagaggtgtgagccaccgcgccaggccaggattcttaacatagcaagacttgggttgcagtttaaaaaagaaattccggccgggcgccatggctcacgcctgtaatcccagcacttagggagaccgaggcaggcagatcacgaggtcaggagttcgagactagcctggccaacatagtgaaaccctgtccctactaaaaatacaaaaattagctaggcatggtggcgcacgcctgtagtcccagctacttgggaggctgaggcaggagaatcacttgaatctgggagacggaggttgtggtgagctgagctgagatcgggccactgcactcagactggggaacagagcaggactctctcaaaaaaaaaaaaaaaaaaaaaaaaaaaaaaaaaaaaagaaatcccacaagtagaatttgtggccatttgaaggatttaagtctcagatcctcataattaattgaattcttagggactaataattctcatctctgtaacaaaataggagaacttatctgttctgaatgtttgttccatctaattgtgatggtatttaacttggcggagttcatagcagtaatcattagttgtcacaatatctccccaagaaagagagttccgagtctttttttccccacattcttttaattttcctttttaaaaaactgctgatgttggctcctgcctgaaatgccagcatttttggaggctgagattgggggatcgcttgagagtaggagtttgagaacagcctgagcaacatattgagaccctatctctacaaaaaatctgaaaaattagccaagcatggtggtgcgtgcctgtagtctcagcttcttgggaggctgagggaggatcgcttgagcccaggagatcaaggctgcagtgagctgtgattgtgccactgcactccagcctgggagacagagtgagaacctgtctcaaaacaaaaacaaaacgaaacaaaaaaaccctgcaagtcttatatccaagaaggtagtagggaaggtactgtaagttagataatcactgctaagatgttttgaatatttcagatatttaaaaaccatggctgggcgcggtggctcacgcctgtaatctcagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggggtgaacccgggaggcggagcttgcagtgagccgagattgcgccactgcaatccggcctgggctaaacagcgggactccgtctcaaaaaaaaaaaaaaaaccatacccaagataaacttctttaacaagctccaacattttggcatggaaaatattaaaagggtcagtctgaaatcaaaatatgtatatgtggttaagtctgatttttgattaacgatgaaactgcccctctgatttaaagctatatttataaatttgatttaatgataatatgaaattctatggatgacctcatttgggagctaaataagcacaaataaattttggcctatcagcgaaaacattttacatttttagaaactggaggatattttgtgatgtttaatcattgtaaaatggaaacaaattagtcattttatcatgaagaagaaaatgccgtagtaagttgagggttatgtgtgaagataagcacaggcaatagcagcttctcttttcagtttaaatgtctgtaaatgctaaattatagctagcacatatgaattaatcagttttgtgtaatttgaataggtatcataataaacttttgaaagttatttaacagtaatattaaatatttataaaatatttttatgcttaagatgttagccctcgttttacacattataaatcaagaagtaaaggatgaagaatcatgtaacaacaaaatcagtgacaagtgaaatttaaactttgaatcactgactttcccagtatgagaccatgtgctgtggttcacacctgtaatcccggcactttgggaggctgaggcaggtggatcgcttgagctcaggagcttcaaaaccagcctgggcaacataatgagaccccatctctacaaaaaaaaaaaccacaaaattagccgggtgtggtggtgtatgcctgtagtcccagctactcaggaggctgaggagggaggatggcttgagcctggaaggttgagttacggtgagccatgattgttccactgtgctccggcctgggcaacagagtgagaccctgtctcaaaaaaaaaaaaaaaaaaatttcccagtatgattcataactcattgtcatgttatttctctagatgccgtgtctattttagtatccattaaaaacaagttacatatatcacttccttttcttctttaatccaaacaaattagtcacatctgatttggactattatgacttggctttagaggtttataattattttaagtaatggttataagatagtttaaagacatactgttgaaataagtacagattttatactagtctctactggcattgttggctagagtgtgtgattgagggaggttggcttgttaattatggactactagaaaaagcaattgaagtattggacctatatgtttccttcctgtcttgggcaactttaattttgtgtttctagtggtgattacactgtgagtagtatgattaaactagcattggattggtagactagtcccactcaagtgaatgtttcaggttagggcatcaattaattacttgcgttgcttactttacggtcagaccccagttagaaaatgtgacctctgacctcttgtgacatgtttggcattgacatttctgagttctcctggagttcttcctgtcgctacagatatacataaacgcaaactgtaagtcctcatcacgtgcaggttgcgtgtgaaatttcaactaggtacacattatttctttaactttttgaaaacactttccaggaactgtttatttatgtaagttaaattttgctatgtctcactgtcaatttctcttccttcactggaattattggagaggaagagaatagccattgcctaagttacttctttggaaataagttcattaaaaaacaactgattagtattatactgtttatgtaatcccaaggattctccacagaattgcctgttgtattctcatttccatctatattgattgtttcttacatatcttattatgaaaccagattggcaggtatactgttattattgtatacaataatggccttacagaagaagtaactgattctgaataagtagagtccacagtgagttttttccagcatgccaaattcttaggacattcaccttgccttgggttgttgtctagctgttttcatgtatttcacatttctttgcatgtctatgaagaaaaacatacaaggcacataaaataataaggcggtagtaccaaataacaggagagggtcagtaccacagattggagtctatcagtttacaacactatagaccttatttgaggggacagtcactgtgagaatgcttgggatgccttgtgaagggtacagaaatagtcaggccttgatatttcgatgggattcgacaaggcagagaggcgagtcaaagcatagactgtctggatcaagcagagggactgtagggcttaagggaaagtggataaaaaggcagaaagagttagaccagcagggtctttaatgctagcattgaaatttttatcctgtagcgagaggggaatagcaaatattttttgaatgtagaaatggtaaaagtaaaacacagtcatttttttccaccgcagctggattgactcgagtctgtctgctcttctctgttctggcctgggttttcatccttatgactttcttgcctgtttttccagcccctagctttgctagtctctgtttcttcccatcgttggtgttagagatgcttttcaacaacatcatcagattggtccactgttgcaaacgttttcctgctgcccgtgaagtccacattcccatgcataggtgttgctgtctcgccctgcctcttctgcacaccctcctgcaactccccactctccttaggctccggctgggctctcgcaggccctcagatctgcgtttcccatgctctgccttgggacgcccttcccagactcctccttcaggtgttggtgttatctcctgacacctttaagtcaacctaattctgtcagttatttttctaaattttaggtctggttatgctcttaaaattctcttttgatttcctcattattgataaagtccaaatacctgagcaaggcatttgtacaaagctctttacagtgagaccctgacgtttcttcttttcatacccagcgtctccctactcagtgttccacctgatgagactattctcaattgcctgagcactttatggattcttcattttgtatttttccttcatcagtggacaaaatcatacccattcttttaggatccaactcaaatctcctttgagatttttgagacattccttattcaagcccattttcctttctctttgttcccttagtaatatatatatagatatataatttgatttcattatttattagtctcttaggatctttgaagagcattctgcttccttttgatggtgagcaccttgagggtagggtatatatattttctatctttgtatcttagtgtgaggagtagtaattggaactttaataatattcagctgtgtaaactgtagaagtggtttgaaggagggttataataattgataacattaaatagtcattattttgtgaaaagcactgtgctttatataattatttaattttcacaacaactgtgtgagttatgttgtgatgagtccccttttgttgataaagcttaggaaggtaaaatggatggcccaaagttggtggcagaactaaaattttcatatagatccatctgatattggagtccaagctcttaaccattaaatgtttccttccggcattttttaatggatttgtatctttgcaaactttgaagttttcaaaacatgatcatctgcatggaactaacacattatctcatttcatcctcacaacaactgtgaagtttaaattagccccaccttataggtagggaatgtgaggctatcagggtaaattatttatcccaggtcacgtgttggaattgggaagaaccaagtgcttcaggatgtattctgaaaagttaaaatggctgcagtgatgaaggagccctaacaatgctgttgtaggttttgaagtgtattgctctttgttccatgcaattttgaaatatttgtttgccatgaaatattttgttttatttctaaaagtaacataaatatattacaagatacttggaaaatagaaaacagaaaaataaccctctgtaatttctctacccgaattcaaatcagatactcattttgattttttttcccattcattttcctacatgtggttgttgtctcagcatcattcaacctttttccatgtcattgcttggccaccgtaagttattatctgtagtggttgcacaatgcacagtgtttcatctggcgagactgcactgtaatatgagctgggcaggaggagaaacaagatgaatgaatatttgttatatgacttacgttatcttatttaccctcaaaacaacagcatggggttgactttactaattttacttcatagatatgcaaatcgagatgcagtgagggtaagtgacttgtccaaagttatgcagctagtcagttgcagaacagatctgtgtgactttgcaggccatgcttttccactctgctttcacggtgcctgtatgtgtcatctgttaaattcttataacagcactacatattccagttatacaaatgaagaatgaggcgagagcttagagggggtgaagtgtgctaagtagcaggaactacttatttaagtattaagtgtgaggcactggactacattttgcatccgtgatatcatttggctcctcctgcagccctgtagtattgtctgccttctgaccatcatgctgccagtgttacagtctagaataacttgaatgttttcaagtttttcattgtgctccatatctctttgtactttttccccgttttgaattatttccttgctatggacactcaagatgtcttcagtttccttccaccataaattactatgacttgcccgacttttcagtaccacagatgacactacaaggaatttgttggtctgtctgtccagaaagagaaattcctccctgatttcagggtatgcacacaggtgcctaatctgactgagctctcaagaagggccacctccgtcttcgtgctgggtagcgctgtgcacaaggggttttattttcctgcgtatctgcatttgcttagtgctgttcagttgcccacattttgtcacttggatgtttgaacttggcatttctttatctgttaatgagtttaggcagctcttggtgttcttataaggttttgggtttcctcttctgtgagtccctgttactctctgcttgttttccactgggatattgttacctttttctgttgatttacacggggtgctctttattctaaacattaattcccttataggttttatgctttgtaaacttcttttctcattctgtcatctgtttatttaactttttccatagttttatttcttgaacagaaattttaagttttgaaatgattgtattcaatctcttctgcctaatgtcttatgcttttgaaattttattttaagaagaccttatcctgaaggaggccacagaatattccctacattttcttttactaattgtatagttttatcattatcagataggtctgcaatccatctgtagttccctttttatgtggtaggtaaggatctactttaccttattatcttatgtttcactccatagtaagtctgccttttgctttgggatttaaacttgaaaatcaaaaactcttttgggagatattttaggggcccttacagcattccatatagttaaattatttattagcagtaccgttacttgtgtgccctctgaccctgcaacctctgtatggagtaaggatctcttttggatatggggtatcccaaacacctagaactagtgactggcatgtgacattcactcaacagtcttcaatgatatttgttgagtgctaggtgaatgtaggctttttttcctgcagctagttagtcattctaacaaaaagcttgaaatcgttaataaaaccagactaatagctctgctgttaaccagctgtgtttccttgaggaagtcattttctttccttcctctgtaaactaatgacctgtgcaaccaccatctcaattaagattacaggaagtttttatcaccccaaaagttctttgtactcctttgtactgccttctgctcccttccatcattgatttgcctacggtcactgtgattagctttgcctgttttagaattttatttgaatggaaacatattattttccatgataatcttttcttggttagcatgttttgtgattcatttgctatgtatattggtagttcatttgttttcattgctgagtagtatttcattgtgtggatataccacaaattaaaaaattcattaatctactggagggatatttggggtggtttttttttagtggggagatagggtctcaccctgttaaccaggatggagtgcaatagtacaatctcagctcactacagcctcaacctcctgggctcaagcaatcctcccaattcagcctctcgagtagctgggactacaagtggatgccaccacgcctggctaatttttgaattttttttttggtagagtcggggtttcttcatgttgcccaggctggtctcgaactccagggctcaggcgatctacccacctcagcctcccaaagtgctgggacccaggctggtctcgaactcctgggctcaggcagactacccacctcagcctcccaaagtgctgggactacaggtgtgagccaccacgcctggctagtgttttccatcaggaggcaattatggcaaaactacaatatcctttcatgtacaggtgtaggcatacgttttgagaactacctaggagtggaattgctaggctatgtgataagtgtatgtttaactttattagaaatggcaaaactattatccaaagtgactgttttacatttccagctgcaatctatgagagttccaaattttccactttctctccaacacctggtattgtcagtttttaaaagttcgagtcattccgctcgatttatactagcatctcatggtggttgaaatttgcatttccctgatacaagcatattttaatgtgcttactgaccaattataacttctttcacaaagtattcaaatcctttgcccatttttttatggagttagtttatttcagtattactgaagtgttatagagctctatatatattccagatacaaggtcgctcacagacctgcatgtctagagttctggagggatgtaatggaggaaatgaggaacaatcaacatttatagagatactggctaaaaactttctgaaattattgaaaggtactaatactcattccaggaagcccattgcagaccaaatttaacatgatatccacatttagctgtattgtttaaaaactgcagtatttactaaggggaaagagaagatcttaagtgttgccaatagattttttatgagacatcgtgtatacagatgtggtagttagactcacaaactgacttctgaactgcaatactggaatactgcaaaactgaaataatagcttcagtgtgtgttaagagacagtaactctcagcctagatttatttacctttcaaggaggagggagattcaaataaagacttttgtagacaaatacaatctgagagaaaagaagttctcagtggctaacgtcaggcagaaaaaaatgatctcaagtgaaagttctgaaatacaagaacgaataatgagcaaagacttgataaatatgtgtttaaaattaaaacattaactgtaaaaaataaaaataatgttcaagttgtgaaaaaaattaggctggtgccaccataatagtgatcattcacagtagaatggatagtcatatatttctataacagactattatactacagtaaaaataaactatagcctcacacatcaatatgggttaatttcagatacataatattaagaaagtaatcaaattacaaaagaatacatgcagtatgattccatttctgtaaacttcaaaaacagacaacactgcacagcatgtttttaagggataggcatacataggggccaatagcgtgaagacacagaaggggaaatggtgaacacaaaattaaggacagtggtaaccagctgtgggggtgagtgccaccaggatgggcacattctaggggcttttgtcagagttggtttctgctttctttcctaacataggaggtgatttaactggtgtttgtcttgttcttcacactacacatattttaaaataatttcttatatgtgtaatttctaaatagaaaaatttaaaccaagaagaagtaaatgggaggcatggaagtttgttggggaaaatagatgacacagaagggtaaggacagcgggtcatataactgagaaggattaattgttctgcattgtctaatcactgttgtactgttccctgatgacgtatatctcaatcacagtcaggtctattgatgacccattccactgttttaggtaattcatttcattcagcagtaattatcataatttaagtcagctgtttctttttggctatttctcttttcttctactgaagacttttctgtgccagattatcaaaatgcaaagaatatcctaatcacatggaagttacattattgacatgctgttcgcttctaaacatttctggtaatactacggaaaattttttctgctaagtattgttgtaagtagaattctattcagtgttatcaagaggaattttatatcgaagtgaaagagaagacctagttatttggcttttaattctttttctccaacaaactggataaagtatataattttattatgaccattttttataatcgagttaaaaatgaaaatggaagtttttaagatgtatataatttgaaaatacatgatattacaatttttaactacacaacttattttgaaggaaaatccattcaacaaaattagtaggttatacatcataaaatttgataatcgttgaaattttgtcttagagttgtgttaatatagattgtgtactaatatactaagaagcattgtacaaataaagttagatttagtttggggctagtaaatgaatattaaaaaggaaagtataacattttaaatactggaattcaattttaatataaaaatttgaaacatcctgtttcattgtaagacattgattaattcatgttttcaactggcaaacagagaaaaaggagggaagagaatgtctgaaactggggtaagagtaaaaggggaactattaatagttctgccagtacaacatgtaaatgcaacagtccaggaagcacagtccccctttcatcatgaagaaagaatggaaggtggagtgcttttagttcacgtgtgtgcccacgtgcgcattgtattcatgtatgtgtatcaatacatacgcatggaaggtggagtgcttttagttcacgtgtgtgcccacgtgcgcaatgtgttcatgtatgtgtatcaatacatacgcatggaaggtggcgtgcttttagttcacgtgtgtgcccacgtgcacattgtattcatgtatgtgtatcaatacatacgcgtggaaagtggagtgcttttagttcacgtgtgtgcccacgtgcgcattgtgttcatgtatgtgtatcaatacatacgcatggaaggtggagtgcttttagttcatgtgtgtgcccacgtgcgcattgtattcatgtatgtgtatcaatacatacacatggtatatttcattggaacttctcttttttttcaaaaatattttggggacaattagaaaaaagatacagaatagaagaaggttatatatatcagaaggggatgagcaggatgaggaagaggaaagcaaagtttagtatatgaaatagagccacaagtaaggctaatataagaaagacttctatacctctataaagtccaacagcctgctgaggatgtgttgcagatttgcctttccgttttctagtagctaatgcaaaggagaagcctcaacattttagtaatgtccataaagcaaatcagttgcctaggtaaagtgtagctacttctaatagtactaaaaccagaaagaaatctttagggttttcagaaagttaaccattgtctaagttgcaaagctcgtgtcaggtggcagagtgtagtcctatgtcttgagaagtcatggttgagatttcagaggcaattttaattgaaatgttattgttatgtaataaacaatatgccaaaacagtactctgctgttacttttacttttttccaactacaaaggaaagtgactatcaaacttacaatatatttcaatttcagatgtgaaacaactacattattcttgaacctatggtgatttttacatcattacacagatatgtcattttcattagttgtatcattgttataaactggtaagtaagtttttaaaaagttggtaaaatttggggataggtctaatttaataatgtaaaaagattcaagcaagctgtaaaatatataatttataatggccaaaattgagattttaaattaaaaatatttcctttttataaaatggaaccaaagttaataaaataagtagttatatatgtcacagtaaaaatgttattttcccccaaatgaaaactttgcctgttatttgaaggggtatctaggtctctacctagctttaaaattactaaatgttttactttaccagtttaaatatggtcactgcataaataatagagatcaaaatctaaagtaattatttacagtgtaacatttggggtaatcataatggagaacatttttaaaaaaaaagtataatacctttactgttaacaaaaatataattgaaaggaagggattttttggttaatccccataaaatctttacactgtatctatattcagcaaatactgtaaattatttttaattcagaaataagggaaattaagactcaacagttttgattaaatagaaattatgaaaagggttcatattttagtgttatgaaaactaaaatatttcacctctcgttggcatttttcctagagtcactggaggtccataagaagtatttctgtgcttgatatttagacagtgggacagaactgaaaagaaggattattacactctagcctaggactttacatacaaataggtacttgcatattgcatgttctttcaactcccatgtgagtgtttttattaattgtgtgccatatatctatttgaaatatagattagagagatgcaggcgctaggatgatgatgtctggtggaccaccaatttcacatcaccttaatcaaatcaggaattgacatgattgaagctgggcttttagtgtgtatgcacaccaagctctttccaggttagctttaagcagagtctttcaggatcacaacctagtccgtgggttcttgccaaggctccctttcttggtgcacctgaattacagtttttgtctccctgtccccatgagattgtcaaaagctctgcctagcttctgagcctctcacttgccttttccagaattggcagatgctgctaaatgaattatttttttagtattttctttggtttttctagttttcaatggaaggattgatctgaacaacccaataaattattattggtagcagaactctctctctctcccttcccccctcgctcgctctctctccccattccccttcccatccctccctccctcactccctccctctcttcctccctccctccctccctctctccctccgtctctgtctctttctttctgtgtatgcatgtacgtatgtatatgcatatataattttaaatcttatccttattatatacactgtgagcattttctcataccattgttgtttttcttggagacagtgtcgcctaggcagaaatgcagtggtgcaatcacagctctcttgcagtcttgactttctgggcttaagcggtcctcctgtgtcagcctcctccttgactgggactacaggtgcatgccaccgtgcttggctaattttttaaaattttttttgtagagacgaggtcttactatgctgcccagctggtatcaaaatcctgggctaaagtgaccctcctgtctcagcctcctaaagtgctgggattataggtctgagccactgtggcctgccacaacattgttttttgaaacattaattttattaactgcatagtattctatcaagtggatatactttaacttattttactagtattaacatttagttcctttttttaactataaaattttatgatgtggaaaacatttttttcttttttttgagacagggtcttgttctgtcatccaggctggagtgcagtggtgtgatcacgactcactgcagcctctacctcctgggctcaagcaatcctcccacctcagcctcctgagtagttgggactacaggtgtgcactaccatgcctggctaaataagaaaatacctcagattttctaaaaaggtcaccacttccctggcccgtaggaatgatgaatacacaccatttctttttctaaaacactctaacagaggttttggcagggagggaagggttcaagttagggttagctgagactacagacatgtgctgccatgcctggctagggtgtgtgtgtgtgtgtgtgtataatatatataaaaatatatatataatataaaatatataattatatataatatataatatgtataaaatgtatattatatataatatataacatataatatgtattatatataacatatatacatatatgtgtatatatgtgtatatatgtatatataacaatatatattatatatacaccctatatatataataatatatgttataataaatatgtgtgtatatatttattttttagagacagggtcttgctgtattgcccaggctgatcttgaactgctgagctcaagtgatctcaccttggcctcccaaagtgctgagattacaagcatgagccaccacttccggctggaagcatttttctattaagacataagtcttgccccatctcaagttatttacttagaaatagaatggctgtcaagtgataggattatctgtaaggctgttgatgtgtaatgctggactgctttctagaaagtgctttcaatagcagtgtgttgagggtggctgtcttgatgcctctttactacattgagaataattattttaaatatcttgctgatttaagaaggaaaaattgttttcctgttttagtttcgcatttttagaatataaactttttgtcatatttgtcataaatgtttttccattttattgttttcttttaatttacaaaatggaaattagtgataattgcttcagaggccagaaaaaatgagtttcagatgtttgtgtcataaagaaattcaacatttctaatctagtcaggtattttgcatctcctcctgttatacttccatagcttttatactcataaagtcttttgacagcaagatactagatcaatattcatttaaatttctatctcaaattttatgattctgatgttttcagtcctctgagccagtacactgagccagtagggggccataaggtactgaaattggggggcagtcctaagtcttaaggtgtttatccagattacctagaatacacttaaaataaatttatgttaccatcaacattgtaaaaggcctctggactccacagtggtgtgaactatttatgagggacaagaagacatcacaggcatttgttatgtttttcattgatagaaaacacatcactgcattctgtggtggttcgttcttccactggttgtggctgtttttatactgtttttattaatgtgctcattttccaatatattcatttcaaatgagatggcagaagtttctgagattgaatcattgttagaaggcttaaaagtaggtaattactttcaggaaattatgactcatgagatttcttacttttgtaaaaatgttaaataatcagtggctgttaccatgaaatacacacacacacacacacacattatatatatatgtattcgtcttggaactttcagaatgatctcggggaggggatcatctcaggcctgtggcttggaggcacttgagtactcagcgtcccatggaagctcgcaccctgggagagaagggagcgctctggggtgccagatggtggaaagctgtgggaatgcagtggggtgcgagaaaatgaggaggaagttattgaaaaagttcagagaaattgaatgtatactttaatattagacatttacatgccatttcctgacctgcggtattaagtgaaattaaaatagcagactagaaggccacttatcagtgtatctcaaacccaaattgttctgttttctctttattggaagaagaaaagttcttgttatagattaagcagttataagaaaatgagagacctggagtatcctttatctgaatgctaacaaatatgttttcacatgatgcaaacctgcctgagtacttgatgatctaagaaaatgaataatgaattgggacccattgttacatttgaggtattgtgtaaatcagccttcagagtttattattaattccagaaaatcttaagccttatcaaatatatttggcctgtaatacgcagtaggatcacagtactcctctagttacttaatatttacagtgttctggctcggttctaaccttttgctttacttttgaagaaaaataggtatgaatttctttgaacttatttcttaagaacataacaatatatatttttaaagaatagaagagtgagcaggaaaacataaattcatcaggtttagacattactttatgagcttgtatttcttgacacaaccattataaataatgaacacgttagcccttagatgacacttctaatatatactagatcagttattctttattctaatttgcctaaactcaaaactttccatccagaaaacaaagttattgactcctttgttagattctcaaggtgcatcagtataggaggaagcacttagttttgcgttgttgtcattcgtgtgtgctagttgcgactcatccttcagccatactctctcctgaccttcatctgtgaaagggctccctcattccaacctgctcttcatggcatacatcttttttagtccctcaaagaccaaagatagagaacgaaatgaccagaatgtattgttttcactgactttatttcactttaaaataagaaagttgagcccaacatgctaggactaacaacaaagcagacctcttcttgtgttgtgtgttaatccatgctctatggttgtttcttagtggctaagaaaacccattgtgtggtgaaagtctgtggataaaaatatatcaaggaataataaaatgcagtgccattaaaaaaaaacacttagcaaactggaaagaaatgtcctcaataaaagttatgcatcaaaatcctatagcaagcatcatatttgcatttatatttatcattttatatttataagatatgtttaccaataagcatcctcaagagtcatgtttaatggtgaactgttataagaatcccctacaaaatctaaaacaagataaggatacccactgttactacgtatggtgtgcactttactagaagtcctaatcagcttgatgagaaacaagtccaatagaatttgcagacaaacctgaaactataaagagaggtaagcagactgcccaataaataccagcaaccaccaaccaggaaatactatataaaataaaattccattttaaaaaaaaacagtaaatgtaaaatatctaggaaaaacccaaaagatatgtacaaatcttatggatacaaattataaaaccatattaaagacatagaaaaatatataaataaatgagcatatgtaccaatttcatcagtggatattcttaacttggttatggagatttaactatttttgtggattttggcaaactgactttaaaattactgtggatgaatatgggaccaagaagagccacaatgagtctgaaaaagaaggagaggaactccctaaggctggcaagcttacatgggagcaggaaacttgtatgttctggaggaatggtaaatggtagctacttttttaaaagtaaaaatcgtctagctaatagatacaaatgaaattccaaggggcatactgtggaaaaaagtcttctcccatcccttgttccctgagcccctctctgcagtttctggaaggaatcaagctctagaactcttttgtgcacatcagttatacagtgttttgaaaaatagtagtgtcttataccacgatttttttaaaaaaatgtaatatagagcttatgtcatcttaacacctataacattgcttcatttcttgtgaaaactgtgtaataatccttggtacagttatcagttatttaaccagtcccctaagatatatatttacattatttctaattgtttcttgctgccagcaatactaaaatgaatttccttccttgtatgtgtgttatttcacacatgctgaacaattgtgtggttttgttgtccatatttaaatctgatctatctataatttatagatacaatctaaggtagggctccctctcctttcctaggttagataaccagttgtcccaatgtcctgcattgattaatcagtctttctaccaataatgtgaaatgccacttttactgtaatgaaaattccgatttgttcatcttttttctttgcatcagtagaatttcagaatttacacaaattttgtcattctatttcttcctggaaattttatttttcttactgttgttgtaaataattgagttttggtcttcttttcaatcacctgtctttttggtttctgtatatgaatgctgttagtaaattagtttgtacccaaagaatttattgaactatatacttaatttaaattacttaaaaaagcatatcagctgattttcttgggttttctagatacatgatttgcaaactccttatcaacttttataactagtccagttatgttggttattacctttgcagagtgttaaggaaaagtgacaaccacagacatctttgaatattcttgattaggttacagaagtatttactcattcttgttttgttaagggctaggtattgaattttcctaaatgcctttcaacgtgttatcaaaatcttcatgatagtttatttttgacctgttaatggagtaaactatatttttaaatgtcttcatattaaatcttccttcaattcctagaattagtatattattttgacattgaatatattaatatttatatatttgtatttaatattagattatattcaaatattttatgtaggatttttatatcactatttctacaggtcactgattttctttgtctatgctgttttgtggggttttcttaccattacatgctagattccttgctttcctatgattgtgcactggaagagtttgagtctcattggagttacctggtcattataagtttgatagaagtaacttacgaatatgtctgtagctgatgtttttctggggaagctcttcgcaaacttcttctatttatttctttggaaattggccttttaaaggttctgttttattctgtgttcaggttttggttatttatattttcttataaaatcatagtgtttatatttttacacagaactgaacaaagtagttgcttctattttaatttcctttttatatatagctgtctccctgtagcatttttttgtatgtttgtgctttgtgtcttcactgtgaattagattaggtaatgatacctcttttatttttccctaagaaggagttcttgggccaggcatggtagctcatgcctgtaatcctagcactttgagaggctgaggtgggaggatgacttgaggctgagagtttgagaccagccagggcaacatagtgagaccctgtttctacaaaaaattaaaaagttagtcaggtgtagtggtgtgtggctgtaatcccagcttctcaggaggctgaggtgggaggagcacttgaggatgggaggtcaagcctgcagtgagccatgattgtgctattgtactgcagcctgggtggcagagtgagaccctgtacaaaaaataaaaaataaaaaaaaaggagttcctggattctacacattttcttttttaacagcattgctttagcttttcatttagatcttttgtaatttttaagtaactttttttttttgactcggtggttgtttatgagggttttctggttttgttattaatatctggtttaatttcaccatgattaacaatggcgtgtataacttttggaatctcttcaagtcatctttgtggtgattttgtggtcagttgttatgtatgtcttctggacctattaaaggtgtttttttggtgtcaggataaatcaatagacctgtcctaaggttgttttttttttttttttgtttcagaataaatcaactagataaataatcaacaaataaaaaatcaggccgggcgcggtggctcacgcctgtaatcccggcactttgggaggccgaggcgggtggatcacctgaggtcacgacttcaagactagcctgaccaacatggtgaaaccccatctctactaaaaatacaaaaattagccaggcgtggtggccagcacctgtagtcccagctacttgggaggctgagtcaggagaatcacttgaacccaggaggcagaggttgcagtgagccgagatcatgccactgtgctccagcctgggcaacagagtgagattccatctcaaaaataataataaatcaatagctctgtcttattagttaggtcttctatagccatacttagttttttgtccagttgacttttttgtgaactgagagaattgaattaaaatctcataattttatatttctgtcagtatttcttttatttcctatagttgtttgcattataactatgctctgtcttttttaagaatgatttttgccttgttttccaaatcctatacacttccatcttgacccctgcttcatttaggtagcatttttatgatatgctttttcccatttgttttcagtctttctgagtcactgtttttaaattgttgagtttagcccatttgtatttactaaaaagacaaacatgtctggttttggtcttctcatacgtactacgccttctgtttttatcactttatcactacgtaacacattttctttgagtttcttcagatagcttagaaatgttttaatttttatttttttaatttttttattattattatactttaagttttagggtacatgtgcacaatgtgcaggtttcatatgtatacatgtgccatgctggtgtgctgcacccattaactcatcatttagcattaggtatatctcctaatgctatgcctccccactcccccgaccccacaacagtccccagagtgtgatgttccccttcctgtgtccatgtgttctcattgttcaattcccatctatgagtgagaacatgcagtgtttggttttttgtccttgcgatagtttactgagaatgatgatttccaatttcatccatgtccctacaaaggacatgtactcatcattttttatggctgcatagtattccatggtgtatatgtgccacattttcttaatccagtctatcactcatggacatttgggttggttccaagtctttgctattgtgaatagtgccgcagtaaacatacatgtgcatgtgtctttatagcagcatgatttatagtcctttgggtatatacccactaatgggatggctgggtcaaatggtatttctagttctagatccctggggaatcgccacactgtcttccacaatggttgaactagtttacagtcccaccaacagtgtaaaagtgttcctgtttctccacatcctctccagcacctgttgtttcctgactttttaatgactgccattctaactggtgtgagatggtatctcattgtggttttgattggcatttctctgatggcaaggaatgtgaaggacctcttcaaggagaactacaaaccactgctcaatgaaataaaagaggatacaaacaaatggaagaacattccatgctcatggagaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaataaagccagaggcatcacgctacctgacttcaaactataccacaaggctacagtaaccaaaacagcatggtactggtaccaaaacagacatatagatcaatggaacagaacggagccctcagaaataatgccgcatatctacaactatctgatctttgacaaacctgagaaaaacaagcaatggggaaaggattccttatttaataaatggtgctgggaaaactggctagccatatgtagaaagctgaaactggatcccttccttacaccttatacaaaaattaattcaagatggattaaagacttaaacgtttgacctaaaaccataaaaaccctagaagaaaacctaggccttaccattcaggacataggcatgggcaaggacttcgtgtctaaaacaccaaaagcaatggcaacaaaagccaaaattgacaaatgggatctaattaaagagcttctgcacagcaaaagaaactgccatcagagtgaacaggcaacctacaaaatgggagaaaattttcacaacctactcatctgacaaagggctaatatccagaatctacagtgaactcaaacaaatttacaagaaaaaaacaaataaccccaacaaaaagtggacgaaggacatgaacagacacttctcaaaagaagacgtttatgcagccaaaagacacatgaaaaaatgttttttgttttaagggtgatgtttatatattcagatagtgcactcagtccctgagatagttgttcatgactctgcactgtgggcgtcgaggacattagcacattttccccttcaacattgcttgttctgtcaatgcagttaacagaaggactaagacagaaagagaggtgggaattatgatcagagaacagaacgttagccctgacagtggcaacatctgtaacaatgaggtggagaaggaagaaggtgggagctagtccaaacatgctagttttgtcacccttatttccttgaggacttatgaggcattactcccctgacttctagcgtggaatgtttctctggagaagtctgaggccagtctgatttagctcacactatgttttttatctggatatccaaagatctctttgaagtttagtagttaactggagatacaggtagatacattgacattgatgtgtgtgtgtgtgtgtatatatatatgtatatgtatatatatatatagagagagagagagatcagcgttgaggtttgtttggaggagagtggaaaatggcacaaatccaactttataacatttatttctttattaaacaaaaaagatacaaagcaaatatgccgaatattaacatgagttgaatatagttggtgaatacaagggaatctgcaatgttattctcagtgatccagggtgtgtcggatatatttcacttttttgttttaaaaaaataccttgtaacggtaaatcagggaatgtttgcgtgcttcagtgactcaaagtatatttcactgaaaatcacgtttttgcctgactgatcacaacatgcgtccatgctttccttatatgttgacaagcactcgtgtaatttctaaatgttctctggtgtcatttcctaagttttaggtaaaagtattacaaaatatgtttgtagttctaaggtcctatggttggagattataaaattctaaatgtagaatctgtagagtagaagttagtggtaattgctccctctggaggctaaaactaaatgggatgtttgactacagtctcttaagtgatttatattcgctgatttgggactattttgaacatatcttggtctaatcattacagaagagaatttgagtttaaaatagcatgataattggaagagttgcgtattgaagacttttcctttcttttctgtttatcgtgttcgttctttatcttgttctttatctcaacaggactctcataaatacaagtcataatgaaagaaattaccaccattttcttattttcattcatttttagttttcagtactgaaagatttttaaatttgtttttcctctgtgttcaggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgtaagtacattttatttgataaacatagagatgtgaacttttagcttttaaacattatttagatacaacctatagaaaatcattttcagaagtttaatatttcattttaacatttgtatcaacattaaggctctacattggtagtatggatactttccttactaattatttaggagatgactcacttttacaaagatcctgcttctctatatattaccttgaatctaaaaaagaaagcaaaccaaagctcttttgatgtacccacacttcatggcattcctaagtgttttcgtcaataaatattagcaaaaaatgtttccatgccagataatgttgatgccatctagacagatagaaggggatgaaccgtcttcctagggaaacagcctcagttcaggtaggatggtatcacagcccaaaggcaggcttcagtaggaattttgtggcagagtacaaaggttccaaacgttaagttctcctggccagtgcctacgttgactaatgacaattgcaagttttgtgtactggaacagaaatcaaataggaaagacagaacattaattctctttacgtttttacctagttctcactttgactcctcttttaaatgttgatattttaatctgcttctctttcctttcattatgtacctttaaactcagaggcacatatcgaagtacatttttttcttacgtaaagattgatttcatgtgtaatatttctatcttcctaccttattttattttgctgtttctaataccttgatttaaaatgtgttaatttttacaagggaacatcatttaagatgataggtttcaaatgtaacagatgtggccaggtgtggtggctcatgcctgtagtcctagcactttggaaggctaaagcaggaggatcacttgagcccaggagttcaacactagcctgggcaacatagcccccatctctacaaaaaaaaataaaatacacaaccccatctctacaaaaaaataaaaaattagctgggtgtggtggcacatgcctgtagtaccagatacccaggaggctgaggtaggaggatcacttgagcccaggagtttagggctgcaatgagctatggtcatgccgctgctgtactgtagcctgggcgacagagcaagaccctgtctcctaaaaagaaaaaaaaaaatctatctatagatatctttttcttaaaaagaaaaaaaaaatctatctatagatatagatagacatatccctttcaaaaatctatctctttctatagattgagtttgtgaaagggatagatttagtaattgcatactttgagagtgttttatcataaattctctaaaatctaaaattataaaaatgacatagaatcttataattggttctttgtggaaaaattttccaaaaagtttgagtttattttcttttctggctctacagcagatgagccagcaaacatactaacctgtgaagcctgagagcagtaaactaactagcaagtgcctgtggggaggtggtttatagcaacagctgtgataaggtataaacttagaaaagctgttcacttctttaactttgtttttgtcaatttaatctgcaccttcaaagcttcaggaaagaacattcacattttccagcaacagaaaacatggaagaaaaaatctttactttcactggtgtaatttcatttgtgcactggaagtattcttgaaaagttaagtggaaatctttatataagaagaatttttctattgagttgccttacagaaaagtaaagctttgctgccagtgaagaaacttagggtgccaagacataataaaagtaatgtcaagtggtatcagtctattgcctcaggtatttaaaggagggccattaattgttgataccttattatatactcagaataatccagataatgtaaaatttctaatcttaaaacacttaggaatttatagatagtatagaagactatagtgataatatccaagatttgtatagtaattaactaacagtaagtgcaacttaatctataggattttggtttgtggatcatgtgtacattttttcataaaagcgattttatttctctttactgtttagattggtactttcctatatgctttcttcctcctcaagttgaagtttttttgtttagtttaattcaataagtcgttaatgagcacattatatttttaccactatattaggtcctatgttctaatttttatttttatatgttgttcttgcatatatttatagaatcatccttttttcttctgtctagatgaaatattatatgtaaaccaaacatatagtatacaggtttaattctgattggttctttcttgcaaacatttttattctaaaatggctgtataatataagcacaagtgaatatatcaaaattgtgcctggtgtataaaatatgtaaatatttaaaattcagaggtaatgtagtttattagaaagaagtaagatctcgtatgtcacaaataaacaggggtttcagatccaattcaagcctttatttagttatgcaaccttgaggaaatttcttagcctctgatcctcagccctcagctgtcgtatgggcatattaatatctatttcatttgattgtttgaaagattaaatgagattatctacataaagtgtataaccaggtactcaaagcaagtttttgaccaatgaataaatatgcttacaacaaaaaacgcctgtatataatatagtaaaagcacattagtttcttactaattatacaagcaaaaattctactcagggtctttttacttttcaacctgtattctcaaacacaagacttgtaaagaggttttccattagaacactggatctttatttaaagtgtaactctaaaataatgagacaaattatatgtgtattttgttaccttggctggggtcccacctggctactcagcgactgtccatgtgccacaattttcatgccctgataacactctaggaggaggacatataattgtttcccactaggcacagcacatgcatctcgtactgaccagctttgtgtactttttttaatgtatggccagtgcgtggaggttgttgcatatgggggtgccagatgtgaactgtacaatttaggaagccccatccacatcacagacattgtatatttgcctatttattcaaaagtcaccagtgcatttattctaataaatgaacatacaacaacaagagtgtcttatggaagggccaccttttctagtttgcacatggtgttctgtgggctaatgattgtcctacatgccagcatttgagtctggggcccatgctttatagttttaccaccttatatataggatgaatcactttgatgtctctaaaaacttgactttttaaactgaaagatgtatgttgtaatttatccatcaagaaaggaacatgacaagtagatgtatatggccttaggaagggaaggcataggatgtttttggttatctatttttaaacgtttaagtcaaagttacaaatattctttacttaggcagttctgttattttttaaatgggtggtaaagctctttttttttccttctgttatctctaaaaattgctgtaaactcaggtggggaaaaggtgtatttatcttgataagtcccacaagttatatctcctgagatactttgtatcagcaaagagtctggactcttgtcttcaattccacaattctgttgataaagagaaagtagacaaaagtgcagttttctctatgctgcctattactgatggaatttaaaagtcagagtttgttggtgttacatttttatttcacctctgctactttttttcaatgcttatttttaaaaatttgaagcaattgagaaatatgcatatattgaacaagattacttttatgaaatctagcaatcatgtaacaaaagcctaactatataatatgtcaggatatagttataaataatccaagtggaagcctatatattttaaggccaagatagtgaccgcatggtgctgagattccttcttttggactgcagttattttaggcattttgggatgctgatctcagccaccgtttgcagccctaatgatcacataagtgatcattcatttggagaaactgtggtaaaattaggtaatagataagcatctttgtggtaatgttttaaatatgaccatatgaaatggtagaatgaaaaaagtaattatttaaagtaaggccactcccaattttaaatggtttgctcaaatattagtcaagcaaacagaagtatacgtactgaggagccaggtgtgatggcacacacctgtagtcacagctacttgggaggctgtggcaggaggattgcttgaacccaggagtttgagtctagcctgggcagcgtagcaagacttgtctcttaagaaagtaaatgcataaaaaattgtgtgtgccaactagtttctacactctatggtcatctcacacttccagattggtctgtcattaccatttactcatagggtccacataattcatttaaaggtattttcataagcttttaaaattatattggaaaaagaccgcaagaccaggccactgagtgaaattttgtgatatctggtcattcaatgttttgttatttcaagacttttttcttttgattttttaaaagaaatgctctatgtccttgtaggctcatatgttgcttcatctgcttgctctagagcaagacacatggatggctgcactaaacccttatttcttcacagtatttcaccacctttattcttaaaatgtgagaagtgtatttcttggacagaattttaccatttgctgggctaagttacatttggtatttagcagctctctgtgataaatataagttaatatcttacgagttatactcttaagcaataagatactcactaaagatgagaaggtcttaacaaaggctttaatgtaatacactaaggcaggtcaccttaaatgatggatcatttgcagataaagcatatcaaataatgtcgtttgcaattgaggcggttagtgttaatttggtgacttccaactttattgacagcccttggcacaaagctagaatattatttgacagatacttttgatctcacatttaataatttagtcaagagtgttgaggatgacttaaaatattaaaaagtgatctttgctgtaaaactacttctccctttacttacctaccaggtttggtctcacagcctcatttccttgtcatagttaatgccaggacaaaaataatatatgagtttaaaatattaaaaagtgatgtttgctgtaaaactacttctccctttacttacctaccaggtttggtctcacagcctcatttccttgtcacagttaatgccaggacaaaaataatgtatgagtttaggaaccacgttgatacttttggttaaagtccttctaccggtatgttttgctgcttgtgactcaagagcaactgcacgcatgatattatactacttttaaataggcctagggggcatctttgttttttgttttttttttttttgagacagggtctccctttgtcacccagcctggagtacagtggcgcaatcatggttcactacagccttgacctcctggcctcaagcaatcctcctgcctcaccctccgaagtagctgggactacaggcatgcactaccacacccagctaattttctcattttttgtagagacagggtcttgctatgttgcctaggatggtcttgaactcctggcttcaagtgatcctcctgcctcagtgacccaaagtgctggaattgcaggcatgagccaccatgcctacacctttttaaatgaaaaggtagaattctgtgtcttttgctttttctcatttaaggcttttgacacatattaaaacagcataattaatgaaaatatatattttctggcttcttaaagagattaacctattggggataaacaagcttaaatcttaatttacagaggggcaagatagacccttcttttctgtcatcatctgttcctcccacctcaaaatgcccagtctaaaaaaagttttgggttatatttctcttgaaatttagcttagctcacatcttttagataggagataggaatggaattgatggctttattcttcagaactaccaccgtaggcagccatggcaagcaggggcgcccttgcgttgttcttgaggaaaatattaagtgaggctaaattcaaactgagcctgactccccaacccccacaacccttttatatatatatggcatattacagtgagaatttctttttaaagttttaggtctttgtctttttcttgataaaattatagttataatagttgtcataagttaatcaatcgtatgttttaagtgcccttagtgcaaaatttgatgccccttggatactgttgatttatttaatatgaaatataccttttgttaatttttaatttttatggataggtgtatatgtttatggggtgtgagatacaacttactctatttacgttacttaccgcagaaccacatatttcttccaaatgtccatgccctatcttagttacaaaaacacaatcatttgccaagtgaattatcggtgattattagaaatcatttatactgtggttctgtgtgcatttaaactataatatacttagaaattattcttgctttggtaaaatactttccttcttattcaagaggattttttgggtcatgctgtcttgttatatactcttttaagtttattatgattgtgtgtgtatatgtttgttttttctttttccttctgtctgaattctgttgcactgagcaatgttgtaatatttttattttaaatataagtaatatttaaaattactggaaatatgtaaccatcagattattatctcctaatgataaacagaatttgttaattaagctaaacctagaattgtagacaattatttttacattgcatctacattaaaatgctatctcaaacacacatacttggttgtgtaatatttatctactcattaagtagaaagagtaaattaaaaattgcttttggattattgatgagggtggattatactttagaacactattcaaacagttcttccacatatctcccttttgacttgactgagcaactctctttctgtgcttcggtttggtctctaagtcagagttaatatttcttgctctatctagcatatagaagcattgtgggctgggtgcagtagctcacacctgtaatcctagcactttgggcagattgcccaagcttaggagtttgagatcggcctgggtaacatggcgaaatcccgtctctactaaaaacacaaaaaaattagctgggtatggtggcgcacgcctgtaattccagctacttgggaagctgaggcgcaagaattgctggaacctgggaggcggaggttgcagtgagccgagatttcgccgttgcactccagcctggcgagattctgtctccaaaaaaaaaaaaaaaaattgttgtgaaatacagatgtgataatgaattttaaaatgcctagcaaagaaatgtgcacacatatataattataagcatgttctatcattttgtgacttggtcagttcctgttctgtgcactgagtagataataataacaacacttcctgggtgctcacattgtgccaggcactcccgtaaggactgtctgcgtattgactcatgtgattcatagaaaaaccgtgtagactgcgtactatcattttgttcattatataggtagaaaatgacacatagagaagctaagcattctgcctgagattatacagctgcgaatgccagggccaggatttgaatcaatcgagctccagagtcttaaccaaatgctatgtgaatgacagagacttagatcaataggctgctgctagaggtggatttttctactagattctgaggacagcctgtataaatttcatgttatggtgaggtattgagttgaccacactcatattcatcatttccgatttttagagaatccagtgtgaaccagttttaaattaataagacatacattcatgtcttacgcaagtttataatggcactgaatttatttattagcaaaatatttttctaatatcattatagttttcacggtacattggcgggagattttctctatgtccatttgtagcttttgtgtttgttagttgaaacgtttcctctacaactagtaatgactcttatgtttgcatgcttctgtcttttcgttattaattagcacattgatagattaccagttaatatcatctgtaaaatagtataagtcatataggaaataataaacagtttggccctgtgtgaaatccctttagccctgtgtattgcctgacatttagcaaagttaagtagcgagaccaagattattttgtttttattttgaaaggcctatagtatgcagcctttctccaggacagcagccccaaacaaggtgaactaattttgcactatgttattttactataattctgctttattttttgtattgtagtttctcttttaccttaggctagcttagttaactcttgctagatttgtttgttaaaaccatactatctttacatggcttctaattttgaatttcatgctagtaggtttgctatttaaaagctttcatgttttgaattggcatttcacatacgctgttactcaggctatctctagagtagctaatgacatctgggggaaccagtgaaaatgcaaacttaggttctttgacatacatgtttgagtgctagtcaaaagcattatgtaaaggatctctatttaccaaaagacaaattgtaggcaacctgtcctataatcaacatgcctgtatgattcatccctcaggaaaatgtttcctggattcagagtctagtaactttgaacttgacttttgcatgttttgcatattctgaacagctattgccgtgattaaaacaatcaacagcactgcttccccagcccatactttctgtctgagaatagagttggttatatgccatcatataaatgtgtccagatgtttctcttttacttcatttgagttatactttcatttctgtaattggttatgaaaaactaggtcaagaattaaacaccctatcaaagatccatttttatcttcatttaatgggtggatggggaaagggtagggatgcaaagaggtaaaggtaatgtggagaggccagaggtatgcacaggaattatactcttgcttccttttgttaattaacctagtaactactataatattttgcccagcacatgaagatgaattaatgtaaaaaattcaagtgatgaatgatggcaatttctttttaatattgagtcaaatataagccaccagaatcccttaagatgtttttaaaacagctatgagtatgaagaaaatatcctgaaatattttgtcttaactttggaaagagtactgttaattaaaagtagaataagatatcttatttccaccaaaacctaatttgtcaatgatttttaatataataattgataaattgaaatagctaaaatgaagcttacatatgagcccatctcaaatggatacaccaaggatgactgttttaatacagccaagcgccacacacatatattgttgtctgtgtgatgccagtgtgcccaactttgtgcagtacatcattttgtgccatgtgcaatcagggttttatgtaaaaatcagtattttaagattccagcccaactgaaattaccataccaaaggaagtttgcagagtgtatacatctgtagcaaataactaaaaatggtcattgtctttttattactttggtcaacacagactgccaatttcttaataaaaagcaaaccggaaagtttacatttttgcaggatttactgccacactctagccatgactctggatgtggtttggaagacatgaatttttgaacattcatgtatctcttctcttttgaaggactgggtagtccttcatatctggcagtcagatatggtcaagcagtaacatgtttgaacctagtttccaaagaagttgctgcttatggagtgagtgctacatgaaagcccatttattgggggagtactgacatcagagaaaacagtaaagctgttccaccttggaaaccgtatagataacaatttatagaaataaaattgatggtggaacccaaatttggaatgtcagggtccctactggaagtggccctgtttatactaactgtggactttacccttgttcatttggttactacatctacaaataaagttgagaattaactcatcactcttagcataaatatattttaagaaaagctaagagtaatatttataaataatgaattctaaattaagagaacttctaacacttgctttgtatacttaaagggtattagctgtataaaaaaaaggtgtcaaaaataagaacatgttgaagaatgcctgtgtacctacagttgtgttcttttatttctaggaatagccccagtcaggaaataaggctacttccttttttgttttctgtggtaatctcctttggataatgtgattaaacctttagtttcacagtttcaatttatttttccaaattcaacagctctgaaaatctgacatcctatcagaacatggacattctgattaatggttattttcaataaaacatccagtgccacagatgagaagataagaatagtgagcatcaccagttattactattctctctgttcccacagtgtgtcaaggactgttatatatatatatgtaaagcagaacaaaacaaaggtttgtttatttgaaatgcgaagctataggttggtttggggttctcagtttactaaagaaattattccttagattgtatttcaaaatgaaagataacattagaactggagttggctttggacatacttcattttggactggttttgctatcacattatcttaagatatttctgaatattaccactgttttaggaaagattttaaaatttaaagcagcaactttctaggtattttccctcttgttttaacacagtaaatgtctttaaattgtttatgatgcctaacttctgatggacattagtttcaattttgttcttagtcattgcagatattgacaaaatgtcatacaaaactattttgtacttttttgtaggactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcagggtgagtacctatgagctttcctgtgctggttagagggttggaattaattcataatagcttcaaaaagatatcccaggtggtcttgccaggtgaacggataaaggactggagggtgggggttatctaatgaaatgatgatactcataaatggacatcacagaacacatacaccgtatttcagggtgtggattttagaaagttttaatcacgtaaaaatatatcctcttcccttcccttacctgcctctggcttatgtgactaatttaatggatggcctttggacatcagaaatacgaaacctactaacatctgttcaatagctactttgtaataaactgtacaatttatggtattcaggaaacagttagcaaaaggcacattgttgggggcattctgtatctatttcccattttatatccatgtaatgttgcctttatttttgtcatatcatgagtttgtttttttttgcttatattttatttggagggtggagggatgagacattgtgtataaagaattctaattatttttttaaagtaaaatgaaattgccccataggtaaaaaaggtactttccacaattacttttattcattgatcccactgaggaatatacatactgtgattgttagttgcagaatgtggtatgtgtgtgtatacgagtgatatgtggtgacttattacatatggcatcgatggtaataaggaattatttgattgcaacctctattattttatacttaactattaaaatacttatttggaaccatgcacattgttgagattactcgtgatttccagtttgttaatatgctttataataacttgcgtaatttaagtatttttttgctttttcaaaaaacattttttcataactttttccctctctggcattagtcgaaaatttcctgttagcatcataagcaaactacagtatatgttctagtcttctaactggctttgtattgcctaagtgtacttagccttgccatatacgttatacttactcattaggcatacaacaggcagttgggatagcattttaaaaaatgtttaatgatgacttgccactcaaatgcctaggtgccaaataagtcatgtcagttccctaagtctgagtaaatcagtatcagttttcaatatgtagacctcctctttgaggtctacaagaatgtctgtaagaaattagtgtaagtggtgctctaagtttcacaatttggagcaaaggagctgtattaatattcatattttattctcttgtggatttcgattgtacattttaaaagcaaatatacatcttccattttctgatagaagtttaccctaggggaagtagaaaattaatgagatcaaaaaaaaaaagaggcaatgttagtagtcacatggggatcctaatatggatgcaggaattaggaaatacagctctgggtatgtctgtgtctctacagccattgctcttttgtatttaatatttaattcttattttcatagtaaataacttaaacgaaaatactgggacttctgaggacaggttaagcttctttgtagatattttgtatttcttatggtaagaatgggaattgaacaattattatacctttgaagaaaatgtttaatacttcttccgtcagaattcactatcaagttgtctgattccattttgtgtttcctttactctttttttttttttctgagactgagtctctctctgtcatccaggctggagggcagtggcatgatctcggctcactgcaacctccacttcctgggttcaagtgattcttctgcctcagcctcccgagtagctgggattacaggtgcgtgccaccacacctggctaatttttgtatttttagtagagacggggttttgtcatgttggtgtggccaggctggttggtcttgaactcctgacctcaagtgatctgcccacctgggcctcccaaagtgctgagattactgttgtgagccatcgtgcccagtctgtgtttcctctactctttactgaatggatgaaatttaaaaaatttttacactgtattggctcacacagaaacatgattaccctattctgttctgttcttctcttttcctttctttttgcctttgtcaatctagacatttttatactgctatataattgtgcttactgaaatgatgctgtcaataaaaatcttgaatttttcattcattttatggtatgtgagctactccctgctaaggctcaaaaaccctgttttctagggtgaggatggagagttttatcttgagctttaaattttccaaagaaatagttattcattttagatccattctattgttttatggtattcaagaaaaagataagtactaacaattcttttcctttgagaaggggtaataataatcttgaaattgtaacggagtttttcatatctttaaggtgaagttattggttgatttgttttaaattttaaatatagtgtcaaaactttgagtaaagccgttttttaggagagtgaccagatttaagtaatcatggactaagagaacctagagtctatagacagaaactcaagaactgtggttccgaatcagaataactttctactctgtttttttttcaatgtttggaaaaatatggattaattagatatgttgataaagaatgatgaagataaggtgccatagccaaattccatatggtaaaaataataaatggaagctaaccattactacctaaaactgacaatgaaaagaagcccttttctaagagtttgcagtgattggaatactattcactcttacattcctttctctcccttacagtgttgaaaaagtcactgagaacaggtgttctgtctcctagctgtcacctgtgttaccagatttaattcagctcaagcagctttatcttacgtatctatttctgaaatattttaacaggacagtaataggcatttttctcaaaaataattttgtgacttttcataataaatctctagaatctataaccctaagaatagttctttggaatgtctgcctttctaaaaaataaacttttgctttatggacacagtagattattattgaaaagtagcttattaatatcagattagattttactttgagaaagatttaaatactgtccagtttcacacttttactgagatctctctcattaaattttagaaaagagattttaaaatttgctataaaaaattcaaataatttaggataagaaaaaattcccagaaaccgtattccatagtaggtaatattctcacagacttcttcctgtgttggtgtgtgtgtcattttgtttgtatctgtatccacatgactttacattaattactggatgtggctagtgtgtatgtactcgacagtaccccagaatgacctttttttggcacctgttatgatttgagagggcatgctgtaacttatgtgaccagttcctcatgtagcaggtgttcatcatttccactgttcggtatggaaacacctgtcaaaggtgacatatgcaaatgctatcctggaaatcatgccccatttccaacttctgaggaggagtcttctcattattatttatttctgcatgaaactgaagtttatattttgttttatttgaattttattttcctgaaatagccatgaattttccaggaaaaaaataagaaaatcatactcttttgtgaaaattgcttttaagattttaagattttgtttacaaaaaagaaatacctttaaaacacaatatagtccattgcattttttaaagatagaaaattatatacatttatgtaattctgtctgaacacctttggtaggataagtttattaacatgggatttttaggtttaaaggatagtgtacacgtttaaatttttgataaaaatcactgacttgttcttcagagtattatacccatgtacatcaacagcacatgaaactatttgtcaattttttgttgcctatttgataagatgaattttttgttgtcgttgtttttttgttttttatgtgtgtttttaggcaggatcttgttctgtcacccaggttggagtgcagtggcacaatcatggctcactgcagcctcaacctcctgggccagcctcctcctgcctcagcttctgagtagctaggactatacgcacacaccagtatgtgtggctcatttttaaatttttttctggagacagggtctcgctgtattgccctggctgatcttgaattccagagttcgagtgaccctcctgccttggcctcccaaagtgctgggattacaggcatgtgccaccataccggctgtctcattttatttttgcttcattttcatatatatagttcccaaattacaaagtcattttatactttgaaggcatggttagagacagacgtgtgcttggacctgcgtatgtgtgcatgtgctccatgcttgctggcttgcaagcctgctggtgaaaatcatgatactgtaattcatgggcaaggcagtctgtcataagaagcccctgggcagccagcctgctggggtggcacattgccttgtagagcagggctgttcgagagcttctttggtggtggaaagggtctctgtgctgtgcagtgtgagccactgaccttgtgtgtctgtggagcccttgaatgtgacttgtagaccaaagaactggattgcagtttgccacatggggcttgtggctaccatattagatagtgcagttttagaacattcatgttctaaatgcctataccactccaagaaagcatctttaggtataaaatactgatctcttgagagtgcctggcatttgtctccccattacgccagagttacgacttggagagttcttaaagaagcatataactacttgactccccacccttcctctccctagtatacacagcagattctatagcagacactgccctgcacagattagtggctataatatctgatagtgttgcttttgctctaatgcctcataaaaagtctgtcagcagaatagctttttaaaaaactctgtagcaaaacaaagtgtagatttttttccccaaaataattggcactttttaggttaagaatttggagacatggtttgaaagtaggcccctatttcctcctctttaatatgtgcatgtttcttacataaatgaattttgatttcataacttagaggagttgtagattcatgttattgcccctatttaaattcagataaatgcagttttcatatttagactaaaattatcattaggaaatagaatttagggctttaaattttgtatgatgtgcttttacagtaagtgagttacagagaaagtgagtaaatgggaaaattacagtgagctacccgttttcttttccatacttggcccgctgaaatggaataccgctccactgaaatccctccaaagagttttgtcttggatttttacaattgcttgataatattaaaattttatattactattctttatatcattaacaaactttggtgtacatcccactttgaaataaaaggatcaaattaagtcacaaaagacaaagtaaataagtcaaggtaatacagaggtgacatattattccagtatgtctttaaaaactggaaaagactcgtcccctacaaatgtttcaggtggcatttttctctgtttaaggatcacaagttttaaattttatgttaatgtacaaattgtagggtgaatcaaaatcagcccacttaacaagatgtagaaacacaagaaaatgcagatgaggaaataaagaagaatctatgtggaagaattttattactaatttcaaaatactttggttctacatctaatccaaaaagctctcccgaatttgcagcacttgattctctgactcatgttcttaagcaagagagctgtttggtggttcttccacgttagtaggaactattcctaaaatttatttgctcctgcccttcttaaaatactcagaatgatacatgttttgcaggaaagttaagactttaaaaatggactcaggagtctatagaaagcatttaaaagtaaattttaacttggaatgttaagcctcatgtactttttaaaaactcaccattgggagtccacctggagctttatcaattgggtacagactggcatgtcagtgttgacttaggtctgggtaggttatgtttgagccatttgtactgtaactttttgttgttgagatagttaaagaaaaaaaaatcatgatgaagtctctctgttgaaattagagaaatttgtttctggatacagttttcatgcttttgggtatgtaggcagtacagtctttttaaattccaacagtaaagagaatgcccatataatgtttagaatgaaaaatgggatcaaatgctgaatgaaaatactttgaacataaattccttatgtatctatgaagctataactgctcttgctttctgatcaggcatattttagtgtgggaaatttattaatattttcaccccaaatgtaagtacttttacactttcaagatacatattaacaaatctagaatggagatttgatttttaaataagtagagattgaagccattattttcttaaatagtagacatagtattgaaaacaactaatgaacattaatcaaatatttttacaatttttaagacaacttataattttatactaacaaaaggagaaagttaattttagaaagattgtgtctgagccacgcacttttataaggtaaatttgcagttcaccacaagcttaatcagaggaaaaaataatgggaacactgataaagccagaggattttaaaaattggatctacaatataaaactataaaatcctatgtattgttatctaggcccaaagaagaagaaaaaaagctcatataatttactgtattaccttcctgtggtgaatttaacagtggttatgatcagaaaggatatgactgtgaaatgttttgtatgttggtgtatttggcctttgtgatctatgttttggtggtttgtttagaatcttattcgaagtttatcttttattttcactctaagggattgagaaggtgatagttggggtgtttcctatatcaggatgcttacaacttaatgtagattaaatggaaagctcactcagtgtttccaaagttcatgaacagaaaatacttacaaagtacatgcagtttccttgtgctacctctgcagtgcagaagcgatgagagggagtgggaaggtaggtagtacttacattggctggatgtcagccccgttaatcaaagaacaagtcatattcatgcctcgacctgaagacagacacatttaagttattttctgaaaagaatggaaagatttattccgctgaagaacgcattctgcctctgccgttcagtcttgttcttcctttagagactagtgttatgtagaaggggaaaggaacaagtagataccaaacctgtgttccataaaatttttctcacttccctttcctattcctaagtcatatagcaagccaccgaggggcttaaagttaccagaaaaagtgcattaatattgaaggataaaatttctgacatgcatagcacccttctctctgtagataaatactattttagcaggtgtgtgtgtgtatgtgtgtacctgtgggcatagtggatttagaaatactacatgtttttttctatcacggtttgttttgtagactatatttgagagatgctttcatagttactaagtcagcccagtagtagactggctgctacaaagctgctcatatcatgtgaactcttgatcttagtcaaaatttgttatcttcctttagagaagaaagagttggccttgtaaaaattaataaatgtagatacagccacagtggcattcagtggcattttgtaaatgtggatgaacaattcttgtgcgttagtaattctgcaggactaacttactgactaaggagtggcctgtgactggagtctcatttgccaggatgttctaagaatccaccttgagacgttcttagtagtttgcattatcttgagttcctacttttacctgtaataaggcatatttgtgatagcttacaggaggtttttaaacttgaattcttataagttaaaaaaactactctcagtttttttacctgagagtatcttatctaccagttggcagataatctgtgggagttaggatgtggctctgtggaatcctgtgtagtttaatgtgattcgttccataggcagaagtgggtaggtcgagttttctaccattaatactagcaattagtgtgatgtactgttcttcaggtctaataggtaggccatttcagtgtgtcagtactgggagtgaaaaaaccgaacaggagtgtatttttagaaaatagttttagaaaatgattttcactgatgggctacttgagtcttagtggtttgaagggagaagtggcaggacagggtaactcatcaccacttccgctggaccagcttcacttttaacttctcaattattgggacttcatataaattatgtgtaattcctttatattccattgttgcaagtgggcctagacgatattacagagtgttttgatttctgtaacaacatagaatcaaaataaatttttaaaaagctcctagatctcctctataatctcagaacacaaaagaatcaaaataaattttaagagaattttatctaagagaatttattttgattattttgttttctgctattacaattatagaggagatttaggagctgtttaatccctaaaacgatataagtaatttatgtgtagattagtatttctccaaataagatctagaggccacctgtacaggaatcacctggtgagcttatttaaaacacagtctcctaccgagcgcggtagctcacgcctgtaatcccagcactgtgggaggccgaggcgggcggatcatgaggtcaggagttcaagacaatcctggccaatatggtgaaactctgtctctactaaaaatacaaaaattagcccagcatgctggtgcgtgcctgtagtcccagctactcaggaggctgaggcagaaagattgcttgaaccctggatgcggaggttgtagtgagttgagatcgcaccactgcactccagcctgggcgacagagtgagactcagtctcaaaaaaaaaaaaaaaaaaaaaaaaaaaaactacagcctccagggttctaccccagacaggctctggggggtaaggctcaggaatctacatttccagtaagtgctgtaggtggctatgctcactaatatttcagtgagctattggtgacattattcttgattgttagaagtcagcaattgatatttcagtgtcatctggcaataaaatggttcacacatcagaaataaaattatttatgttggtcagaatatgctgacacacagacttgggtataactgcttcacattttagatgggtcctcatattcttgagtttagctgcatggaatagtttctctagtaggcaatgaagccagtaatgagtggcaccagttcaattcaactgatacgtatcgaacgtttactgtgtgccagatgctatgcaccgctgaaattgacattatggaccctgctttcacaaaacttactccctctaggggtcaacctgtgtatgtgtactgcccgtgagctaagaatgacttttacgttttcagattgttgaagaaaaatgacaaataatactttgtgacatgaaaattataaaaaattcaaattttagtatccaaaagttttatcggaacacagccacactcgtgatgtatgcattattcacgattgctttgtcattacaacagcagaattaagtagtcgagacagagaccaaccacatggtcgcaaagcctaaaatatttgctctctggccctttacacaaaatgcttcttgacttttggtctagtttgttgtgtaaagaatatactgagtattgggaacgcccaagaaagtttgaagcccttgtctcatttaatcacagacatggggacttggctgaggtgaactctagctgcatagataaatatgtctgaaaaaagaagtctagatttccaattttgcacttcattcctgcttttggatagtcagtgaaccaaaatgaccaagatctccacaagttcattttctgccaaaataggtttctatgactgaaaaactatatcgctataaagaactgaaaattctgtactaataaaggtattcagtcctgaatgcccctttaagtaatgatccttgggcatcattatcaataatcagctatggataaacttggacaagatcaggagtggccaatagtgtcttccaggcagaaacaccgaagggcaccatgctttgtctgttgtttctacctagagtcatccgattcagtgtagcctggcagttacttacaactggcttaagaatcccttgttcaagatgttcaaattttctgttatttttttcttaaaggaggcagccccaacatctgctttagttcttacgcaaacgtctacaaccctgcttcagacatgcgattaccgtcacttttaaatacaacaactttgccatctcatagaatgtttctttcttgatgatttgtaaaagttgaccacaatcactcccgtatgccaccaggtgatacgaactctggattctgacctgaaccctgttacagggaggccttggttgaagaatcctcaggcctgcaaatagagaataggaataattcttcaaagcctgagaaagaattggatcagaaataatctgtacatattataaagcattgtttttatgtttttctgaccttgttgtcaagagctatctgcttagtttacttcagaagctacctctttcttagttgtagctttttctcaagtcattgaaaatgttttggtctggctgacaggtaccagctgaagcacttcagcgtgaacgccacagaaagtggctccacggcttgttaccttagaaatccccagaaatctccttgaacagacctgggacagaatgtgcaatgtcctgttgatttcttttgtgaaataccaagtctctaaattataactggaaagtcttggaaagaaaaccctcaagtttttcaaatgtgaaagcatcttacagcaaatgttttgttcctacaaatcattgggagggattttggttctgtcgagagtcctcttttttgtttgtgtcagttcagcgagaaagctcctcagcctgtgaatctgggagcagcttctgtcggcctctgtggccttcccttgggtagtgtgaggcccatcacagagcagtgcttgagaagggcttcatggtgtccggaatagatccctcatttatcaccaaaaaggtgggtggggcaacaagtagataaaaggaacatggaagctttcaacaaaataatctcctttgactgtgaaattccgtttggtcagtccttctatacagcccaaatcattgacgtttctaactgtaataactgaagaaaaaaccaacccaaatacttaaaacataactcccatagcactgttagcatataaatgagagaagtattcctctttgtgcagtaaagtcgattgagagcatcctagagctggtacgttagggttcaaaataaaaactcaggttaacctcaagatccctttaaaagagcatttgaagatacaccactttacatcttgtcagaacaccagcaaaggttagaatcagggctgctgcaccagcgtgcgcttgtccgtgtttacatgacgaggtctcttaggaagttggtgcagtgctcttaaccacacctatcagaaacccctgggggcttttaggactatgaatgcctagaccccatcccgcagccgattgtatcagaatttctgggggcggcacctgagacatcggtgggctttttcctttgaggtaaaattcacacatacactgacatgcacaagtcttagctgtgccgtttgaagaacagacaagggcgtgcactggtgcagccaagtcccatcaagctacggggaagctcgctcttgtccctgggccagtagatccccactcccacgccctctccccagacagccattcctctgattattttccgtgagggataagtttggcctgttctagaactttttagaagtagatgttgatgtttcttaaagggttcccaggtggtcctaacgtaataaacacttaagtaggatatctgaatctgaatggtgctctgttaaaatgaggtagaagacattcctggggtagttatgaaggtaatatcttcaaagaattctggaagtttcatcagagttgagaagatggggtgggccctacccagatgaccttgtttcctttcatgctttactcactcatttttccaggcccagatgaccacttttgactgcactcagaaggagacagatgctctagcaaactagttctcagcaaatttaaacagacaaaatcagactttcatcctctattataccatttagttttgtgaaattaattaaggcactcagcatgaactatatgcattctgacttccccaaaatagggaaatgttgcttgcacatggtgacaccaaattagcagttcatttgaaaatatttaaacacatagaaccaagtttatgagagcgtgtagtatctacaatttatgtgaattctctatttaaaaagatagaacctgaatatagacctttatttaaactgggtaattacatgaacaagtgttacctaaacttccgtagtaccgtttcaaactaagaacaatctagttaagatgttttagcaatagtgatattaattctgatataaaattctgattctagcagtgcataatctttgcccatatagaaacagtggatggctttattttctaaagagttagaaacaagagacgtgaaagcgcagaaaggaaacaacaacaacagcaactcctgcacataatgcagcgcacggcgccttgagacagaagcaagaggccttgtgctggatgcagccaggctggtcagcagggctcaggcctcctctcccactgtcactactcaagggaccacagagcctagagctaacatccagaggggaagggattcctgccttgttgaaatgatggaaggctgtgcatgatatttagtgaatattaaaattatatttcagcgctacataacagtgttggttgtatctttcctttgaataatatgtttcctattaaaggaactataaccccactgatagtattacaagacttctaacctggtgtagattgctattatgtctgagtttagataaattcatattttaatgacattgatatttgaaatcagttttaatagtgcacccagagtttgagttggcatgagagaaggccatgtagctagaagcatgtgtttttattctccttttaagaagaatgtacattttataagcgccaagaacaacgtagcaatctccagccttcttacgttttctcttccctgtatctgacagttcatcaaactgcttacttagtacagaaagcagtgcaccgaagcatgtccatactagtaagtagctgattgattgtgcttcagatccagggagagcgccttctgcagtcctgtgagacatgcagaatgcaaaaatggaggatcattttttactgtggtctagtgtacaagaggtgcccgctagtatttcgcaaatgtgtgtgtgtgtgtgtgtgtgtgtgtgaaaagcactggggatcttgttaaaaaggagagtggttttaagtgttctcactacaaaaaccagttagctctatttcgccattgcacgtatttcaaaacatcacattgtacaccattaagtatatataatttcattttgtcaattaaaatttttacaaagttttttaaagagtggctaaccaatgctgctgactaaacaaatttaataactagagttcaatgtttgtttaaagttttatctctcaacagtgcctgtggccaaatactgtgctaataaattgcttgagtgagttcttcatatcctccttcatgtggctgtgtcactcattttaaattcagttaagttcttctgttagttttcaaacagagaattctcaagttatatcaatttgtctccccccgcccccaccagaaaaaaagattataaacccagggctcaggaaatttcattgcactttatattccatatctatgccatggacactctgtcttggccatgcgtcagtcacctgaggaataaacaaatgaacaagcaaatacgaatcacaggccctgccaccagaagtcacaacccagatgctcagcgagtgaagcccagccacgttgtataaaagtttagtccatatctctgatgcgaggccagggttgagaagaactgctctgtaattggcgtaaacggagcagctgtgggcacaggccacaaagcggcataaggagagggcactgactgcgttgccagagaacctaggtgagaagtggggtcaggaaggtgcagtgcagacatgaggtaaatgaaattcagtttagtttctcactaataaaatgtgtttccacttgttatttagatattttatgtgtttataaacagtgtacgtacgtataatcaattcacttaagccctagctaaaagttctcagttatgtgagaaatatttgtcctttcctctactgtatttagtgtactgaagtgacttcctatgcttacagttctttcaggaagaattataccattgggcagagaatcattatctagtgacctgaaaaagttaaagcatctattaaaatagtggccacacccactcatttcctctgcagtatgaactgatgatgttcgcgtgcctggagttttgcctttgcttcctttaggctgttgtaatatcagggactttgactaaggaaataggcacacttgtccttgtttcctagctgtttagaaataacatgcgtagaatcctattttttcttcatgtgaagttagacttttttggtgcaataaattgaggaacctaattagcttgcaggctagactaagagttggagttattactgagtagatccatggtgctcagaaatggagatgttagtatgcagctgcgctgtgcaaagtgagtgacacagatttttaaaattaccttttaaacgaagaataatgttgtattgaaattcaccattcattattgctaatttaagatgttccctcaaaggacttaggccattgatattgtttgtaaaataagcgattatcccttatgtctattatttgtttatctaaaaattaagttttaaaataccaagaaaagaaaaaatatataatcctgtaaggatattatatcaggtacaacataatattttaaagttctcaccttgttacattagatgctgttttttttatgcaaatgtcaaagatttctgtcagatatgttggaaaaagagcacttttagtaaactctttgcatactatctaagtgtttcatatatgtcttttacatgaatatagacataagaatgatcagattttgtacctttttttattctttttttttcaatagagcattaagaagaagaatacaaacaaacaggagatgggcacatacctcagattcattgtctcccgcatgaaggagagggtgagtcctgctcagggaatctttcaaaatatcccaaaacacattttactatggttcattctttcaaagttgaatgatcgagaagtaacaaatatgtacatagcaatatgaagtgtggagagcaccccgtcatgtcatatttcttttttgcagtaaacagttctataacaggcagttagattttcttgttttgtctgttttggacatagacattttgacataagctacatgagattagaaacatttacatttttgaatttcattcatcagaatgaacattttcattgatgatgactctttaaaatgaaaggcaatttttcaaaataactattctatcacaactttaaggaatgtcatattaaactatatagtagtatatgtacattttttctgttaagttttaaagtacttcctctgagattttgctttaaaggtagaaaatattggccgggcgccgtggctcccgcctgtaatcccagcactttgggaggccaaggcaggaggattgcttgagcccaggagttcaagaccagcctgggcaagatggcaagaccctgtctctacaaaaataaaaaataaaaaggtagaaaatattttgagctttaggaattgatgtcttacctgccttcctttaaccacatttaaattgatgtactaacaccctcttaggctatagatcttaataaaaaggggaaggacaataaacacccgatgtacaggaggctggtgcactcagctgtggacgttcccaccattcaagaggtaaagtcggtttcttttatttccacttcaagtacattttcttaactaacaagttaaagaataatgtagcagttaagcagattttggttgctcttctttccttgaaagtgtacttttttccacttcctaaaacaaaagacaggcataactaccaaatgaagcattattaatttgtaaatttcatgtgcttactctaatgcaaattaggtgtcatctttaaaaggcctggttttaaagatgagcagcttgtagcttcttgatccttgttgatttaagaaaatgccttacagcctgggcaatttagcatttcagatgtaaagaatgttttccaggtttagcagtggtacctgagagttcctctcagaaaaaaaagtaaagcatagaactgatctgccgtcttgggaaacaataaaatgaacaaaaaaaattatgattagaaaagttaattattcttaaaggtcttaattttaccaactatagctgaggattgttagtttgttcacgtccagtaacaaattgcaacaacatccagtagaacacgtagacatatttgcagtcagggttactgaattactgattttgcacctcatgtgtcatgttggaaatttaaaatcttaacgcttggtcattatagcctatagggagaccacaggaataattttaaatcatcttacaagtttcttttctttttttttttgagacggagtctcactctgtcgcccaggctggagtgcagtggtgtgatcttggctcactgcaagctctgcctcccgggttcacgccattctcctgcctcagcctcccgagtagctgggactacaggcgcccgacaccacgcccacctaattttttgtatttttagtagagacggggtttcaccgttttagccaggatggtctcgatctcctgacctcgtgatctgcccgcctcggcctcccaaagtgctgggattacaggcgtgagccaccgcgcccggccacaagtttctttagtacccaagaaagactgtggctgtattatttcaatataagataagggtaaatgaaggtttttcccttaaagtaactggtaaatcctggaacaaaaccaagtagttttaattttacctcctacccccagccatagccccttctaaactgtaagacctctacagaatatgtaagaacccagacgccccttcttccccactgcctttactcatgcaggttccttcctgttgaaatcctctaagatttgtcacagacagggacacctgagatgttattttaaaattatttataaaccaattcctagccccaattcagaactataaatatatcttagtagttatggtaaactgtcacagaggctaacagttctgttttcaatctcgatcctcctgtgttgtaaagaatgacaggtgtgtgcttagggtctcaccgcccacactggcccaagcattcgtgcactaccaagcttagcagcagctttctacattattgtcaaatgagatgttcaagccattaaagttcactctgataaattaatgtagtgtctttgtggctgcgggatatctgacctgccatgcttcattatactatattattaaaaccgcaggtggcgttgttggcttcttttacacacattctctgtcaatactgtgggatggcagtagtcatcctgatgtcatcctagaaaagactgcttgtcctgtgaacttagtccagacaagtatttttactggtaactcttttcgtcattctgttttttgccctctgcagaaagtgaatgaagggaaataccgaagttatgaagagttcaaagctgatgcccaattgcttctccacaataccgtgattttctatggaggttgaatatttttgttttttttgtatgcatttttaaacacaccatttacattccatgttgaacactatcttttataaaacattactttcaaagaattaataccttaatgatctacaagtttagagtataaggttaggaatatctggtgatatagattatagaatggactggccaaaaacaaaatcatagtatactaaatgatgaaaacacaattactctttacagttttatatgtatttgttttagctgagaggtttttaataagcactatgattaattctgatcatttccccactagtaccacatcatccaaaggtaaggtcattctctataccctgagaattagtggttgtattggatggaaaacaaaagctgcctgtgtaattttattttgctatcgttattttaaatggacattttggtttgaaatggtagatgtctacttttgcaaactgaaagaaaaggatagtaactttgagtcttgtatttgcagactattgcttataggtaatatctatttttaattacagcagacagtgagcaagctgacattgcgaggatgctatataaagacacatgtcatgaggtactattcattgcccaatagttatactctttctataactgaaattaatttatttcaggattccactcttatctacattttagttgtgccatttcctttaaatgtcttttattgccgggcgtgggggctcacgcctgtaatcccagcactttgggaggccaagttgggcggatcacgagatcaagagatcgagaccatcctggccaacatggtgaaaccctgtctctactaaaaatacaaaaattagctgggtgtggtggtgtacgcctgtagtcccagctactcgggaggctgaggcaggagaatcgcttgaacgtggaaggtggaggttgcagtgagccaagattgcgccactgcaccccagcctggtgacaaaatgagattctgtctcaaaacaaaacaaaaaaaggtcttttattttcatgtttgacatacatgaggcaaaggtaaggactgctgtgattggcagcagatattgttaccttcctgaggaatattcagtctgaagtgctaaccagtgaggtccgggcagggcccagtcagaccagcctcagcttctgttccaactgtggcctgagaccagcgacatggttctaagaggacagtgacagggtcttccagtaccatttattgaaaactttaaaatttaggcttaaaagattaagaaacaaaattcaacactatttatatacgtgaatgttaatttacatggatacattttatatagtttaatgtgtatgtatattttatgtaggctaaagtagtttcttttctttttcagctggatgaactgcagctttgcaagaattgcttttacttgtcaaatgctcgtcctgacaactggttctgttatccttgtgtatgtgaaatttttacctcaagtgtgtaacatacagctctaaggaagtttatttccagtttggttaaagattataattttcttcctaaatttttaaaatatcatagtatatatgggtttaatgagtataaacaactgaaaaaaagtaacagggcttgttatccatttctgattttaaaatgagatactgaataaaaataaatattgggtcctttttctttttgagacagggtctcactctgtcgcccaggcttgagtgcagtggtgtgatctcagctcaccgtagccttgacctcctccaggctcaagtgattctcccacctcagcctccagagtagctgggaccacaggcacacgccaccacacctggctaatttttgtattttttgtagagatggggttttaccatgttgctcaggctggtctcaaactcctgagttcaagcagtcctcccgcctcggccttccaaagtgctgggattacaggcatgagccaccacacccagcgtctgggtcccttaataaagtgaatttttgtttctcctttcatcctttcacaagagacctaaggctttgcctttgtctgtagctgtataatttccccaaaataatacagcttcaaaccgtgcactgacaaagggaattctgagcattcttggccggcagccttggctgcctgagagaagccagccctgtgaagacagtactgtgccagcctaaaatttccccatttctaacaaattcccaggggtgctggagctgctggctccccagctgcacttggccaagcgggtgctcttgtttgccaccgtcatacatgtggatggccttgctccagtcccgacctcttctgaggaataaggttcatgttggcactctgatgcaaatataaaatcagtcaatcccagaaaaaaaatctcgtatgtgtttaggagttatgaaagaaatattttagaaataatggattatatgtgactagtttaatattaatggtacacttgcatttaatactttaaaagtaatataacaaggtaaaacatttaatttccagatacctaatcatgagctggtttgggctaaaatgaaaggttttgggttttggccagccaaagtcatgcagaaagaagacaatcaagtcgacgttcgcttctttggccaccaccaccagaggtaatttgtgatcccatgttcagcggtcacagctgtgcttatgaagtccttaagaaagtttgatgatttctccatcagagatgcatgaagtttattttaaattggaaaaaaaaaacacattatgcatccaagaatacgttccaagataaattgtttccagatatttttcagatattgtgtactaaacaggaatttttaataactgacactgttgaacttcagaagcacattacggttaagactgaatttatagtacagtgggcagaagggcctcagaatgtgtccattccataatatggtaatggaattaccattaccatattcacagttactctagttgctccagccatcttcaaggctcagttaaagacatatagactaaaatcgtcaatcttgtgatcttacaatgtgtgtaaatacctgaagcgtgcgtggaaataagccataataggaataaagaattcacatgcaatttatttggttcatttaacacagatattgagataaggtgaaaaagtgacagaaaccagctacatgatctaaaagtcatactttgtaaggatttaaatgaacagtccatgaggtgtctcctgtcatgccaggaggttattagtgcatagagaagctacacaatgagggaccttactcctccctgtggtaaatttttacttagtcttcattaatttaatttaaacagaagtgtagttataagaaacctataaatactgtaaatttcccagaaggtagttctgttctttcataggtagatacacacttacctgacactgtcatgtcaagaaacattaaataatgatccaataaaataactcaatacaaaatgaatgttttaattacattaagtggtaatttttaacatatgcttaatacatcatactcggatggtttcagtttcttatcagaataggcaaggaaataatgtatttttggtaggttagggtaagtctttatgtgagattgtgttcttgcttcactgtcttctaccctaatcttgatacattagtcagtttctctgagccttagcaaaataaaggcctcataagagtttttgtaaggtttaaagaaatgttgctacagagagacctgagcatagtacctagcacatagtgagtactcaataaatgtcagcttttataatacaacagatattcaaggaataacgggggaaagtttgcttcaatgtttttcacattaaataaaacacagttaacttagaaaaaacaagaattcagttatttttatagccatactaataggtaagaataatctgataattagaactttttatctatatatttttctttttcatcaacttgcaagtagctttatactgtcttcaaccatgagtgatattaataatgagttaacttgttagatgtcattcagtatactatgcagaaaatatttttaaagaatatttgggttaggccaggcacggtggctcacgcctgtaatccctgcactttgggaggccgaggcggctggatcatgaggtcaggagatcgagaccatcctggataacacagtgaaaccccgtctctactaaaaatatgaaaaattagccatgcgtggtggtgtgtgcctgtagtcccacctacttgggaggctgaggcaggagaatggcgtgaacccgggaggtagagcttgcagtgagcagagactgtgccacttcactccagcctgggcgacacagtgagactccgtctcaaaaaaataataataataatggtgctaatctgcagcagtcctagagtagtctgtcacctgaagagagaattaggaaacatcagattacattttcagaggtattttttttccgtcaagcttcttaggtcctggaagattttatgtaaatagttctagacagatgggactcttgaggactttattttagaaaataagagaggttgacaaactcactgtgtaaaatcattttcctttttcctggatacaatgtgaacaatttgaagtgaaggactggttaggatatactttatagtcttccatattagaatgtttattttaaaaaatttgatacaattataatcatgaatttttaattatttaagcaacttatgctcaaaaggttctggttgatcaggagccactggttgcaagttttggctaattattcttctgctagtccatcatatcattacatgtaaatgggaggaaaaaaaatgaatggttttgtaccattccctcctagacacgcaaatagaatatgctgctcgtcggagacaatgagcacgttgtaaatctccagcaaaagagtcgagtatgattgtgtttacatgtgagagctgctttagtgagctttttgtaggatttgcaagatttcgcctgccaaagaaaagtagctgataagacctgtcttaaggaggctagatctttctgctgcgagagtggctggtggatggcatggcccaggccaggaaaccaggtacagacaaaaaagaggtagagcacttcgggctcactgacatcagatcacagaaccattttattctgcaaatgtagttagagcattggcagacatagagccagattagactattcctcttgttattagacttaccttaaattgcgggtgtttgcttttttattttttgtagatcagagagcataccccgtgataatcagatttcagtttaaaaaattatctacagtactggagttgattaaaggagaatagaagtacatttaaagaacagatgtgaatccactttatttaagataaataaggaaaatactcttacagatacaagttcattccaggtagtcagcactgcttgtaacagaattctctctcaaaagcaaactactttgaaaaagtgaacaaaccacttttattgaattcctactacataataggaaatcagtaaatatctgttgattggaagagtaaatatattcaaaatctaatggcaagaaactattccacaagcatgatttcatgtgtactctgcattagagtttagtttttcaaagttcagtttactttgatatggtttttaacaaagtacttatgccagatgagacatagttgatataatattaacaatatattcataaataatgttatggaagttcaactctaacaattttagctgttgttagcatctaatgatatagattattgtatatttaaagtgtgcttctagattataaagcttggcttgtacaaggaagtggaaatggttatttatggctgaggcacatgtggccatgattccctaagagattccttccaacagtcataggcccaggatttctggagcgctataattacaggccagggatgaaaactgtgatatcatatatacttatagcaggaaaaaatctttaacagaaaactgaaaagcataaatacgtgtgtttatagtaccatatcgcaacttgtactctaccgtagaaaatgtctgttactcatgcatccatacagtttcctacctcatttgtgatgttccctctgcctggaatctctccactcacattgtctgctgtctaaatcttatcttccaagaccaaggccgaataaaatgttctgaccactcacaaccaaatgttaactgttcctttccatagcaccctagagtacctttaccacctgctgcattgcattataattattccttagttctttctgacaaaattgtaagtccctcaaaggcagaggcagtgtaggaagtgccatcctaataatcagaagacccgagagattccaaccactaatagtttaccttaacacctgtgggcagcatctcttgccgctgtcaaatgaggcaatgaaactcaagatcacgtagaccccattcacttttccattcttcttagtgccttcccctggtacacagtaaacatctgttgaacacaacatttgggatggatacaaatttaagccgagaaagagaccaatgcccaggaaaaagtgttctttccaacagaagcaaatgtagttgtcctgctctagttttagatatgtatcgcacttatgttcacagctaagtacactgtggctaaataatcagtggctctgtgtgttcatctggtttctctaatgagtagaggcatgatacaaatatgacttactggataatatttttagatcttcccattttatatgaatatatgtatgtatcttatgaaaatttttgggcattttcaagtgattctttagtgctaacggcaaatagctagatgggttatattagtttacagtattcagaacaacaaataactttaaaaggacttatgaagaatacagatatgaactaggacaagctaagctgattgaattgtgaacaattgggaggcatttgtgaatccagttctgagaacttttgtcgactgtgaaagacaaaacaaatctcatttattttccgcttggtaacagtttatttattcaagccatgacgaagcctaagtgattgtggttttcgcaattaaaagtaacggcagaacccacaattgcttttgcaccaagctaacagacgagaactgccacaggtcgcactttatggcaggcagggtccactgaagccctcttttaccacccttcctgccatttgggatgtttctaactatacctttatgtgtttttcctagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcaggtgagtgtgtctccggaaggaagtgcctattcattattacttttaaatgcagaaatcttagtgcacactcctcactgtaatgaacagattttgacgttctccttcccttttttacatttgtaaagtgctctgcaaaactaaaccaaaagcagttcaaatgaatacatagatgtaacaatcaatgaccttgaccctgccagtaccaagagagttaagtacaagtgctcctctctgaaggtgcgctggctctttcaagcctacagttaccagaacagtaaattaagtcagtggtaactgagtggatggaaggatgcaaaaggtagaaatgtattcacttctcacctgtgggtccactatgagtgttttcagcagagaagtattttctagtgtctggaataatatattacttttataatgcccacagctaaaggtcactcaagaaccaagagcaaagaaaggacgacgtaatcaaagtgtggagcccaaaaaggaagtaagttgcccacctcgcagtatccaggtggcaaatgaaacaggaaatattttcaaagtattttgtattttcaaagtatttcaaagacagtcactcttggtggatacttgtgaaattcagctgctgtcagtcaaatcatatccatcaagttgaaaccagtcttctgacttccctgtcattatctgttaccctggaatagcgtacatgctccaagtctccatcttaattaagcagccgctgaccaaagcttggctaagtaggaagggcacattgctattaatacatttcctgggagctctgatatttttcctaagtatgattaaaaacaacacatttatccagtatatcagttgtgccaacatttaaaaacttgaaggagactgtggttgagctcagccgttttaagtgatataagccctgcatgttttaaaactgtaaatctgggcacatttcaaacacatattcagtgagaagtggtttaggatttgaggaaatgtgttaatgaatctagtccaatgaagtaattataagttgacaataatttttatattctataaatttctgtgtttagtttattttaaaaacaaaacttatagtattgataagtaaaattataaatgaagcttatgtttataattattgtagctgttaattgcatgttcttttcattcactaattgggggagatttgtttatttttaaattgtggcaaaatatacgtgacatctaccaccctaactacatttttcaacagcagtttattctatggctattatgtatatcactgaatttttatccgaatggggtagttcttgaactggtgaattatgtggcttcgtttggcgtctaaactcttgtctcaccttttaggaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaaggtaatgcttgtcgccactgtgggtgccctgctgcagccggcactcctgtcatggttaggctcctttcactcatgcatcaacccagtagcagcttttacatgtagccatataatgacaccagtatcttttacagcatttcaagtaataatgatactttcctcacctaaattttttacacatgtaatgaaggggaaaaaaggtacctcatgcaagttgtgttaagtttctgttccagtgtagatggtctgtgttaagttgtgtgctgacgcactgtgggttgtcttttcattccagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaaccccagatcccatattactgtgtactgctcaggattattttgttaaattgagattataataccttagtacatatttattacaattaacttatataatttctccatctatgcatatattttatttgggcaaagtggctggccctgacttttacctggtgatttcagatgggtaacatccaaatggtgaaattataaatgtaattatcacaataaatagtttcagatttccctgcacttaacatttatacattagattttgttaaagaaatcagttacttttactttatagtagtgacatctcattggtctctaactaccctccctcatacctgactagtatcatttgtcatcgtgtcctgctcgccagtctcatcctccccactagagtgggagcttctgagtgcacagggtccaagtgctcgtcctacagccgccacagtgctcagtgaattagggaaaagttttgctcccgaaagctcataacttggtttcagttttaataaatgactatataaagttttgtgataaactaattcttcattttatcaagcctatattatataaatacacataagcttttcatgaaagaaatatttttaaatctgtgacaaagatttggcaagaaggaaaatggaaacttcgaatagatgaagataacttggtaggaagagctggtgaataacaaaataaatattgttaacaaaagaccaggagatctgtggagggaaaaagagaactttattttctgttaaaaaaacaacctgcacattgggtgttatagccttcagtacaagtgaaagcgtgctttccgaataacttttccatgttcttctttaagaaatttcactgctgctcgtaaggttttgaggagctgacaagctctgactggtgagggatggcagtcggcaaaactagtctgagagctgcagccaacattttgtgttccaggtgcttctccccccagcttctcaactcagttttagttgggtatgacaagaatgactgaatttgtgtgatcaactctcacaatatcattagatgggaattaaggtgtgctgaagataacagaagcacaacacccaaagacgccaggtgcagtggctcatgcccgtagtcccagtgctttgggaggccaaggtggaaggattggttgagcccaggagtgcaaggttgcagagaggtgtcattgcaccactgcactccagcctgggcgatggagcaagaccctgtctcttaaaaaattcttatgagtagaaatctcttaagtttactaaagaatcaagaaaatgggaagaagaggctataattataatactgtcttttgtagcactttaccatttgtgaaacagctaaagtgggtatttttgtactcttctttaagatgaagaatttgaggcttatgagattaaatagaatgattaaaaacctagttggcagagctgagctttttgtgctcatcacattctagtaaaagggttagaattctttcttctcggccaggctcggtgctcacacctgtaattccagcacttgggaaggccgaggtgggcagatcacttgagaccagcctgggcaacatggtgaaaccccatctctacaaaaaatacaaaaattagccgggcgtggtggtgtgtgcctgaaaccccagctacttgagaggctcaggcagaagaatctcttgaacccaggaggcagagatcaaaatgagctgagattgtgccactgcactccagcctgggcgacagagcgagactcactctcaaagaatcaagaattctttcttcccaattacatcttacattgttgtaagaaatagagtagtattataggacagaaagcatgtaggtatgccagatgccgaataatggatgtcacgagaaacacagatagatgtatccattaaatatatccccagaaagggagaaattgaaaacgaaataatagggtatttgggagaagggatggtggtgctgtgtaaagtctgaaagatgaggaaactaagaagttaaataacttgaagccacatgaccagtgggtggcacagaccccagatgtgaatcccgacacgcctcatccaagccgtttccaaaactgactctgcacctaatggggatttttctgaaggtgcacttgctgacataatggataataatgcacacaatacacaggaaggaaattagaatgtttaggtatcaaatgtaggctagtctccctgggttcttcctccagggctctcaacagccgtcagatctgcatgtgtctatctacagaactttcatatttatactgacctgttgtcaagtgtttgtttacatccagaaggtctctcatcttccttgcctcactgtgggtgtctgttcatggtactactgttagttcaccaacccagcttggaactttagctttacttttttcactcttctcttctcccatgaccaaagagttcaaccatggtatatggacccttgcactagaacattctttgggggaggtgtacatggtgggatgtttaacagcatcccaggcctctgtctgccagtagtaccttctgcccttaagttgtgacagtcaaaaatatctccagacattgccaaataagatgaagactgagacttggccactagatttgaagttgtaagtgaccctgctagcagcatattagtggcatggtatgagtaaagactgcagcgtatgttaacgacgagagaagaatttgaaatagggagtttaggcaagtctttcaaggagcttgtggggagcagagaaatgcaagtggtagctggaaagggatgtgaagtcaagagcattttaagaaaagaaacgggaatgactctcacagagatggaaaaaacgggaggtgtcaggtaccacctgacagcagcttgagtttgctgacaaccaggcatgagctgcagtcatccccagggctccctttccatctgctgtgcataaaacgtattcagattccacaaaaggttgagccagaaagatcttttaaaagcaccacctcaagagtttgccattttaaccagtcgcttacacatccacacccaagtctaaagactgccccgatttcttacctgcagtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccag

SEQ ID NO: 36091 - DNA, 14584 bp, Homo sapiens
ccgaacgcccgcagcagggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggtaggagcgcggggccccccgcccagtgcgcacgcgcggcgaccggctgctggcccgggtccccccaggccggagcgagcgcgtcccaaccggttcacggccccaccccggcatctgtgccggccggccagggactcactcagacttttatgttttaaaagatttatccaggccgggcgccgtggctcacgcctgtaatcccagcactttgggaggccgaggcgggcggatcacctgaggtcaggagttcgagactagcctggccaacatggtaaaacctcgtctctactaaaaatacagaaattggccgggtgtggtgaggcgcctgtaatcccagctactcgggaggctgaggcaggagaatcgtttgaaccctggaggcggagtttgcagtgagctgagatcgagccattgcactcgagcctgggcaacaagagctaaactctatctcaaaaaaaaaaaaaaaaaaaaaaaaaatatatatatatatatatgtatgtatctttccaggtcgggcgcggtggttcacgcctggagtctcagcgctttgggagactgaggcgggaggatcaattgaatcccaagagtttgagaccactctcagcaacatagcgagacccttgtctctattttttaaatgttttaattaaaatacaaatctgtccatattttttctttttttaatatatggttgcttaaacattttggttcagagattctaccctctgaaaagtgaatagcacataaatgctcattttgaggaattacaaagcgaaccccagggtcaccatggcccaggttgacacacattgtcaccactccattctttccacttaaaccttccctctccacccccaaccccaggtcctgatttttatggtaattatgtcttgcttgtctctattattttgtcaactatttatccctaaacaatatagtctggttttttgtttttttttttgtttttttcagatggagtctcactctatcacccaggctggagtgcagtggtgtgattttagctcactgcaacctctgcctcccaggttgaagcaattctctgcctcagcctcctgagtagctgagattacaggcgctgtccactggacccggctaatttttctatttttggtagagacggggtttcaccatgttggccaggctgatctcgaactcctgacctcaagagatccacccgcctcgacctcccaaagtgttgggattacaggtgtgagccaccgtgcccggcccctaaacaatagtcttcatataggtaagcatacagcgtatagtctgatgtgtctgggtgtttttttttttttaatgtagagatgaggtcttaccacatctctacataaaaggtggttatggagacccaaggtggtctcaatctcctggccacaggcgatcctctaaccccagcctcccaaagtgctgggattacaaacatgagccactgggtcccagccctggcttctttttcgtagatattattttaggagtcattttattgtaatatcagaagtattcatcatctctgtactataccgttctattgcatgactctccaccatatacttatccatcctgcttgctcagggacactggattgttttccattttaacttgctatgaacagtcctgcagtgaatactcttatacagaggagcaggcatggggtatgtactaatgaatgggactgctggctcagcggcccgcctggctttccactctattaaattgttttccaaagttatactggtttatgcgctcgctcaccgctcaccagcagggtagaagaattcctgatgtttgcaccctgcccaaagctggtgggtgtagcgtggtatcctaaggtagttttagtttggatttctccagacttctctaacttgaggaccttttcatattcactggccgctgtgattgtgcttttgtaatgtacctgctcaagtctttcactcttttctcattgcaaacgtacatcctaggtttccagcaggagaaacaggcctgtccatttctgacacaagatgggtgaatcggtaacttttctggtctgttttcccactgcttgttatccttctgttttctttaatggctttctgcctagatcaggagggacagactttcttttgaaacccaataacacaactgttatttcagtacagagctaagacagaaatagcagacatagttcaatggtccctgcacctagagagtgccgtggaaacagggcccagtcaccctccaactgcacagtcccatgaagccaaaaagacaatccaggttggagaatgtcacctttcatttaaggccaagttttgcagagtctgttttatttgtttttaagtctgctgcctaacttcttttgggtttttgtgaacttagaggacacataatctcactcttctagcagtttctctaggaggtgataacaatgcggacaaataattagccataaaacatcttggccaggcgcagtggcccacgtctgtaatcccagcactttgggagaccaaggcaggaggatcacttgaacctaggagttcaaaaccaatctgggcaacatggtgaaaccccattgttacaaaaagtacaaaacttagccaggtgtggtagcatgtgcctgtagttccagctactcaggaggctgaggtgggaggatcacttgagcccaggaggtcagggctgcattgagctgtgatcctgccactggactccagcatgggcaacagagtaaaaccctgtctcaaaaaaaaaaaaaagaaaaaaagcaatcaagtatctccagggtaaatgaaagcaacatgaagaataagctgtttataaatacatataaattaaaactaatggagaaaaacagtataccacatcacagtctagtctcagcaaggaaaacaacaggccaacattagaagacacgaatgacataaaacagatcttgaacattttgttattactcagatcacgaaggactagatcacgctgcactcagggcttaaaaatcacaagccacgttacacatacagtacttcagacattcttcattcctgaccgaggttttttttgtttttgagacagagtctcactctgtcacccagtctggagtgcaatgtcgcaatctcagctcactgcagccactgtctcccgggttcaagcaattttctcctgccttagcctctccagtagctgggattacaggtgccccccaccaagcccagctaatttttgtgtttcagtagaaatggagtttcatcatgttgtcctctcgaactcctgacctcaagtgatccacccgcctcgcccttccaaagtgctgagattacaggtatcagccactgtgcctagccagcactcaataatttaattggcatactgaactctgttccacccggaagtcagtggacttcacatttctctgacgtttgatcttaaataagagcagcagactaggagaggtgagaaagtgctgattaagcccgaaggtaaataggagttaagcaaacaagagaagaaggaagagtgatgcagatggagggaacagcacatgtgaagatctgtggtcagagccagggtggtggtttaggaactcctcggacagtgtggctagagcacaggcaaaggacgaaattgggtgaggtaaggtagccagaggccaaatgatacaaaatgtctgtgaagccatgttaaatgtttgacattttatcctaagcacctagcaggttagcaagggggagacattgacaatatctgatttttttttttttttttttttttttggaaacagtctcactctgccgcctaggctggagtgcagtggtgtgatctctgctcactgcaacctccgcctcccgggttcaagcgattctcctgcctcagcctcctgaatagctggtattacaggcacccacaccacacctggctaatttttgtacttttagtagagacggggtttcaccatgttggccaggctggtctcgaactcctgacctcaggtgatctgcccctctcggcctcccaaagtgctaggattataggcatcagtcagcgcgcccagccttgagtttctttttaagtctttccagctgccatcttaaaggatggtttgcaggggtggactagaatgggtgcgaggtggaataggctaggtgaagaatggtggcctggccacgtgtggtggctcacggctgtcttcccagcactttgggacctgaggtgggaggatggcttgaggacaggagtttgagaccagcctgagcaacatagcgcagttctttgtctctacaaaaaaatttaaaaattagccaggcttggtggcacacacttgtagtcccaggcactcaggagactaaggcaggaggatcacttgagcccaggaagtcaaggctgcagtgggccatgatcacacccctgcactccagcctgggcaatagagtgagaccctgtctccaggacaaaaaaaaaaagacaagaaaatgatttgtggaattgattacttggccccatggacgtgcttccaagctaaaataaagtgtttcaacctgtgttcccttttccctatttgtataaattactcagttacattctcattgctacttatttaagcaaagtattcttagtttgttaagaacaaagaactacaaattgtgttcattttctatccttccctgttgttaagactaaattacctgaaataggaaccatacaatttcagagtggcttttagccacaacttttatttgttgaagctttttttttttttttttttttttttgagacggtgtcttgctctgtcgcccaggctggagttcagtggtgcgatcttggctcactgcaacccccgcctcccgggttcaagcgattctcctgcctcagcctcctgagtagctgggactacaggcatgcactaccacacctggcttatttttgtatttttagtagaaacagggtttcaccatgttggccaggctggtctcaaactcttgaaatcaggtgatccacctgccctcaagcctcccaaagtgctgggattacaggtatgagccaccgcacctggccttgttttaagcatttggggatcaatttgcagggacctattggactatggggaaaatgagatgtttctgctcctgtattttaatgtctttttcctttttgtttctttactttgtaattaaggctttgcagacttgcatcccataatgtcttcttttatttttttttatttttattttttgagatggagtctcactctgtcacccaggctggagtgcagtggtgccatctcggctcactgcaacctccacctcctgggttcaagtggttctcctgcctcaccctcccgagtagctgggattacagttgcgtgccaccatgccaggctaatttttgtatttctagtagagacggggtttcaccatgttggccaggctggtcttgaactcctgacgtcagatgatctgcctacctggacctcccgaagtgctgggattacaggcgtgagccaccacacccagcccataatgtcttcttttaaagggtgggaggtttggtgagtgcatggcaaagtaagacaagtgatcaaatttaaacaacactggtctgatgggagaggaaatgaacatttggctgttggtttgtttaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggtaggttcgttttgaaagctgaaacgttagtaggtactgagtggttagtgcagggaaattgtgctgctgtgattaaagccttagctttcaggccgggcgtggtggctcacgcctgtaattccagcactttgggaagccaaggcgggcagatcatgaggtcaggagatcgagaccatcctggccaacgtggtgaaaccccatttctactaaaaatacaaaaaattcgccgggcgtggtggcgggcacctgtagtcccagctactcgggaggctgaggcaggagaatggcatgaacccgggcagcagagcttgtggtgagcggagatcgcgccactacactccagcctgggcgacagagcgagactccgtctcaaaacaaaaacaaaactagctttctggttttcaaaggcagagccaagagcatgttcatatttttttcttctctaaatgagtgtgcctttgcacagaacagagtcccagggcaggagtgaagtcaaaacaagctctaaagcctcctcttgacttctcagagcacgtagaggacagggaggatctgtaggtagagaaggagtggaagagagttacagcctctgccagtccgggcatgggtccagcagcttctgagccctggaagaacagatctcagcttgcttgctcagtgttccccagaggttcagcagaggcagcccggactctctctgatcacaggccaactttcagaactgtgactgcccaagtacaaaaatcctacccatccttttgaaatgtactgcttaggccagtcagtctcatatttcaaatgcgttttgcttgaactcagtttgctgtattacaagtaagttgcatcagccagctctcatgattgaagtttacaggcttcagctaatttaggggagaatctgatatgcaaagaaagaccacctcgtttgttaaccacaatgtgatatttatttgaggatgcaaaagggtttgtcccaagaatccctatcaatagcctcctctagaatgggtgatagaatagcactacttaaagccctaaaaaatgcaagcattgtggtgtctcacccagggctgggatatttggtaacctcagtacctctgcattcatgtattccttcctctgctccctcattcattcagtacttgttggcatgcactgaggactcagatgaggtgcaaccaggccctcagggagccggagcctagcagatgagttttcgagcatgcgcggctgaaatgactgagaaaagaccctgagtcatttctcagggtgctggggaggtatctcagagcatgtggtgctcaagatgaattttgatacctcagaagacccagcgtcaagtaatacaatatgttcagggaactgcaaggcattctgcctaggccgacgtgtgggatattggtcaggagtggcaggcggggtacagaaagccaaggagtttggccgtgagtgttcacatcagtgcattcattattacgagtgaaagcgtagaataagaaagtctttatctaaaaaggctgtcatgcatgggtttggattatgacaggcccatccccctggacctctcatagtgccccatgccagagcaaactgtggccccgaaccattgcctggcttctgtacccgtgggccactggcactgaagagggttacacagtgggaataaacaaggctgtcagtctgagcacttcagttaacgcctagtattttagcatctccccatccctcatcatcaatgatatcttgggccaacaccccttcttaaggggttcttcatggaaacatcttaatgaacacaaattggccgtggtcagctgttggaaagattgagtagctggaataactgcaggttaaaagggacaaataaaagtgtcattcctaggccaggcaccatggctcccatctgtaatcccagcattttgggaggccaagacggacaggtcatttgaggtcaggagttcgagaacagcctgggcaacatggcaaaaccccatctctactaaaaattaaaaaaaaaaaaattagctgggcatggtgacaggcacctgtagtcccagccacttaggaagctgaggcaggagaatcgcttgaacctgtggaggcagaggttgcagtgagcagagatcatccactgtactccagcctgtgtgacagagtgagactctgtctcaaaaaaaaaaaaaaagtgtcattcctcatatgttgttttatttgacagtagagtcaactttttatttgttgggggtaagggggtggagtccgctcatatcccagctccactccgtcctgagcgagtgaccttggataagttactggctgcaacgtggagatgacgctagtgccgtcttcatggaagtggcggagtcggttagataaccctggttaggttcttagactcgcgcccggcacagtggcactctccgatgactgttattcgtacattgtcttggtctttccccaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatggtaagtagacgggactgagttcaacttacacacagctgccccttgaacaccatgagtttcacctgcatgagtccatttacatgtggatttttttctttttcttttttttttttttttttgagacagagtctcgctctgtcacccaggctggagtgcagtggcacaatcttggcccactgcaacctccacctcctgggttcaagcgattctcctgcctcattctcctgagtagctgggattacaggcgcgcaccaccaggcccagctaattttttttatatttttagtagagacggggtttcactatattggtcaggctggtctcaaactcctgacctcatgatccacctgcctcagcctcccaaagtgctgggattacaggcgtgagccaccaggcccgggcctcatgtggatttttttcaataactatcttggaaaattttttggagatttgcagcaatctgaaaaaactggcagacaaaccgcatagcctagaaatatcaaaacaaggccacgcgcaggggctcacgcctgtaatcccagcactttgtgaggccaaggcaggcagatcacaaagtcaggagttcaagaccagcctgaccaacatggtgaaaccccatctctactaaaaatacaaaacttagccgggtgtggtagcaggcgcctgtaatcccagctactcgggaggcggaggcaggagaatcacttgaacccaggaggtggaggttgcagtgagccaagatcacgccattgtattccagcctgggcgacagaacgagactccatctcaaaaaagaaagaaaaaagaaaaatatcaaaacaagaaaaagatatgaggcataaaatatttacatactagtctattatttacatacacaaaatatacacaaatctattttaaaaagttaaaatgtatcaaaccttacacacacacacacacacacacaatacatggcaccacttgcagttgagagaaatgtaaacaaacgtgaagatgagcatgaaatcccaactgcgtaacattaattgtggaacaaacagactgtactgctggaataatttcacagccgcctccagcgtggggagtgtctgcttcaatctgcttcagacaccctgtgacgctaatcatctcggtgtgagcagctaattcatctctccaggaaattgcatgttgcagtcaaaagtgacctcttgggaggccgaggcgggcagatcacgaggtcaggatatcgagaccatcctggctaacacggtgaaaccccatctctactaaaaaatacaaaaaaaaaaattagccaggcatggtggcaggcgcctgtagtcccagctacttgggaggctgaggcaggagaatggtgtgaacccgggaggcagaggatgcagtgagccgagatcacgccagcgcactccagcctgggcgacacagcaagactccgtctcaaaaaaaaaaaaaaaaaaagagatctcttgaggttcttggctatttttccatcgtgcattgccataaaccttgactaacactgtgggacacttacaaagtgtctcttgtgatactgaaaatgttcccaagaagcagagaaaagtcatgagattacatgagaaaggtgaattgcttgatatgtaccagaagtctgcagctgccacttcaagataaatgaattcagtgtaagaaccattgtttaaaaaaagggaaatttggtcgggcacagtggctcacgcctgtaatcccagaactttgggagaacgaggagggcagatcacgaggttaagagatcaagattatcctggccaacatggtgaaaccccatctctactaaaaatacaaaaattagctgggcgtggtggtgcgtgcctgtagtcccagctacttggaagcctgaggcaggaaaatcgcttcaacctgggaggtggaggttgcagtcagctgaagtcgcaccactgcattccagcctggcgacagagcgagactccatctcaaaaaaaaaaaaaaaaagggaaattcatgaaggcgtcactatagctgcaccaggaggtgcaaaaaccttgcactttttgcagaatacctattcatctcacattgaaaatgtagattttggccggttgtggtggttcatgcctgtaatcccagcactttgggaggctgaggtgggtggatcacctgagatcaggagttcaagaccagcctgaccaatatggcgaaaccccatctctattaaaggcacaaaaatgagctcagcatggtgaccttcacctgtaatcccagctactcaggagactgagacaggagaatcgcttgaacccaggaagtggaggttgccgtgagccgagatcacaccactatactccagcctgggctacagagccagactccgtctcaaaaaaaaagaaaagaaaatgcagcttttatgtggggtgcaggattactgttaggcatacctatagactctcataagattttagaaaaagcaaagtcattatatgacaacttgaagccaaaggatggtgaaagatctaaagctggagagtttaatgccagcaaatgatggtttgataattttaggaagaggtttggcttttaaaaatgtcaagataacaggagaagcagcttccgccaaccaagaggcagcagacaagttcccagatgccataaagaaaatcatggaggagatgggatacctgtgtcaacaggtttttaatgcagacaaaactgccctaatctgggggcatgggagggaaccacaaaggacatctattaagtaaagaagggaagtgagccccaggattgaaggcacgcagggctaagctaactgtcctgttttgtgcaggtgcagctgtgtttatgatcaggcgagctcttacctataaaactgctaacacctgagacttaacgggaaaagataaacacagctgctgatcttttggttgtacaacgtctggacaagaacgctttttctggattaattccattgatgccttgtccttgaagtcaggatgtaccttgccagtaaggtacacctttttaaagttcttcaatgctgcaggcactcagagccccacgagttaacaccaagggcgtcaaagtcgtctacttgcccccaggctcattacacacagtactctatgaaattgtcagtgctatgaaagagaaccctggctgggcatggtggcgcatgcctgtaattccagctactttggaggctgaggcaggagaattgcttgaacccaggaggtgaaggttgtagtgagatcgcgccactgcactccagcctgggtgacagagcaagactccatctcaaaaaaaaaaaaaaaaaaaaagagaaccctgattagaacatcttgaagagtctggaaggattacatcattgaagaggccatcatcgtataaaaagctgtgaaagccatcatggtgaaacagtacattcctcctggagaaacctgtgtccagatgtgcgtgacttcataggatttacgacaatcaaggaaaccatgaaatagatcatagatggggcaaaagtgggtggtgaagagtttcagggtatagatcttggagaaattcaagggctgacagacactgcacagaagaattaacataagacagcttaatggagagaagtgcttccaaaccagtgccagacgttgaggaagaagacctaggagaagccgggctggaaaacagatttccattagacagtctgggagaaggcttctgattattcaaggctgcttttgacttcttttacgacctggagtcttctatgatataagcactgaaactaaagcaagcagtggaagggttgatgctgcacacaactatttttagagaaatcaaaaggcaaaaagtcagacaaattatgatgtatttccctaaagttacaccgtgcttgcctctcgtcctttcctgcctccctttctacctcctccacctcttccacccaagacagcaagaccaacccctcttcctcagcgacatgaggacagtgggatgaagaccttcatgatgatccacttcaacttaatgaatagtaaattcattatcattttcttttaaagaggcagggtcttgctttgtctcccaggctggagtgcagtggtgcgatcatagctcaccacagcctcaaccttctgggctcaagtgatcctcccacctcagcctcccaagcagcagggactacaggtgtgagccaccatgcccagcatccttattattttcttaacattttctcaagtttattgtaagaatatagcatataatatacagaccatacaaaacgtgttaatcaactgtgatgggtaaggcttcccatgaatagtaggctattagtgcttaagttttgaaggagtcagaagttttatgtggattttcgactgcacagcagtcgggggtcagtgtccctaacccccccactgttcaagggttagctgtactatatgatgagatgtgcaacatggttttgataagaggcagcaagggtttaggacattctgtggcatactggccacatagcgatttgcatcaggtcagatattctaagtctagaaagcctgtgggatagttctagaggaggagcagagatgaagcaacgcaaagatgcccttgttcgtctgcaaaatttagggtctctgagtgagacacagctcaagggggggactgtgagcatttggggaagggggttctgtccaaccaggcaaagcggggagtcatggctatcacagccatcttgccctcacattcaagaacttaccatcatagggacactgaagttatcttctcatatggccatataaagataggatgttatgtattgactatcccacagatgtatgcctcttctggtttatgttgatatggagataagcgagttcatgtcattcatatcttaattgccctcagtctcacagaaggcgattatgaggccaagagcctgggagatgcagctcctgggtttccagccctcagcccccaaaaccttaggcagcagggattggagcaggtggtctgaggtcccttctagcttcagaagtgtcataatcaaataccaggaatgactctttggttacttttttaacatagtttgcacttaaacccttttcagtagtaagcatcttagagacagactgaaaatgtgatgttcttcttgaaaacaccctttcccatgtcatcagtctgtggtgtttggtgactgtccccttccccactgtgcgagtacttccctcagggctgctctggtgatgctacctggcgtgttttttcttttcagtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 36092 - DNA, 8178 bp, Homo sapiens
ccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagaggtaacagtagctgcagatcctccccatgcatcgtgtagagctgagcctgtccccagccgtgcaccaccccgctcgggcccggccgcgggcagcaccgacggattcgtccctcgctccccaccccaggtccaccccgcagctctgggaaccccgggacaactagacagtgctttgccctgactcctttcccccactctccttcccttgggagttgcagcgcgagagtctccccccagcctggtctgacccatcgcttcccacctccattgatgcccccgcctccaaacctgccaggtgcccacaaccggtccccacccaggctctcccccttttctctaccccttcgttaccatcatcacgcatgcacaccctgggcacccttttctcatcctggccttttcttaaccactagaatttgacctgtgcagctggcagtacctctgcctctctcagggagaactgtggcgatgccgtaaggctggctgggagagtaggagtgttagggagtgcggacgggtcagggtgtagggactttctatccactctatgccaggctttgacttggggccataggagggaaagtgattccagccctccacagggagttcagagtctaatgaggaagattgaagtaatgattgctggagagcccagaagagagagtactttagggagctgcaggccggggagaggcactagggaaggctcagcaaatgctggatggagctcagccttaaaggctcaatggtaggttggaggagaacaagagaaaggaacattagagtctgtgcaaagacttggtttggaaatgcaatgtgcgtgatgtgtgaaaggaaggccactgggcaggtggggcttgagtggaggatggaggggactgtccctcgtgagcctggtgcccttgatagcccttgggagggtgcctggcactcagtgagggcccagggaacgtgggctgttacccttaccatgcttcacccactggactatcctgaggctgttgctccccacccctgaggagaggttctctctgggtcctcctgagtcatagcgcttggggggtcggggggaaaagagggcaaatgtgaatctcaggcccacgctgtttctagttcacctggctgcatgttgttgtttttgttattattattatttgagacggaatcttgctctgtcacccagggtggagtgcaatggcacgatctcagctcactgcaacctctgcctcagcctcccaagtaactgggattacaggtgcacacggccacgcccagctaatttttgtatttttagtagagatggggtttcaccatattggccaggctggtcttcaactcctgacctcaagtgatctgcccacctcagcctcccaaagtgctgggattataggtgtaagccaccacgcccggccacgttacatactattaataatgaagattttgttcctgagttggtttttcttctctaacccttccccgcttccgtctttggggccaggagctcactgaaccaaagtcctcaggccaggcctgaggcacagttcatgccaagaatgcctggggcgttgtggggaaatggagaaaatctggatgagaaactgtggaacttgttctgtcccatatcccaactgatctcgtgacacccttctgagctactgagctgactttgctaagtatgaaaagtgcagaatccatcccccaaccaatccagacagctggggttctttttttttgttttgttttttgttttttgacacagagtctcactctgtcgcccaggctggagtgcagtagcacaatctggactcactgcaacctctgcctcccaggttcaagtgattctcctgcctcagcctcctaagtagctggggttacaggcacgtgccaccacgcctggctaatttttgtatttttagtagagacagagtttcaccatgttggccaaggctggtctcgaactcctgacctcaggtgatccacccacttcagcctccgaaagtgctgggattacaggcgtgagctacctttcctggcccagctggggttcttttttaatttttatttttgtagagggagggtcttgctacattgtccaggattatctcaaactcttgggctcaagtaattctccctactcagcctcccaaagtactcccaaactaggtttacagacttgagccactacatctggaccaacagctggggttctttataggggaaagaatagtgcagaattaactcatttccaagctgctcggatgcagaacactgttgtcatagcgatgtgtccctacagtgtttggatatatgctcatgcttctgtgagtcaggaaggggaggggagaattataattacattctgctcagtttgccttctaagctctcaagttgatctctaccactgggccacatttatgtggctgcttcgctttcctaaactcttccaggcctgcccccttgacttctttctctatactgcagccaagtgtgaacacaggtgaccggttcacaccctgacaaaatctggaatgatcaagttcagattcagtgggatggtatttaagaacttttgggatgaggtctgtccctgtctcttgtcctacgtcccactgctccttgctctagaatttatgctcttataacttagacttgaaggtttggagcctcacatagtgtttttttgcctctttgactttgcatgggttcccatgctctggagtgtacttcctgctcttccttgttggctgggactctgggagtgatcccctagagaaagccttccctggagtctccaagttggcttcatgcatctcatctgggctccttggcatcgtgtgcctttccctcctgtgcttaccatattgtaccatcatcctctagggctccaggagggcagagatccattgtgttcagttcatctctgcatactcagtctctagtgcaaggcctggcacagccagcaggttggtgactaatgatagttattctaataggtgaacattgagaactcacatatatgacattatttaatccccaggacctcccaatgaggacagtttgattattatcaccccattttacagatcatacaattgaggccaagagaatattagtaatttagccagggttacatggttagcaaatggctctaataggtcacttaaccattccattctctctccaagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggaggtgagggggccctccgagctccaaaggtgggctcctgctcctttctttatcctgatcctactcatgagagcagaggcaccagggcagtcccagggtggggcagggaatagccccattccctggggccccaccctggcctccccttcctggtctgggctacactgcgttctgactggagcctcacccatgcagggcaagttcgtggagcttggcctctccaactatgctagctgggaagtggccgagatctgtaccctctgcaagagcaatggctggatcctgcccactgtgtaccaggtgagggccggggctgcagaggccaaggtctccaggactcctgctaatcctgggctctctttgcccccctgactgccccctgtgccgtctgcatagcagccactcccctgctgaaagcctgcagatggctcccatgtaccctcaggatgccattcaagctcctcagcctggccactgggcatctgcttccttcctgcctatctgtgcaccttggacccttccttccccacctcctttcatacttcagcctggaacacatttcccctgccctcctccctgggagaagcactcaggccttacatagaggtctcctcctctggaagcctttctagacagccccataggagtctccagtctccaaatctcatcttcatacattcagcgagtactttccagctccttgtttgattgtagaacctaactttattgtaattaactgccttccttgtctatttttttaaacttgagtaaacatctcctggaagcagggattttgtgatacctacttgtggttgtaaccagtgtccagcatggagttcatacagcagatatttgtggaaagataccattccacttcaattttctgtccttgggcccaacaccttccctccatcccctactaacagtagtgatgttagaatattgctgaagtcctgggccggtgttgctttagaggtttgaaagtggaaggcaacagttccttctcttgacatgtccaccctgtccccggggtccctctccctgcagggcatgtacaacgccaccacccggcaggtggaaacggagctcttcccctgcctcaggcactttggactgaggttctatgcctacaaccctctggctggtacgtggagcattcctgaccctgtctcagcctattcctgacccacagatgcccagcccagaatttatgaagcagggagggtttgacaagaggctgggctgtgttcttcagcccctcctgggtccctgcccctcccctagaccagagccctgagggatgtggcagcttctggggcactctggggccaggggctgattgctgccttcccgcagggggcctgctgactggcaagtacaagtatgaggacaaggacgggaaacagcctgtgggccgcttctttgggaatagctgggctgagacctacaggaatcggtgagccgggggtgggcttggtgaggatggctggggtggggtcaaatctatgtggaatgaagtcctgggctgttcctgaggtaagaccttcctttgctgtttgcatctcctcccctgcattgcttcaggaattcccaagccctctgtgggttttcttgttgtcttgagacctctgggggggaaatgaggatccctggatgttggggtcttgaagtcatagctcgttcctgagcaatcacctgctgggaagcaaaaagcgagcccaggatgggccaggcatggtggctcacacctgtaatcccagcactttgggacaccgaagtgggagggttacttgagctcatgagttcaagaccagcctgggcaacatggtctctacaaaaaaaaaatgcaaaaaagtggtcaggtgtggtggtgcacacctgtctgtagcccagctacttggaaggctgaggcaggaggattacttgagtctaagaggttgaggctgcagtgagccataatgatgccactgcactccagtgtaggcaacagagtaagaccatgtatcaaaaagcaaaaagagagcccaggagggaatcctgccccatctgagcagccttcgtgtccctagggaagtccctaggctactgagtcctcaggagtaaagatccattgaggtctctgctgaggggcccagcatcctgggtggttctgatgcccagcaaagtgggagacctatgactagagaggacacccgcccctcagggctgcagggtgtggggtggggcagtggtcctggatggctatttggttgcggctcccagtgtgacccccatggtactgacccctgtgctaacatcccctctgcacagcttctggaaggagcaccacttcgaggccattgcgttggtggagaaggccctgcaggccgcatatggcgccagcgcccccagtgtgacctcggctgccctccggtggatgtaccaccactcacagctgcaggtaaccagcgaccctgggtgctcagcttcttcccttccagggggaccagcgtcacctttaggtgaagcccaaagcatttgatttctgaattcctctgaaatttttctttcttccaattctcataagcactcttcccactggtctttgatggtatctgagtggaggctttgtagtgagggattttcattacagggattttcttattccttaggctttctgaagtatgattatcccagtgttattgatgaggaaaccgaggttcacccagctattaaagtggcagacattttaacacaggtttaactaagacccacccatctcacccttttggtttctctctcttgatgcctcatgtcttcctggttaaaacttatttcctgatcagtggcagtgacccacacctgtaatccagcactttgggaggccgagatgggaggattgcttgatctcaagcatttgagtctagcctgggcaagaaaatgggaccctatctctacaacaaatcaaaaacattagccaggttgtgatggcttgctcctacgttcccagctactctggaggctgggatgggaagatggcttgagcctgggaggtcaaggctgcagtgagctgagattacaccactgcaccttagcctgggtgacaaagcaagaccctgtctaaaaaaaacaagcaaacaacaatgaaaataacagcaacaaacttatctccagcttcagccttccatgttgcatagtgtctggcatatatccggtagatgttcagtacgtgggagctgtgttttacataagttttctcattccaatgctgaaaacagagaaaaagattgaatgtcatgcctgcatcgacagcacatatactaaaattggaatgatacagagaagattagtatggcccctgcgcaaggatgacacgcaaatttgtgaagtgttccatatttttccgctgccaccaccacaccgcactacctcccacccccttttgtgtacaaaacacaaggaaaaatatttttgtttgaaaaaaaaaaagatcgaatgtcaaaacaagcttaataacgtagcctgctttttaatttttttgagacagagtctcactctgttacccaggcggtagaacagcagcacactcatagctcactgcaacctcaacctcctgggctcaagtgatccttctgcctcagcctccctagtagctgggacaaggcatgcaccatcacccctggctaattttgttttgttgttttttgtagagacagagtctctctctgttgcccaggctggtcttgaacactttggctcaagtgttcttcccaccttgacctcccaaagtgctgggattgcaggcatgagcctctgtgcccagccaacttagccatttttacacagctgctgggggcagaactgggctgtgaatgtagttctgtgtggaagcgtcgtgcggcagtaggggaaaggatgcgggtttcaagtcacgtgggtacagctatccaaggcaccttaagtcctttctggacatacaagatataaatataaacagagaccccagatctcagcagggaggtggctgggacggctgtgagtggagtcgctgtgcagcagaagagggttgaagtctggccgtctcccttgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaacccca

SEQ ID NO: 36093 - DNA, 13404 bp, Homo sapiens
ggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggtaaccctttgcgtcgcgctgggagaaactgcggagtagtcttaggccctggggcggcaccagtttccagggtaacggggtctgaggctagcgggctttgggagctcacggggcgggcgtgggaggtggacgtgtggatccctgaccgccgcaacctgctccgaccgggcccggtctccccgaactcgccgggacctttttgttatgtgtcttcagcttgtgagcccgaaaaccctgtgcgtctttgctccagcacctaccgatgagctcatattaattaggcatctttccttcccagtatcgggttgggagagggtagtaaagtgggttttattaaagatcttggtatacacacacacactaacacacacaccgcaactcacacgcacaccaagaaaaatgtgaccattgtaacctttttttaactcacaaagcctttctcgtaatgttgtcaagttagcttgccattttgtcttcagtaagacagatgaaagttatgcagctgttaaagttaatgtttttcttagacacttaaaaagggtttatatcattagttttaaaattaaataaaggagacaacatccagaagcagcagctcactaatagataatagatactttccagttgagttaaaatggaaagaattgtctttgcaacgcagctgtggtgattttctgtctcttattcaggacgcttgatgtaatgggcagaatcagaatgcttcaggaatctgtcgaatttgtttcttataatagtaagatcatttaaatgggaatttgagaactggggaaggggatccacttacatattcttgaatgtataaagaaactgaagcccaaagggagataaatcaaagctgatgacgaatataaacttaatactcagaattttcgtgtttgatacttctctaagctgtttctaaatctataataggactataagattacttatagtcttagactaaaaaggcttacttttaaaattagcatttataaaatattattttaaaaatgaaagttaaagggtaaatgaggtttttaaaattttgtgttgttttgttttgttttcatttttggccttctaggcccctggaggaattgctacacccccagtgtatggtcagcttctagctttatatttgctccataatgacatgtaagtatgtttaacctaaagctaagagcaacaggtttctcaaagttatatggaaatatttctgcactgaagtagcaccactaaacataggcacaacgagctaccttttttattacagtaattgttaacgtctatttcctattgaatcataggttaatgaattatgattaggtcgtcattgtcttacatatactttctagaaaacatttcaatttattatgacaaattacgtcagtaaattcatttaacctttttgtctttttaagaaacttttatgacctctatttacttaacttcatatataatcaataaaacaaaagaagtgaaaagagaagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaagtggatggcttgagtccaggagttttgataccagcctggggaatatagtgaaaccccgtctgtcctaaaaatacaaaaaattagctgggcatggttgcgtgtgcctctaatcccagctacctgggaggctgaggtggggagaatcacctgagcccagaaagtcaaggctgcagtgagctaagattgcgcgactgcactctagcctgagcaaccaaagtgagaccctgtctcaaaaggaaagcataactgcaaaaaaaaaaaaaaaaagtctcctatagttctgtgactcactgatgattcctgataacattttattttaaactcttccaaaacctttcttttatatctttttaaaaactaaattgaaatttttattacacatatgtaaggtttttgtttttgttttgtaaaactgtcattatatgtttgttgtagttcaagcctccaaacccataaaaactcctgcctcagaagctgtgtcccactggtaggaggggctgtaatcgggagagaagtgttgtgtaccaggcttattgtcagggaatgctacagccttgatagtacataaatttgtttacttttatatcctaataaataatttgggccgtctataaatcctcgtgtttttagtgtgctgttgcctaaatttaggatatggattattatttttaaaaaattcactagaaatggcaaaatattactttggtaaaaatatttcatgtcctttttatctggaaaaccactattgtttccccaaaacaaattcatataaaactaaattttactttgtgttatgtgaagtatacttctgtatgtttggcttgggacctggtagtttttaacatttcctgagatgattatgtttttaattgattattcttctttgtggtggcgtaaattaggaataatgcaagatatctttggaaaagaataccacctgctataaaatctgtaagtatcctttaaacctattttactgctttaatgtaatgacattcccttaaatggcaaccttttataagcttatgttttctatctgacgtcctagtaatagtcatcagattggtattaaggattcgaaataaatcttcagagtcctctaatcagaaatttgaattttgctgggatggtgtagaatttctgctcagttcctactgattagatttcttgagacgcttttatgtgcagcttccctagttaaacagctgagccagtttagatgaaggaagctcctggaggtggcggaggcagctgaggtgattttcagctggtttatgttgcttcctataatggtacttattttgaaactgccatcgtttacaagaatactctaagaatgattgacagcaataagattatttttgttaattaggattttaaatttcttattttggttgggagattagaagaaatagcctgtgaaaaggttcttccaaagtggaatgaagtaaaattttaatgtcaaatgattccatgtgtctaacatgagtgtcaagtgaaatttttaacattctcgggatattaccaagaattcatctaaacttttgtttattgatattcatcaagagatcggattagtatttttactctttttttttccctcatacattctgttctgttaagtaagattggaatattcctcagcttctttggctaaataaagaagtactataaatcatgcacataagtttcaatggcgttagtggaaactcaatccttagagaggctacaatgtatgacatcttagattgagagtctctattgttaaccattttgctattacttttgacctaaatatatattcataatatatctatgaaatacaaatacaacatctttaaaaacaatccttaagctaattagtccccaggcttaattctgaaatgttttttgactactttctcatgccttaatttgctattgtaataaatttatatcagccctacagataaattttaccttactgctcatagtgtttaaaaaccttttgatagtgattgggctgaaaaagtaattgcatcttttaaaataaatgttgaattaggttttaatgatgtagctaacaagtttttatatcatttctggtattttgttttaagatacaatcattggtgcatttacagagtgaataccctctaaggcaataatatttattgcaggcaaattctgaacttgggggaatttggtcagtaggacaaagaatctggcagagagatttccctgggatctatacaaccatcaacgctcaccagtggtctgagacggtccagccaattatggaagcacttagaggtagtgtttctttgtggttaaaaatgaaattagatgagacttagtccctaagtgctgcagtgttgaagtaataaatcagtggtgtgtgtttaagtagatatttttgataggtgaaaagagcagttttcagaattttttagatttgccctaatcatgcttcttcattttttgttgcttgagattacattggctgctgtgcttttgttgtttcttaattctagacagaaattgctcgtcagttttaagagttttttttgctattaaaacgagatcttgtaatattctaataagtttaaggtatgggtttgtagagatgtgaaaatagagactgctctttgaattttgtcagcctcagcctttgataggtgttgtcttaagcttctggattttataatttatcagtttaatacatagatgctcaaatgtgtttttaattgctttgaaagattacaagcctggtgtgacagagcactgatcccacaataaaatctcattccctgcctctctacagtctctcacccctagcatttgcttccagtcctcctggttcactctttataaaattatataatcttgttttatgttgtcatgtactgttatttcttattgttacccttacttccatagttaatatccaccttcactgtatgccttcctgctgtggaggaagtcagtgagcaggaatttttttaataactgttcatcactctgctaagggatatcagctttacagggcagcagacagcagagattgtttctgaaatgcacataattcccttggaatggtaaaattcttagcagcataaaacataacaatgtaagtgacagaacaggaggcagctactttaaatgtgaatgaaatgagcagagtcctaaggcaggcagatagatgggaagggaggagtgtggaagaagattgcacaggtacagcaggggcagtttcagaaagtagcaccagaaacctcttcatataagccctgaggaattagcgttatagtggacttccatagtatcctcgtgattcagccttgtgattgtggtggggcggtcacaggccatgtgccttttcccagtgttttacagcgggttgattggcaggactgggcttgggaactccttactcgttcagcaagcattctcttgtgcaccgtcgggtccgtagttttattccttcccggagccgcctctcactgaattccatgagattgagaattcctggcaagcagttcagtagacccaggaaaggctatatagcgtaccatgcgggagtttaagctctgggtccttgcttccggagttcaaattctgattctgtcacttactagggtgactcctcagtgtcttattttcctcatttgtgaaatgtgattagaaatagtactttttcaggttgtaaatgagttaatatataaacatgtaccttattctaaagcactacagtattcctgaacatatcctgagacttttacaaatctccagattcatgaatggtactgtggtttcctttgtaaaatgcagccaggtcaggatagtctcttaacagattggtcttactgatgaatttaacattttgcttcttaacttattagaaacttattttctagttgagaacaatcactttcttagatctctttccattctcttctaaattaggcacagtcctattagaaaactgaaaatgacttaagagaagctagtgaaaactatttttgcaggaaacaagggctgaggaagtacttagaaactaggtagacagtagccattctcatctgaggcttgaaagggcaaggcgaggggccagtgttactggggctgccccacaggatggatacagaaggtcagctggagcaaggcagggaaagggcataggaagtgaattccctgaccttccttcccagcctctgacctgatagagccccaattcgccaaagcaagagagctcaggtgcaacaggcattggcggccaacctccctggcacacagcatggctgggaaagacagaagaggattcgaaaggatgggagtgactagttcatcttcccttctgtctccagcactggcagtgatggatgagcagcacttgagtatttgttgaacaactgagtttgcattctgttagcatttgttttcaccaaaaatgtgttccatcaactactgccacagatattaggtgctggctcaatttattccaccttccagcgtgtcattctagggcctgaggttacagatttcacaacttgaggatcacagagtgactagtcggaatgtagatgtgattcgtgccaagtggatattgcagcttctgagacagagaacacttagcctttatttttgctttgtcaactcacttctcccatcacatgtttttctttccttttccagtgatatctttttacttttctctcccttttatctcctccattcttactgtattcctgttttattccccactctgaaaatatggccagaatatttgaactgaagtaaatgtttttgaaatacagttgacttaccaaatgaatatagttttatggtgtatacttttacttctctaaaaaaaaaaagtatactttccattgttggctcttttccattgttggctcagttcttttccattgaatgtatgcagccttaatagaaaacgtttcttggtattgcaaagtctgttaggttacaggctggttgaaggaaggaaggaacctacaataataagtgtaaagccacagaaggaagagcagacagtggctgagtgaaagctggagaggatgtcgggctcagatgaggggaagggatgggagtgtcggcagtttttaaggaatctgagaaaacaaagcctaagtgttggagtcgtgccccattttggtcctcgtgatgccatcaacaagcatgtatttggcatatatttcactggagatgctaggtgtttgggggactttgaggataagagataccccttcctgtcgagaagtttggaatataattgaaaagaaggggataggtggaacagtgtctgccgtagtggaaagttgcttgttaaagtagaagtgtaaacaatactgctgagtttagagaagggcagagatcgtaatgaattataaacagacttaggaatggtagagagcagacaggagggcatttcaggccacgggatagcataaaccaaaagccccagggggagaaggtgtaagacttgtctgagagccagtggactcgtttggcacaaagggtatctgggggaattggtgtagtttgacaatgtcccaggaatggagagaagattttaaatatgttagggtgtttgttttacatatgtacactggcctattaaatatggaaagtaaaatccagaatatttcctaagcatgttgaccaccaggtggaggagctcttgcattaccaatgagcaatgcccagggagaaaggccagctggtttcacagtgctcaactctaccgtactcctgagtttatttaattgggtatggaagcctggggacaatcctaaatgccactttcaggaaagttttcgttgctggtattgtttggcagtcccttcttagagtcattctttcaaggtgggaatttaggattttgaaccttaattcagtcaagagtttgatgcagacttggaagaatgctccagttacaagatttgttctgtaactcccaggtgtggtcctgtattagagacgtttttgaaaaggacagctgattacgcaaatcagttttctgctcctttgattccagcatttgtaaatgaaataagataagtaaaatttatatccccattgcataaacatactgcattttcttagggttagagccttgtgtttagtaacctttttccatctttgtaattttcattatctgagatttttcatccaagaggaagtgtaagaaatgtatttttttccagcaatatttgaaccccccgtacatactgggcatatgtatttgtatctataagcacagaaatctttgggttcatctggccttgcttatgaaaactagacaaggacagtggtgtgatttaacaatgtgctttgaaaatgctgctccctggttcactctctgccaacccaccactcccacaatagatgcaacaaggagacgcgcctttgccctggtctctcaagcgtatacttcaatcatcgccgatgattttgcagcctttgttggacttcctgtagaagaggctgtgaaaggtaattttggcttactttttacttataaggaaaatggaaaatagaagtgtgaattgtaggttcacagtctcctctgaaacacttggaacagaatatgcttttggagtccaggctgtgttttttgagaggtgatatgaaacaggtgttgtggaacacccagcaggcaccctgcagtcaagcatattaatagttctatagcaagcaaatgtgtgagtatccacacagttggttacaaaaatatgtcttaattggtctctttactcatatttggaaatccttatttcacccttatttgataaaggcagcatcatccccacgtcccttttcattttccctgccatttctgacccataccctaggcgcttgcttgctccccactcatacctgctggtctctccaaatgtaactttgcattttcatttctcagctgatgcccagactaatccttcctgttgctcgttgttatagaatactgtatacacctggccaggtgcagtggctcacacctgtaatcccagcactttgggaggccgaggcgggtggatcatgatgaggtcaggagttcgagaccagcctggccaacatggtgaaagcccgtctctactaaaaatacaaaaaattagccaggtgtggtggcaggcacctgtaatcccaactactcaggaggctgaggcaggagaatcgcatgaatccaggaggtggaggttgcagtgagctgagactgtgccactgcactctagcctgggcaacacagtgagattccatatcaaaaatatatatatatatcgtatacaccttgttgcattgttttgccatgattgacatttttgattctccagctaaaatatgagcaccatcacgcactacatcctaaatttccagggcctagcatagttgtagatacatgaagataggttaatgaaagttctaagttattacttttatttactcatacaaacatttatttcttttggctcttaaaattggtccatcatttattttctatatataacatacttcagagctcgtattctcagctgaccacctggatgtgaatgctggtaccacccgtccctgatgctagtggctatgtgacttaggacaaatcacttgaatttccctcaactttattttccatacctgtcaaacgatggccctatatcccacttcatagagttgtggtgattacataaaatcatccctataaaagcacgtagtctggtacctacaggtaaaccttccatatatggaagctgtttttattattgccatctttgttattactgatatgatggtcacaaaaggcgccatatcagttttccttctgtttgttttaaataatactgattaggttaatactataatatattcttgacagaaaactaaccatcttttaatgattatagcaacctaatagagtaaaatgaggctttgatacctgtttcagaaatatttcaataataagtttccatgctctttgtaatatacctttctagtaaaaatgcatatgacgggttatactaaacacatcaggtcttctgtacaactaatgtcatggacaagttgtggattttgtggggtgttttattctttccggatctttatgtgtaatatacttttttaggcatattagaacaaggatggcaagctgattccaccacaagaatggttctgcccagaaagccaggtaggtggagctttcacccatttacgcagcactggactcttctaagactgcttcaggttttcagtctttggtttttgataattggatgtaaaattcggctatactaacacaatggaaataactcattttaaataaagcgtagtagacggggtagaaaggatcacctagtttaaactcttaaaaatgtatttcctgtatataaatgattttacgtaggtttttcatggtccttacaccttagtttttactaaatattaatctccatccttttatggagccatttgtaactgagcttatccttcatatccaagctgttgtctgtattaaaaaaaaatgtttaaatattcaactgccccccttttctgtttgcactcaagtcatacaggcacttttcctgtggcttccactttcacagagttaacttctctagccctccttttaaggccttaatttctatgacctgccctcattgtctttatctgaattcccagcccctcagtcttcctgttggaagtgagccacactcattcccgcctgatagtttctcttcctcctgctgaccaggagtgtcttttctgccaggtctttagagccaagcttaatgcccacttccataaacccgccttcatccacgtcagcccaaatttccttccacctactcggaatgcctatgtttagacattgctgaacatacagtaaaggattctcaatgtgctcagccctttgagttacaaagagtgagaagacatgatcccagtcaagtgagatagtgggggaagagtaatataataaagaattataatggagcacagttgttatccctgtttgagaaataaatggccgttaaatgcatgttgtgctgaaaatagcatgttctatgaaagatctttacaatgacttctgtaaattgagctgtacattttttttttgaatttagttgcaggggccctggatgtttcctttaacaagtttattcccttatcaggtatgtattttcatatgcacattttttaatgtctcattgttcctaatttcttttttgtagtatatatgtatatgtgtgtgtgagtgtgtgtatctatttcttaccttgtaaacagaggttaaatttcataaatgcgtagtaatacatctggttacaagagtgaaactgggctcccccagagcttgccttgaggcggtgccctcctctgggccagctgcagagccttcttattctcatgtcagggaggcctgccagagctgttcaccagtactgttattcagaaggcgtccccaggctgacgtgtagtaatttaaatgttggaatgtaaattccttgaggttctttgtgggttttcttttttttttttttttttttggtttgttgacaatttaatattcttcagtgatgtctggggcatgggaagcactctatttcttgaatttaatgttgcatgggtaaggatgttttcaagaagagctgtgatcttttaaaagacatgttgcatgataaaagtgtctttaacctttacatagaatacttcagtaacaacaacatgagacatgcctttactagcagttaggtaaaaccatactcataaaagttgcaacttcttggcttgcttttcaaaaatgtccaagcctctatgatgtaagattttgtctaaaaccaggacaaatctaagaaagttaacttactgttaaaaattgaaggcattaggggaggtaggtgttggggccaaagctttgttactgtggtatgtaacatgaagtgtgtttgtttctttaacatacagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttcatctaagatagtttctggaaatttcactctcgatctttctgtggacacaatctattttgtcattgtgtctatatgaatctcttaagtagaaatgagttgtatggtgaatctgtgtagtgataattatataatttatttattttg

SEQ ID NO: 36094 - DNA, 20245 bp, Homo sapiens
tttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcaggtaacggatcccgggctgaggggctgggccgggagggacgggcccgccccagcacgtgccgggctctgttccgggctgggcttagccaccccggagctgcggcccggctattttcagctgggtgttccctgtcctgaggagctgcggccccaggaaagcaagggcaggagatccgggagccgccacctgttgcctcacgtgttctcagtccgagagggttcgagacgcggaggaggctgggagaaattcagcctgtagtttcagggaattcattttggccatccccgcaggagtacgctgctaaccacagacaccgagcgcttgtttcgtactgttgtgctcattatttcactaatcttttcttgtgtaatccatgaagatcttgcaggcttgatggtgtttttcccacattgcaggggagaacaaagcccggacagcttgttgtttgccctagcccatccagctattaagaacggaactgggatttgaacctgggtgcactccagagcctgagctgagcacgtagccccttggttttccacagtgcctgtgtagttagtgacaggactggaatgcttgttttctaggccaccgtttctgcctcactggcctccgctttgcctcttaggagaagactccgggtaggggtttattaaacggggtttataatttcttttctaagggctgcatagagaacttcttagcccagcggtttcagaaatagctccagaagagttgaagcaaactgaaggtgatccagagagcgataatgtttctcctcaagtttcagaggaaagtgccacaacgagcaagttggcaatgccctctcaaacggcacagtaaacatggaaacaatttgacttcgggcctaggacctgtaccatggaactctccaaacaggaaactttcattctagattccctccctccccttatcactgccctccaaaatattgggcgatacactacaataatagcagacattcagatagtgccttctgagacccaggtcttaaccctttacacatggttgcttattaatcctccaaacaaccctgaagagtaggtatgaaatactatgactgtacctgttttacagatggaagaatgaagcatcaacttaataaactcttggcgtagatagcgatagtagtagaccttaatcatgtgttgtggtttgtgatgtactagtgtgtactctttctatttcatctgatattctattctgtagatgagggtagtggtactcaagactttgccagggtcgccaaagctagtaaatggcttcaagctggaattggaatgtagagtctgagtatgtgttctttgtgttggcctaaaatgcatacaattttggctttggattatctgttagggtgtcaaaattaccataaattgcataataacttagtagctaagaaaaaacttggagaataagagattaggaggaatgcagaaaatttgtagtaaggaaagtatgaattttgaaaagataaattgcttgaggggaggaagcagtatggccgtgctgccctctgctgctttgctttggaaggagcccagaggtgtcatgtcttctgtgactgtaaaggttccaggcagttctgccacatgtggctgccgagtacttgaaatgcagctagtgtgactgagaaactgactttttacttttatttatatatttaggttttgagactgggtctggctctgtcgcctaggctggagtgcagtggcacaatcttggctcgttacaacctctgcatcctgggctcaagctgtcctctcacctcagcctcccaagctggaactagaggtgcacgccaccacgcccggcaaatttttgtgttgttttgtagagatgggtctcactgtgttttccagtgcggtctagaacttctggactcaagcgatccaccgaccttggcctcccaaagatgtgagccaccatacctggcctgactttttacttataaatattttccaatactttttaattaatcaatttaaatttaaatagccatatctggctagtagctcctttcttggataaaaaagatctaagatgcaagatccttcccggagtcactgtttgcaagtttcaagtgaggtttaaatcagtttcaccactgtttgtattcagcccttggatctaagttccgagctgcctgtgggctgccagctattttttgcagcctaatttttccagtgatggatgaatgtaagacatcaatgtgtttattttctcatcaatatctcctggaattgctttcagttgcactcatttgctgtatataatttcctggcaaaactacttacagaatttctaaatttggtttctgtaaatccatctaagtaaaatggccaccatcatgccaagcactaaggattaagcaataaataaaacaaagctcctcaagaagtattcattctagagggaaatgacaggttaataaatatgtaaaaatgtcatgtggtgataagtgctgtaaataaaaccaagtgacacagagtgtgttttacattgaagtcagggaagacctctttgagaagatgacatttgattccagagagcagaatgtgtgagggagtgaaccaagcagaggtctcaggcagaaggaacagtcaagagcaggattatgttgttgttttatttattggagctttcttttttttttttttttggagacagaggcttactctgttgcccaggctggagtgcagtgccgcaatcttggctcactgcaagctctgcctcctgggttcaagcgattctccaacctcagcctcctgagtagctaggactacaggtgcacgccaccatgcctggctaattttttgtattttagtagagacagggtttcaccgttgttgcccaggctggtctgttggagctttgttatagtatactttaccatgattcattgagaagttctctcccaccccacctcgaccccactacccctggccagtgtactttcaacttggttgcctcaaattttaatttaagggttgggagatagggtagtgctgctaacatgaatcagttttttttccttggtgtcacttcattcaaataactgtgacactgagactattttattttattttgcctattctgcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgtaggcgcctgtgttgtttatacttaaaactcagtctctagaatctatttgtcaattttatttgatgttgtccagttgaggaagtgacactatagatcttttttttttttttgaggcagagtctccctctgtctcccagactggagtgcagtggcacggctcactgcaagctccgcctcctgggttcacaccattctcctgcctcagcctcccgagtagctgggattacaggtgcccaccaccacactcggctaatttttttgtatttttttagtagagatggggtttcaccatgttagccaggatggtctctatctcctgacctcgtgatccacccccctcagcctcccaaagtgttgggattacaggcgtgagccaccacgcccagccagatctttatttttaaaggtatcttggttgaaaacgctgaggaattttttcagcttttagtgtgcttccaatctaaactgtaagcaccaaatgacctctataaaataagacctacagatcctgcttatgcattggtttgctggatgtaagccaaggccttagcattttaatggctgaggtaatttttcaaaggaattttttttttttctttgagatggagtcttgctctgtcacccaggcgggagtgcagtggcatgatcttggctcactgcaacctctgcctcccaggttcaattgattcctgtgtctcggcctccccagtagctgggattccacgcgcctgccaccacgccgcctggctaatttttgtatttttagtagagaggggttttgccatgttggtcaggctggtcttgaactcctagcctcaggttatctgcccaccttggcctcccaaagtgctgagagtgctgagattacaggcatgagccactgtgcctggccttcaaaggacttgtgaaatcctttgaagacctttgaaggactctgaagtccttcaaagaccctgtctcaaaaaaaatactttgagacagggtctcgcttctgtcacctaggctggagtgcagtgacacgaacatggctcactgcagccttgaccttctgggctcaagtgattctcccacctcgggctcctgagtagctgggaccacaggcatgtgccactgcaccaggctaattaaaaaaaaattttttttttttttggagacagagttttgctcttgttgcccaggctggagtgcaatggcgcaatctcagctcactgcaacctctgcctcccgagttcaagcgattctcctgcctcagcctccctagtagctgggattataggcgcctgccgccacgcccagctaattttttttatttttagtagagacagggtttcactatgttggccagcctggtctcgaactcctgacctcagacgatctaccctcctcagccccccaaagtgctgggattacaggcgttagccaccacgcctggcaaatttttaaaatatttatagggacagtgtttcaccatgctgcccagaatggccttgaactcctgtgttcaaacagtcctcctgccttagcctcccaaagtcctgggattacaggagtgagccagcgtacctggcctagcttgtgctcttaatcagagtatacccatggaggttgaagttagattccagataaacgtccaatttgagaataagccagtaatttttaagttgcctcaaatgctttcttatttttttgagacggagtctcgctctgtctcccaggctggagtctcctgcctcagccttccaagtagctaggactacaggcgcccgccaccacacccggctaattttttgtatttttagtagagacggggtttcactgtgttaaccaggatggtctcgatctcctgacctcgtgatccacccacctcggcctcccaaagtgctgggattacaggtgtgagccactgcccctggcctccaaatgctttctttagtcttaaatgaaacataattaaaggcatctttgtgtaactggcgagtcagatagtgggagaagaacagtcttcttacttggaaaatcctttaaaaaagtacccagttgtgtggatgggctcaacaattaccgtttcatatcgacatgtgttggagctaactgaaatatgtacatctggagattaccttcctcacgagcagctttatgtttcctaaaccttgatattctgggtcattcctttccttgttagcaactgtaggcaagaaaaatgggggaggctgggcacggtggctcacacctgtaatcccagcactttgggaggccgaggtgggcggatcatgaggtcaggtgattgagaccatcctggctaacacaggtgaaaccctgtctctactaaaaatacaaaaaattagctgggcgtggtggcgggtgcctgtagtcccagctactcaggaggctgaggcaggagaatggcgtgaacccgggaggtggagctcgcagtgagctgagatcgcgccactgcactacagcctgggcgacagagcgagactcccatcttaaaaagaaaaaaaaagaaaacgggaggaaagtaatggaatgtgccatatggaagcttctcagaagctcaagccctcctctctgggaaaatagaaaccttgttgacttgcacattttccagtcattttttcttaattgagaatttttttaatattggagagacagtcttgctgtgttacacagactgatgttgaactcctggcctaagcagtccacctgcttcagcctcccaaaatcctgagaatacaggcatgcgccaccatgcccaaccttcagtcatcttagataccatgtaccttgggctttataagtataaaggttttgttccttacagatctcagtagtactgttaagctggtgtgcttttcaaacagtaatcaggaaagaacaacttgtgttagtattttctggcgtgcttagtgggttggtagtggtgatataggctggtagctgagcaacccagcctttctggccaaaaagtgttatgtaataatattgtttgagcaaagctgctaaatataagatcattgcattttctttcgtaggacttgattattcttagaaatgcacttgacctgcttttgccaaaggtaaggagttggcagatgtttcctaccaaccctagattccctatgttaggagataggcaccagttacaactaaatcaacacagtgtaaatttttacatagactatcattttttcaggtgaatgacaaccctatgtttaatctgtagaactaattgtttcttcttctcctttcttcttctcttcctccttctcctttcttcttcttcttgagccagagtctcattctgtcaaggggcgtgatcaaggcttattgcaacctccgcctcccaggctcagacagctctcctgtctcagtctcccaagtaggtgggagtacaggtgcatgccacctcacctggctaattttctgtagaaatggtttttgccatgttgcccaggctggtctcaaactcctgagctcaagggatccacccgtcttggcctttcaaagtgttgggattacaggtgtgagccaccgcacccagctgtctctttaaaagactaaatggtttttaaagcatagccttttttttttttttttttttttgagatggagtctcgctcagttacccaggctggagtgcagtggcacagtctcagctcactgcaagctccacctcccaggttcatgccattctcctgcctcagcctcccgaacagctgggactactggcacccgccactacgcccagctattttttttgtatttttagtagagacggggtttcaccgtgttagccaggatgatctggatcttctgacctcgtgatccgcccgtcttggcctcacaaagtgctgggattacaggcatgagccaccgcgcccggcccaagcataggcttttaaacgaagagagtgcaaccaaaggcatgttgctgggatatgtgggtcaggattatgattttgttctgtttttctgccgtggtcttaaaatagttcatgacattttaggtagtcaactcagttttcaaattttggttactgtgaactcttccaggcactttagggtacaaagatggaaggatatggctgctgcctttcatgagttagcggtctaattttatacaaaattatctgaaagttttgttcctaattatgtaatgaacacaacctgaattcaacctctttctatcacatgatctttcttgtagcttgccagagtgatctctcggcttgccgactttgctaaggaacgagccagtctacccacattaggtttcacacatttccagtaagtgataagattacttcttgtttatgtgcatatggctttcagctgcttcttgagttctctgttttccacagtaaccttgaggtgaagaatctgaaaacatgatttaaatataagtaatttgggatgcttataaggaatgagcctgatatccactgagagagtaaatctaacagttcatttgggaaacattgggaaatacatatcaagagccttgaaaaatattctttatgatagtaaacattagaaacaatctaaatgggccgggtgtggtggctcatgcctgtaaacccaccattttgggaggtcaaggtgggcagatcccttgaggttaggagttcaccaccagcctggccaatgtggtgaaacgctgtctctactaaaaatacaaacattagccagatttggtagcatgcctgtaatcccagctactcaggaggctgaggcaggagaatcacttgaacccgggacgcggaggttgcagtgagccaagatcgcaccactgcattccagtttgggtgacagagcaagactccgtctcaaaaaaaaaaaaaaagaaaaaaatctaaatgttcaataataagagaataagtaaggcatagtattcatacatccataggttggaataacatgcaaccatttaaatgatgcttacaagatctaatgtgcaaatgcacttaggtttgtgttatggtaacaaagacagtttataaattgcacaaaaattggttgaaagtacaccatgatgtaaatgttgattactctggtttatgagataataggaaaattaaatttctttctactttttgagttttgttttgtttttggagagggagtcttgctctgttgcccaggctggagtgcagtggtgtgattttggctcactctcactacaacctctacgtcctgggttcaaatgattctcccgcctcagccttcctagtagctgggactacaggcgcctaccaccatgcccggctaatttttttattgtttggagagatagggtttcgccatgttagccaggctggtctcaaactcctgacctcaagtgatctgcccacttgagatccgcccacctcggcctcccaaagtgctgggattacaggcgtgagccaccgcgcccggcctagacatttcatataaacagaatcgcatacaatatgtgaccttttgtgtctggcttctgttgctgttttcaatatccatgttgaatcagaacttcggttctttttatgactgaaaagcgttccattggttgtaccatgtttcatttacccaattgtcaacaactgatggacatttgggtaatttctactttttggctactatgaataatgctgccatgaacaagtccatgctaatttacttctttctttgcttacaccaataatctgttagcagttaacaaggaaaacagtaagattaattttggggatatactatagcttgtgatgtgcctcctatggacattcctagtgttacgccttgatgttcctagctgtcagtgtcattagcctaagaggaaagaaattccatttggaataggttaggttatctattagaaattaggctgggtccaggtgcagtggctcatgcctgtaatcccagcactttgggaggccaaggtgggtggatcacctgaggtcaggagttcaagaccagcctggctcacatggtgaaaccctgtctctactaaaaatacaaaaaaaaaaaaaaaaaaaattagccggacgcagtggcgcatgcctatagtcccagctacttgggaggctgaggcaggagaattgtttgaacctgggaggcggaggttgtagtgagccaagattgcaccattgcactccagcctaggtgacagagcgagactccacctcaaaaaaaaaaaagaaaagaaagaaagaaattaggctgggcggttaggctgggcagccgggcgcagtggatcgtgcctgtaatctcagcactttgggaggccgaggcaggtggatcacgaggtcaggaaatcaagaccagcttggccaacatggtgaaactccatgtgtgctaaaaataacacaaatagctgggtgtggtggcagatgcctgtaatcccagctactcaggaggctgaggcaggagaatcacttgaaccccggaggcagaggttgcagtgagccaagatcgcgccgctgcactccagcctgggcgacagagtgaaattccgtctccaaaaaaaaaaaaaaaagaaagaaattaggctggtcatagtgacttatggctgtaatctcggcactttgcggggccaaggcaggacgatagcttgaggcatggagttcgagaccagcctgggcaacatagggagaccatggctcttaaaaaaaataaagttagccaggtgtggtggcttgtgcctgtagttccagccactcaggaggctgaggcaggaggttggcttgagcccaggagattgaggctacagtgagctgtgattataccagcgtgtgccagcctggggtgacagagtgagaccctgtctcaaaaaagaaagaaattggacattagggcaacttattcataattatatattttgtttttttgttttgttttgagacagagtctcactctgtcacctagattggggtacagtggtgtgatctcagctcactgcagcctcagcttcccggattcaagtgattctcccacctcagcctcccaagtacctgggattacaggtgtgcaccaccacacttggccagtttttgtattttttgtagaaacagggttttaccatgttggccaggctggtctcaaactcctggcttcaagtgatccacctgcctcggcctcccaaagtgctgggattacaagcgtgagacaccgcacctggcctcgtaattatgttttatgttcagaaacagaccttcagtggcttgatttgggctttttttttttttttttttttttgacatggagtttcgcttttgtcatccaggctggagtgcagtggcacaatcttggctcaccgcagcctccgcctcctgggttcaagtgattctcctgcctcagcttcccgagtagctaggattacaggcatgcaccaccacgcctggctaattttgtatttttagtagagacggggtttctctgtgttggtcaggctggtctcaaactcccgatctcaggtgatccgccctccttggcctcccaaagtgctggaattacaggcatgagccatggcaccctactttgatttaggcttaatgctggaaacaaagccattagctgctgtgtttgagtcctctggttatgtgtgttgtgtagctgttctccatagcatgactattcctcactggatcttgactcctcacaaaggctttcctctacttccaatctagagcagccatcaccattaccttcatcgttcttttattcttttagcacttaaaatctcaataattaatcttgtttcttttttttcatttgtttttttgagacagaatctggctgtgtcgcccagtgcggtgtcacagtctcggctcattgcaacctctgcctctcaggttcgagtgattctcctgcctcagcctcccaagtagctgggattacaaacacccgccaccacgcccagttaattttttgtatttttagtagagacagggttttacctgtctctgttggccacgctggtctcgaactcctgacctcaagtgatccccccgtctcagcctcccaaagtgctgggattataggcatgagccaccgcgcctggcctaatcttgttttgttttctttttttactcgtttacaatgtaagcaagtgccactggacaaggaccctgtctgtgttattccttgttgtatttccaatagtaagagtacatcagatacttggcaaatattacacgagtatctaatgtatttcttaccaatgtctgtggatatagccatgaacaaaagggacattgtccctgcccttataataaattgtctcttgccgtgcatcacagtggttcatgcctgtaatcccaacactttggaaggctgaagtaggtggatcgcttgagacatagagtttgagaccagcctgagcaacaaagtgagaccccgtcactacaaaaaatttaaaaattagccaggcatggtattgcatgcctgtggtcccagctacatggaaggctgaggcagaaggatcacttgagctccagaggtcgaggctacagtcagctatgttcatgccactgcacttcagcttgggcaacagagcaagacccagtctagaaataataataatttaaaaattgcctcttgatgaagaaagtactatgctaatcgccttttagtttcatactccttgactatttgtaaatgacattgaatctccgtaacgattatttggttaaacattttatctcttgttttatctttaccagttactccctctcttacttaaattgttctccctccaaggggtaatggtggttattaaaagaagcaatgaaaccttgatgatttaaggtctcggtctgagactttcgtgtgttctctttgggttttcaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtattctgaaagtgacctgcaggacacagaaactcaatggtggagcctaagagacaaggctgcctttgaggatgataggagagattgactgtgggatgggtggggtctttcgactagaaggaagttgtgggggttagggagcgagacctgggtaggatgacaggttgaggcattctcacactggacacatggattattataaggatgtgtcttttctttccaaggtagagcagcttgacaagatggtgacagaaaaggcaggatttaagaggtaggtaaatgggaatgtgttggcctccctgttaagttgatggaagtcctatattcagtatacctgcagatttgaccttacaatttttgcctttttcttcctttgttcttctacccatttttttttttcctgtctctatcctgggttttactttcttactatctggattctttttttttttttttttttttcgcctaatcgtcttgctgacatattttctggatttcattttattttattattgtttttgagacagggtcttactctgtcacccaggctggagtgcagcggtgtgatctcggctcacggcagcctccgcctcccagtttcaagcagtccttccacctaagccccctgtgactacaggcatgcctggctaatttttgtattgtttttgtataatttttgtattgttttgtagagaccatgttgcccaggctggtctccaactcctgagatcaagcgatccacctgcctcagcctcaaagtgctaggattataggcatgagccaccatgcctgacctgcattctctttttgtataatctataggaaaaaagaaaatgatttacttctggtttctttagaatacctttatccatgttgttaccatttttgtttctttacttagggcccccaacaggttaggctaaatctgaccatttccattgaggtccaccaggttccaccatggctccttctcccaggcatttctattgggctgtggccagacatgggcacgttgcaccatgtatccttcttgagtcaggccattgtcctgagtattagtgaaaagggtggaagaatagtttattccaggagcaagttaccactcaggtccactggttgagtataacttagcataccaataagaccaagcttttctttaggatgtgtttttccttgtttgacagagtcatgttttgaattattattattttataagagtctcccagtgatgcttaggctggccttaacctcctgagttaaagcagtcctcctccgttagcctcctaagtagctgggactacagtcatgcaccactgcaatggctttaaaatattttaacctaagtctctcttgtacttattcctagagctttcatcatcacagggcagacatatacacgaaaagtggatattgaagtactgtctgtgctggctagcttgggggcatcagtgcacaaggtgagtggtggcagcatgtggggtggggacaggagctttgggcaccacagacagactgaattaacctcagacttttacttaaccatctctctcaagcaatattttacattagttttaataatttgtggtctgtaaatgaaacccttaaggggaagactcgttttggcattttctttaaagttatctcaagcactgcaaaacatccatcttgttcagtggtatattaaattaatcttttttttttttcgagatggagtttcgctcttgttgcccaggctggagtgcaatggtatgatctcggctcactgcaacctccacctcctgggttcgagcgagcctcccaagtagctgggattacaggcatgcaccacaatgtctggctaattttagtagaggcagggtttcaccatgttggccaggctggtctcgaactcctgacctcaggtgatccacccacctcagcctcccaaaatgctgggattacaggtgtgagccaccgcgcccatcctgaattaatcttgtgattttctttccatgatgccttaagcagtgtttcacaaaagcgttttcatgctccttgaatttgtcatcccagtccttcgggaacagagaggagtcggagtaagatactctgcaggagctctttgggaggatgcgctggtcttcagctcagccacagcacacctaagagctcatctccttcatcagcctagtcacagctcccagactctactgcacactgacagtgtggggtgatgcttattcccctacctcccccagatttgcaccgacatacgcctcctggcaaacctcaaggagatggaggaaccctttgaaaaacagcagattggtgagtgctgtgtagagacctgtgagcacacattgctgctggaaggctgtggatgggggctgagagctcattcagcatgcttgcctactcactatcctctgaagtctctctgcctttgcatcttgtcctttttttacatgggcaggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggaggtctgaaggagggacctagaagtaaaaggacatatttgagcatctctacagtctccttatccccaaggatcccagagtctagcagggaggcaaaaacataaaaaggacagtgtgataagtgttacaattggagtgtgtactgggtactgtggagcaaagaggaaggaatagtgtttgaggagtcagaaagcttcacagtagaggtgatgccttaagacttaagaaatacatgcatcttttaaagacaagatcgggagcattataaaggcacaaagcaggagaaaacacacttgagggagttactactacttgagtagccctggggaatgaagtcaacatgtgccaggaggtggggcaggacatggtcacagatagccagtttatgaaaggtcttctgggtcttttctgaaggcagatagatgtcagttgtggtgtctaggcacaatgacatcttgattagttatgagatgagtcagaaataatttgtaactactgttgaggtgccaacatgcgcatcattttctgttttatgtatatactcacttaaagcagattggcattactctcgcctgctcgcattttgctggaatttcttgagtggatacggatgtatagttaaacctagctttctgggatctgtgcataatccacgatttatctctggaaataagtcatgtgaactcattcagaagtcagccattgaatactttttagcaaggtgtgaccctgtaggtctgctgatttgcctgctaaaagaccctagcaacagtttggagagttggctgtaaggagacagggatcatgtcagaacaagttaggggctactttaaaagtctgaggccacattggtgcagtggccatgtaaatggagaggaaggatatagatccagagtcgaaggcagactggccagcccagccctggtggttgaccggagtgagtataaagagcttggtgagtggggcgctactgccatttactgaggcaggagctacaagggaggaatggcaggtatgtaatggtgagtaggaggaatgagaaagtggctgagttcagtttggggattgaggtacccatagatcaaccaggtggacgtctcactcagtaggtatgaggtctggcacttgagcaagtggtctggcctagaggtgacagatttgagggtcgtgaggttattggggtaatcataagattgaaggagattatccagagagtacagtcagtagggcaacttgttgggacacacactgcatttcactgaaattatttgtttaaagacatactgaatggctatttgttttctagacggatctgtttggccgaggcatttcttaccgcagatactatattgaatacgctgcagaacatttctgaaggattggtcgtgtaccccaaagtaagaagcctcaattcaaaagtaaagtactagggaggggttagaatgtgggagggagggtgctctggggtgtgttgagggagctgtattctgatccgataggcattcttcccacccgagctcatccttcagttcataagctctagggaactagctctgtggaattcatagacacattatagaaacagaaaaagaagtattttaaattgccttaaactatctagcagcatgaatcatcagctctggtgtgactaggcagagtagatgtctccatttgcctgtttttaagtacttgaggcagatgggttcatttctctcctatacttagctcttgaggctgagcactgatatgtaacaaataggggttttaagaattctttcaggccaggcgtggtggctcacgcctgtaattccagcactttgggaggccgaggcgggcagatcacctgaggtcaggagttcaagactagcctggccaacatggtaaaaccctgtctctactaaaaatacaaaaattagctgggcgtgttggcgggtgcctgtaatccgagctactcgggagactgaggcaggaaaattgcttgaacccaggaggtggaagttgcggtgagccgagatcgtgtcattgtactccatcctgggcaacaagaacgaaactccatctcaaaaaaaaaaaaaaaacctcttcctatgtggcaactttttttaagttaatatttcctttttaaaaatcaaaagtctgacagggcgcggtggcttacgcctgtaatcccagcactttgggatcacgaggccaggagatcaagaccatcctggctaacacagtgaaaccctgtctctactaaaaatacaaaaattatctggacgtggtggcgggcgcctgtagtcccagctactcgggaggctgaggcaggagaatggcgtgagcccaggagacggagcttgcagtgagctgagatcacgccactgcactccagcctgggcgacagagtgagactctgtctcaaaaaaaaaagaaaaaaaaaatccgaagtctgagttagtaagaaaactgaaaaaacatcatatagaataaaacaacttgttactctccataatgtggtagttagtgtctgtgctgtgcattttgtttgacatcctgctgtgtttatgactttaaccttgaggcacctttcttggtcattcaccgtatcttttcctataggtaattgaacggcgcattcggcaagagctgcctttcatggccacagagaacatcatcatggccatggtcaaagctggaggtagccgccaggtttgtaacccctcatgttcctggataagttgagagtgcacgtttggtcctgctctcttctccgtgaaggagagcagatgaaggtgtttatgtcattaccttcagtcacagtaatggtacagagcagtggccataatctgccatctatggagggtgattttggtgaactgaatttgttaaagtgaattacttaatcacttgtaggaaaagtccactcctagtgaaggaatgaggtctgacattctgtaggaaatgagcaggaaacgagcaaatgattcatgaggctttacagaagagggccagagcaaggtgggcatccatttcaggcttgtcctaagatgtgggcagagagttgagaagaccctggtacagatagacacaggaaccacctcagcctagaggggttttgtgtagagctgtgtagactgcatggatgggaagtatctgatgactttttaaaagtgttcaaacgccctgttagtagggaactgacaatacttcactgtcttcccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtaagcttccaagaagcctcttttctgctgggctgcagaacctggggtactctctttgatgtttttgctttataggaggtatggtgggaatgggctagttagaagaaaatcagagcaggttgctggctaaaacttagatatttcggttttgtttctgttttgttttgtttttttgagacagagtctctcatccaggctggagtgcagtggtgctgagtgcagtggtgctgggattataggcatgagcccccacaactgaccaagataccgctgttttgagctgcctttatttctttgtgtagattttttggaattatcttttggtcttgagaatgtggtataatggacaaagaattaggttttattgtcaggtggatctgggttaaatcgtaacctctggcatttactggctgagaaggtaaaagtaaatatctcagtgttgtaatgattgaaatgcctgagtatatactaggtgctcagtatgtgttcaggtactgtatttaattctggggattttaaaatgaatagataggctgggcgcagtggctcacaccagtaatcctagcattttgggaggccgaggcaggaggattgcttgagctcaggagttcaagaacatcctgggcaacatggtgaaaccttgtctctacaaaaaaatacaaaaattagccaggtgtggtggtgtgcgcctgtagtctctgctactcagggctgaggcgggaggatagcttgagcctaggaggtcaaggctgcagtgagccatattcattcccttgccctctggcttgggtgacaaaatgagatcctgtcttaaaaaaaatacaaagatgaatagataatcctcatcttcagagagctcaaaacttagtggtgaatacttgtaaataggtcattatgataccaagcagtacgtgcaaggactgagggctaaaagactaaaactggaggtaggagaccaataaggaggctactgcaacgggccaagcagtagatgatgagagcttgagtgaaggcagtggtgagagacacagaccggggagggagaggaggttaagctcttggtggctacttgaagagggctgggaagcaggaggaaagaagctgtggtgatttttaggttggatggaaatggtgaaaccacctgagagaacacaggctgggccagtttgcgggaaaggttggtgagcatgtgggcatggtggttgaatcatctgtgtctaggcagaaattcctgataggcagttgaggaaaacaagctcagtgttggagtaaaagcttcatcaaattaggtttcagtggtatcccctgacattggaaaaggtattatctgctaatatcttaacattttcttttgtcttgtatttgctttcctctggcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttg

SEQ ID NO: 36095 - DNA, 4738 bp, Homo sapiens
  misc_feature (46)..(46): n is a, c, g, or t
  misc_feature (232)..(233): n is a, c, g, or t
  misc_feature (683)..(683): n is a, c, g, or t
  misc_feature (827)..(827): n is a, c, g, or t
  misc_feature (839)..(839): n is a, c, g, or t
  misc_feature (841)..(841): n is a, c, g, or t
  misc_feature (845)..(845): n is a, c, g, or t
  misc_feature (847)..(847): n is a, c, g, or t
  misc_feature (967)..(967): n is a, c, g, or t
  misc_feature (1074)..(1074): n is a, c, g, or t
  misc_feature (1441)..(1441): n is a, c, g, or t
  misc_feature (1444)..(1444): n is a, c, g, or t
  misc_feature (1446)..(1446): n is a, c, g, or t
  misc_feature (1474)..(1474): n is a, c, g, or t
  misc_feature (1480)..(1480): n is a, c, g, or t
  misc_feature (1490)..(1490): n is a, c, g, or t
  misc_feature (1494)..(1494): n is a, c, g, or t
  misc_feature (1496)..(1496): n is a, c, g, or t
  misc_feature (1716)..(1716): n is a, c, g, or t
  misc_feature (1772)..(1772): n is a, c, g, or t
  misc_feature (1908)..(1908): n is a, c, g, or t
  misc_feature (1989)..(1989): n is a, c, g, or t
  misc_feature (2048)..(2048): n is a, c, g, or t
  misc_feature (2145)..(2145): n is a, c, g, or t
  misc_feature (2732)..(2732): n is a, c, g, or t
  misc_feature (2793)..(2793): n is a, c, g, or t
  misc_feature (2924)..(2924): n is a, c, g, or t
  misc_feature (3181)..(3181): n is a, c, g, or t
  misc_feature (3209)..(3209): n is a, c, g, or t
  misc_feature (3221)..(3221): n is a, c, g, or t
  misc_feature (3440)..(3440): n is a, c, g, or t
  misc_feature (3680)..(3680): n is a, c, g, or t
  misc_feature (3737)..(3737): n is a, c, g, or t
  misc_feature (3863)..(3863): n is a, c, g, or t
  misc_feature (3866)..(3866): n is a, c, g, or t
  misc_feature (3946)..(3946): n is a, c, g, or t
  misc_feature (4123)..(4123): n is a, c, g, or t
  misc_feature (4231)..(4231): n is a, c, g, or t
agtcatttcttctgcggaacctccacccctccagtgggtgcggganccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcanngccggtgccatctgtgggggctttgggccaggggtctccggacagcatgagcgtgggcttcatcggcgctggccagctggcttttgccctggccaagggcttcacagcagcaggtaggcccccaggtgggggacggtgaggcccagtgggagagactggcctctttccacttctgcagggctgggggctgaaggtgggtgctgggtcacaaggcctgagtcctgcgggaactggcaacttctgtgtgtttggggctttacctgtgctgtctcactcttcttcctgggaatggggagggagggaagccaaagctagccatgaagaggaactgtttccggccgggcgcggtggctcacgcctgtaatcccagcactttgggaggccgaggcgggcggatcacgaggtcaggagatcgagaccatcctggctaacacagtgaaaccccgtctnctactaaaaataccaaaaattagccgggtgtggtggcgggcgcctgtagtcccagctactcgggaggctgaggcaggagcatggcgtgaacccgggaggtggagcttgcagtgagccgagattgcgccactgcactccagcctngggcaacacagncngagnanctccgtctcaaaaaaaaaaaaataataaagaactgaagaggaactgtttctcccctcaggcgtcttggctgcccacaagataatggctagctccccagacatggacctggccacagtttnctgctctcagggtaggtgcagatgaaagggagaaaggagactgagtccctgtggggctgggtgtgagaggcaggagtgtgtgctgtagcccccaccccagtgagggncaggggccctgggctggggtctcatggaccccacctcctcgccctgctgattgctcttgggacctgggtggtgggcgtgtgtacagctgataggagggtgttgttctggaatggagttccctgcacagggttaaagtttcgaggggtcctctgggggcctggcaggtggggccacagcctggcagccaaggaacacacctgggggctgcttgagaccaccactcccacgtggagagcccggtctggaggacggcagtcccaggctgggggcagattggtggcatggatggagggtccttttctgtctgcagcagggacatattccacacagagttcttcctccatttctgggtgggaagggtcatcnaangnggggtggtcagagccctgagcccccagnccctgncccacccccnaacntnccagcattctctgtgccattctacctgtggggctcttggcttggtgggggtacagacagccacgggaccaggctgagcccacctgttgcccctgcagaagatgggggtgaagttgacaccccacaacaaggagacggtgcagcacagtgatgtgctcttcctggctgtgaagccacacatcatccccttcatcctggatgaaataggcgccgacattganggacagacacattgtggtgtcctgcgcggccggcgtcaccatcagctccattgagnaaggtagcaccgcaggcccagtggggtgtggagaggggctgtctagagcccgggccctcagtacttcagttttcatctgcaaaagggttgcagcgtcccggcccactgggagagctcgggcactgcttggtggggntgagtgcatctaggcactgcgtccatggccagacggacacgctggtttctcttccagaagctgtcagcgtttcggccagcnccccagggtcatccgctgcatgaccaacactccagtcgtggtgcgggagggggccaccngtgtatgccacaggcacgcacgcccaggtggaggacgggaggctcatggagcagctgctgagcagcgtgggcttctgcacggaggtggaagaggacnctgattgatgccgtcacggggctcagtggcagcggccccgcctacgtaaggactgcgggggaagctggcggcggcgggcacttcccgggaccaccgggcacatctgtccctgctccccctgggagggccagggtggagggctccaaggctgtgggaactggagcttgcccagaagggaaggaggagaagcccaggagagaggctcagggtgccttctccccacaggcattcacagccctggatgccctggctgatgggggtgtgaagatgggacttccaaggcgcctggcagtccgcctcggggcccaggccctcctggtcagtgtgtttcctgaccctctggtggggccactctttgcggggccctggggcttcactgggaggagccaagtggggcgtcagtgtgtgctacagtggctggggcagtgccccgcagaggcaggtgcgtgcccacagccgtcagcctttcttctggctgcagggggctgccaagatgctgctgcactcagaacagcacccaggccagctcaaggacaacgtcagctctcctggtggggccaccatccatgccttgcatgtgctggagnagtgggggcttccgctccctgctcatcaacgctgtggaggcctcctgcatccgcacacggntgggcccccgcgctgcccgcttccctggtctccagtccttgcatggcagaggcctctctcacacacatctgctcattcacgcactcagcagatacgtattgagctccagcccagtgttgcgcaggacacangggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccangtaggacacgcagcaacatccaggcacnaaggaaaattcncatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaacacgnaggggcctggcctcacctccagcctgcaggggagacaggtgtaaacccacatcccgtggtggggccacgagaactcaggtctggggggcactgcggggagatttggtgatgctgagctgattcgaatgaggtgagaaggagcccagcagctgtgtgggggcgtgtcgctggcagaggggaataaaggtgctgaggtgagggtgacagcatcgcccagggctgactggcactgggagctgntgggcttcactccctcttcctgggtgcacgcttgtgctccaaagccaacctctcccntgcctctctagggagctgcagtccatggctgaccaggagcaggtgtcaccagccgccatcaagaagaccatcctggacaaggtgaagctggactcccctgcagggaccgctctgtcaccttctggnccnacaccaagctgctcccccgcagcctggccccagcgggcaaggattgacacgtcctgcctgaccaccatcctgccaccacncttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattcccncaacctcaacctcctttcttctctgctcccaaaccatgtcaggaccaccttcctctagagctcgggagcccggagggtcttcacccactcctactccagtatcagctnggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 36096 - DNA, 22454 bp, Homo sapiens
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggtaggcccccaggtgggggacggtgaggcccagtgggagagactggcctctttccacttctgcagggctgggggctgaaggtgggtgctgggtcacaaggcctgagtcctgcgggaactggcaacttctgtgtgtttggggctttacctgtgctgtctcactcttcttcctgggaatggggagggagggaagccaaagctagccatgaagaggaactgtttccggccgggcgcggtggctcacgcctgtaatcccagcactttgggaggccgaggcgggcggatcacgaggtcaggagatcgagaccatcctggctaacacagtgaaaccccgtctctactaaaaataccaaaaattagccgggtgtggtggcgggcgcctgtagtcccagctactcgggaggctgaggcaggagcatggcgtgaacccgggaggtggagcttgcagtgagccgagattgcgccactgcactccagcctgggcaacacagcgagactccgtctcaaaaaaaaaaaaataataaagaactgaagaggaactgtttctcccctcaggcgtcttggctgcccacaagataatggctagctccccagacatggacctggccacagtttctgctctcagggtaggtgcagatgaaagggagaaaggagactgagtctctgtggggctgggtgtgagaggcaggagtgtgtgctgtagcccccaccccagtgagggcaggggccctgggctggggtctcatggaccccacctcctcgccctgctgattgctcttgggacctgggtggtgggcgtgtgtacagctgataggagggtgttgttctggaatggagttccctgcacagggttaaagtttcgaggggtcctctgggggcctggcaggtggggccacagcctggcagccaaggaacacacctgggggctgcttgagaccaccactcccacgtggagagcccggtctggaggacggcagtcccaggctgggggcagattggtggcatggatggagggtccttttctgtctgcagcagggacatattccacacagagttcttcctccatttctgggtgggaagggtcatcaagggggtggtcagagccctgagcccccagccctgcccacccccaactccagcattctctgtgccattctacctgtggggctcttggcttggtgggggtacagacagccacgggaccaggctgagcccacctgttgcccctgcagaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaaggtagcaccgcaggcccagtggggtgtggagaggggctgtctagagcccgggccctcagtacttcagttttcatctgcaaaagggttgcagcgtcccggcccactgggagagctcgggcactgcttggtggggtgagtgcatctaggcactgcgtccatggccagacggacacgctggtttctcttccagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgtaaggactgcgggggaagctggcggcggcgggcacttcccgggaccaccgggcacatctgtccctgctccccctgggagggccagggtggagggctccaaggctgtgggaactggagcttgcccagaagggaaggaggagaagcccaggagagaggctcagggtgccttctccccacaggcattcacagccctggatgccctggctgatgggggtgtgaagatgggacttccaaggcgcctggcagtccgcctcggggcccaggccctcctggtcagtgtgtttcctgaccctctggtggggccactctttgcggggccctggggcttcactgggaggagccaagtggggcgtcagtgtgtgctacagtggctggggcagtgccccgcagaggcaggtgcgtgcccacagccgtcagcctttcttctggctgcagggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacggtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaacacgaggggcctggcctcacctccagcctgcaggggagacaggtgtaaacccacatcccgtggtggggccacgagaactcaggtctggggggcactgcggggagatttggtgatgctgagctgattcgaatgaggtgagaaggagcccagcagctgtgtgggggcgtgtcgctggcagaggggaataaaggtgctgaggtgagggtgacagcatcgcccagggctgactggcactgggagctgtgggcttcactccctcttcctgggtgcacgcttgtgctccaaagccaacctctccctgcctctctagggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcagggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgctgcggcagggcagatggcatgggtacatcctccaccgccactctccccctggcaagagtcctggccactccccataaaacgagtacccaccacacccaggcacaaaggggacggtaggtggggtgagtccctgctgtctggctgagatctggcagtgcaggagctaagcgggggacacagatggacggtgctgggccgggagtccctgcaggctcccctgaaggccccctcctgtatgggtggatgtgggcatcagggcgggtggggaatgcccttgtgtcagggctgtgagcaatagaataaccccctgccccagcaaagtgcctggcagtgctgggagaccctggcaactcctcccacctgggcagaggtgcccccagaagagattgtcccacaggccacacgcctgtcccaggaccaaagctgccccgaccattcccctcaaagccagtttccctgctagcgcccattctcaggtgctgacgcagagcaagacgaggggcgcggggctgccaaaggtgcttctggtccggggacacaagggaagccagcaggcgacgcgggtttcaagtgaggcagactggtcttgggctccagaggaagcacagggaggtgaggaggtgtgtggggggctgcagacgggctttgcaaggaggcgtttgcttcagcaggcgggccctaggagctttcccactgtgggttcctgattaagcagaggccagaggcaggtagagccagagtccacaggaggctcctgacgtgcgtgagaagtctggggaggtaggtgaggcaggctgtggggaggtggacacccaggaagccacagagcgtgaggacgggcccaccccaagtagcaacatgttttatgtgggcctcagcaggtcaaggagggagatggtgccgggggccaaggacccaaggatcctgccaagaagcgtcgaaacgctgccaggcagaggaaccctacagggggcccctgggggctggccagatggtgctttccctgctcctgtcaccagcagctctgacacctctcagtcctggaaagccccctccaaaaatgaagcggtttggagtgagtccccagcaggccaggtgggccctggaggaggagctgcccgcctctgcttggctcagcttctgcccccatttatttttcattttcctttttttttagagaggttctctgtcgcccaggctggagtgcagtggtatgatcacagctcactgcagcctgcaacccctgggcacaagcaatcctcccacgtcagcctcctgaatagctgggacaacaggtgtgcaccaccatgcccagctttttttttttttttttcttgtagcgatagggtctctatgttaccaatgctggtctcaaactcccgggctcaagcgattctcccactgcctcccaaagtgctgggattataggcttgagacactgcacccggcctgccgcagtttcttggttggaattgccctgactccagcttgccagctggggcccttgccctgcccaattctgccacgcctcttcagtgcccggctgacccctgtccatggtacttgtgcaggacaggctcagactctggaaccagtgggtcagcagcccctggccaggcagagatgggcaatgtccaccctgggagggccctgcctggagaccagggagagcagggctggactggacccgtctgggtgtggacgctagcacctccctcccggcagcatctggctgagatctgctgctctcaggaggaaccgatggggtcttaaggtcagtcccacagaagctgcagcctggggcgggaggatgccggggaagtgcctgcggggctcagtcccacagaaggtgcagcctggggcgggaggatgccggggaggtgcctgcggggctcagtcccacagaagctgcagcctggggcgggagggtgcccgggaggtgcctgcgggggccagtcccacagaaggtgcagcctggggcgggaggatgcccgggaggtgcctgcgggaggaggcatccagctgtgacgggaagtgagctcctggaggtgcagagaagtccaaacagggagccaggcctcaaggccgcacttaaagccggtcgtggagatgagtgtgcggagtgagagggatgcttggaaacctgtgggcctctctcgcagtatccctctcagtacagtagcctttcgcggttctggtggcctcatggtttggcccaagcatggctgcaccactgtgtccagggacaagtgtcctgggctctccgtggggagctggccaggagccgctggggaggtgaggagatcttcgtgcagagccagtgccagccctcactgaccacggaacaccttcagctctctaggaggacagggagacaggtcctaggggtttggcttgggctgtttccacgtggcacctcccctccctcgatactctttctacaagccaccgtatgctactctgcaggtgcctgggaccccacccaccccaagaagattctggggtgaggggcagcaaaggagcctgggcagctccctgagtgtcctccccagcccgtcctgcccatctctatgacagtgcccagggaggggaggactgaggctccttcccaggagaagacagcaccgcagtgaggacgattcataaatccgttccaaattcgcgcggaggtgcaaatgagagcgggctcgaccctgtgaggaggagttggggtgtgggagtgagtggggacagcctggtgagcgtctgcccgcggggtgggggctgccagccccagggccaatcacccctggctcctgacggcaccgtggctccagctcccgctgtgtggcacggagggcgggtcctgaggagactcgggggcccgccaggtccccgctgtgtggacctagccctcaccgcccagcaatgcacgacttcaccctcccgcggagcaggatgcccagcggctcagggcgccctcccctcgccagcccagtgtggtgtggtaggatgaggacgcgagcagggaggagaggcaggagacggagctgcactcctggcctcagggccccgtgtgctgttttgtacactaaggttgaggcctcggaagccacgccaggaccatatcatgcccctagagcctgtgagactcgggctgtgtccagagcagggggagcaggtccccgacgactaaggacaccaccgtaagaaccacacgcagccccacagcgcacacggcgacaacgtgctgtggggctcggaggagttcctggggtctggcagggacaggcggagggacgcttctgagccttacacctcacggcttcgggactttggggccggcctgttcatggacggagcccaggaggaccccacagcccgtccccgccccttcctccccgctcacctgctggcggggcggccacccttcccctcccaggattcacagctgcgaagggaagagggtggaggagaaagtccagacacgggatcccccgtttatcttcctcccgagtcctcgccccctaccgctgggcatctccaacaagcagcgaagtctcccccgggcggagctctgggtacacgtggcgcaggaagggcctgggcagctcggggtctgctgcgcgggcggggatcgcccctcgctgctgggagctgccaggccgtccccgccccgcgccgctccgggacccccgagttggaatcgcggggccccggcggcgccgtcctgacgcaagagcgcctctgcctggcagggcccaggccggcactcgagggggcgcacgcagagcctgccctaggctgagcactcgagctggaaaacgccgccggcgtccgcgagcttggacaggggccctggacggcgggcgcaggagccaggcgaggcaggctccggctgcaggacgccgggggctgggggtggagacctggcgctttggccgtgcgcccaggcccgcccgtgagaccccgccaggcgctagagcagccagtgttgccagggacgacggcgcgcgggttgcgcatgcgcagtttgccctcccgccgccgcgccttcccctttaagcgccggccggccgcgtcgccgcttcatgaatggagcccacgtgaccaaacatcatgtgacgtctgtggagcggcggcggcggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtggtgagtgcggctgcggcggcgggcccgggcggtgggggcggcgcggcgggggcggcgggggccgagggggcgcgcaggcagggctcctcccggagctaggcgggcggttgggggcccggcggcgggggccgctggtttcgggtctgccgcgcaccctgctggcggcccgtgcctcgatttccccagcggtcaggagccagctcctcctgcccctggcgcccgggtactggaggtgggccgcgggcggcggcggacccgcggagccgggcgagtgcggagcggactcggagacccgggcgtcctggagggaggggcactggacggcgggaggaaagggtggggtcgagcgaggcgcccgggggtccgcgccagggcccggcggcccggcccgcagctgctgattcatccggtggccgcgtcagctctccccggcgcgggggtccgcggcgagcccgggaggaggggcggcgatgggggtgctgcggggaagaccctgcccctggctggggctcgggttccgtcagtcgcgtgccagagcccggagggagacttgctgagtcatcagcgtgaggtcactcggtgctcaagctgataccggaggggattcgagcgaggggcctcggggactaaaaggccgccagcgggaggtgggagggagccgtggggatgtgggagggggccaggcccggcgccttggggtgcctgtttaagtgagcgccgagcgatccagttgaaggcaggggtgcttgaagaggaagtgggggtggctcgctgcaggtgttctcccggggtcaaaggtgaagccccgggcggtccaccccttcccaggcggctcttttccggcagctggtcctggtcccaagtctggagcagttttccaaactgggaaatagttccctgagtgagggaggggaggagcttcggtgggccgagctagccaaaggggaagtcggctttccctgggactggcctggttggacagcccctggccagagatcgaggtcctgggagaaagaggggtgtgtgtaccaagccctgggtgacagtgggctgggcagggaggaagcaggggcagctctaccaggaaacggcaaaggggaggaagcagcccagcctctctccccagttggccctggagtctgggttgagactgtaggtggtgggagcttcagggtgcctagccttggggtgcagcagatgggctggtgtggatggcacagggtggcagaacgcagcacccagccaccctaaagttgtcgctacctgaagtggggtctcagcgttgtgtgaagttagcaaagggagtggccctgttgggtgtctggcctggcagcccaggacgcttagaaagtggcagcttgggagtgatgtggccagagccacctttccttgggtatgtggagattcacgaaggttgacttcctttgcccaggagttcatttcatggctgggttaggctactttgtggtttgccctcagggatgccccccgccccccgccacacacacacacacacacacacacacacaggtccattctcagtgagcaccccccacacatacacacagaacacaggtccactctcagtgagccccggggcttatagattccagatgtttcaatgttttagctgaccgttggcctggagtttgatgccctgggaaaattttggggtcctggagggacatttatgtacatctttttttttttttttttttgagacggagtctcactcttttgcccaggctggagtgcagtggcgcgatctcagctcactgcaagctctgcctcccaggttcacgccgttctcctgcctcagcctcccgagtagctgggactacaggcgcccaccacgacgcccggctatttttttgtatttttagtagagacggggtttcaccgtgttagccaggatggtctcgatctcctgacctcgtaatccacccacctcggcctcccaaagtgttgggattacaggtgtgagccaccgcgcggcccatttatgtacatcttctcagtcacttatgcatcagtggaaactaagttttaggttctgttcaaagagtgactttcaggagctgagagcttatggagcagaggccatgactgccggggagtttcggccgctgggctttgcagccaggtggggctgtctgtgttcaggcacgggagtttctactttagccaaaggagacggagctcccaaatctccctccctttcctggctctcagtgtgaatgggtggcctaggtaccctcgcaggttgcggagccgtgaccatctgtgcctcctgcgtgaggtgggcttattagcctctgggagcagagggtgcatgacaggccccagctctgcccagccttgagggctggaggagggcgggggcagcttctcctcagtccagctcctgggatccctgcatggtccctctcagcccaggtccagaggccaggccaggagcctggaacgcactggctgtgctcagggctgcccctcccccaccccccggcgcacctttgataggaggcgatggcttgcacttgtgctgagttcaggccttctgcggagggcaaaatctgtcgaggaggcacttttccgtgtgatctcttcaggaagtcaccactgtcattgtgcttagcagcaggggtgggggcgatgggggtgggagaagctggtgccagggcagtgtctctgcaccctgacttgcactcaaggctggggggcccctccatgcttggctgagggcctgtctcctggggcagtgttgtgccggacgtgtaggaaagggctcctgtgggccttctgacctccagctcaggtcttccccatcctttatctggaagaatccagtggctggagcctcgggaccttgcctctgagctggcttggctgtggggaggggtctctggcctcccctccctgctctgtgcttgcagcctcacctcctggtcccaggctgggtgaggtggagtcttgagcctggtgaggatgtgtgcatccgcctggccacacttcagctcccctgatgagagtaagaagccccccagcccataatttcctgaagtgatcctagctcctctggaggagtctcccatctgtctgcatcaaacctggaaagtgggggatggagcatgaggcgggggtccatgcccaagggtctggtgggagctgggctgagctgggaatcccagaaacatccttagcaagaaagtgagagcagagtgctggagggaccccgagtggggaagagttggttgttaagtccggccaccccagcacttttgtttttgctccctggccctgtgggcactcacccggggcagggaccagagagcaggctgcagctcggaggggctgactccgccagccttcacgttgggcaggcccggggtggctcactgtgggagcccttgtgaaataccctggatggggtggggcaggggctgcttcctgcaacccaaagccacaggatggttactccatcagtggaggaggccgactgggaggtctagaggggcctcgggccaggctcctcccagctgatggcctgccacctggaaggtgggggaactccctggtcagtcctgccaacagaccagagctagatggacggcccacccccagcttttcaaagttaggaggctgggagactcggggttccctgtagcctcctctctggccaggtcccccgtggggcccctgtgcacccagggagcagggggctttgtccgaggccggctcaggggaggtggctgtagaaggtaggaccctggaagatgcacacacagggtcactggctggccctcacctgctattggccaggctgggggctgcggctctcgtggggcgctgttggctggcgggccagggagtgcgggcgcggcggggaggcagaggcaatgtgctgagtcagcgtgactcgccaggaacagccgcgctctgggcagtgccggggttatttttaaagctcccggcttccttctaggcctgcctctcccgcgtcttattccttctaatctctcccccgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcaggtattgggggctgggcacctggacagcaggctggggcgggctgtgcggcaagggctcttgtgaactgggccgggggcggggggggggggggtgcggcgagggtggtctccagggtactgacctgctccgtgtcttgcagagagcgcctgctcgctgtgcccccgggttatgacgacccccaataaaggaaacaaggccttgaaggtgagtgggcagggacaggagcctgtgggctggggtcggggggcacagtgggcgtgcccgcttggcctgtgaccacctgcactgtgccccaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatcgctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagagactggcaggtgcttctttggggcgacgcggcgggcggagccggaaggggtgggtgggggcggggcccatcttgcgcatgcgccctgagcgcggcctgccgtgtgaggcggaagcggaagagcaggtctccaggggagcgatggcagccgggggtctgagccgctccgagcgcaaagcggcggagcgggtccggaggttgcgggaggagcagcagagggagcgcctccgccaggtacgccgccgccgctccccggcccggccatgcccggcccgcgccgccgctcaccgtccgcctgcccgcaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggcgagttccgcgtgcggcgcgcgggcgcccccggtttcgggagcagctggggcgacgggcggtcccgggtggggcggcccggggcggtgaccaccctggcgtcttggcaggtgtgcgacgacccggaggagctgcgggggaaggtccgggagctggccagcgccgtccggaacgccaaatacttggtcgtctacacaggcgcgggaatcagcacggtagggagggaggcggaggcgtaccccaggacggagtatgagctccagtaatcgcgaaaaactcgcctttaaagcagctctaaggttttttctcttaaagaaacgaaatgaccaaaacttacctaaggtaaacgctttttaaacgcttggcctctgtgttacagccagttaaaaaaaacaaggagtagagatacgaatggggtgtagtagccgactgctcgcaggcacccccaggttatgtggacagagctaagcccaaagttgtgattttccactctgttctgtccatgtcgagggaagataagtagaaagtgacacagtaagagccagaatacaccaggtgaaggagagaattgcattgtgttttgagaagtttcactgacaagttatcctgggctgtgggacatcactagctttgaaagtgtagctggcacctcgtccatctaatttgatgggtgtgtgtggggtgttgggcacgcgtcggcctagcagatctgaacccaggtgatttctgttctcaggaagcttttaggtgacaaggatcaggcatgtgaacaaataaccatactgtaaagctggctgtgctgggtcgctagagcaaactcagacacacactctgcgctcttggagttgggaaacccacctgcgttggctttttgtgggaggtggccttgattgggccttgaaggatgggtgagatttacagaaggttggaatgaggcactccaagcaaagaacagcagaggctcagcagcaagaatgcaaaaagggagttcactactgactcaaatacccggagccctggggtttagtctcctccctccacaagtcacatgtaaaagtccagtcatgctgggcgcggtggctcatgcctataatcctagcactttgggaggccgaggtgggcggatcatgaggtcagtagttcaagaacaacctggccaacacggtgaaaccctgtctctactaaaaatacaaaaattagtcgggcatggtggtgggcacctgcaatcccagctactcgagaggctgaggcaggagaatcacttgaaactggaaggcggaggttgcagtgagccgagatcatgccactgcattccagcctgggcgaaagagctaaactccgtctctcaaaaaaaaaaaaaaaaaaaaaagtccagtcatgtaattatgtaacagtcacgtgacctgttatggaacttccaatggcaactaaaagcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttaggtaagcgggccaggcatggcctcccacataggctgggcagcggcagcacgggcctgagctccagctctcctcaccttgccttcctttctgcctggcagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttccaggtgcagcatgtggtgtctcagaactgtgacgggctccacctgaggagtgggctgccgcgcacggc

SEQ ID NO: 36097 - DNA, 16839 bp, Homo sapiens
atggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagccgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggcagaggcccagccggcggagaagtccctgggagtgagtacctggggatgaactatgctgcctggtgctggggagcagtggcgcccctgggccatccctctgctgaaacctgggcgtctcgctgaagagaccacctccatttcctctgcagagactgagcactcagtcagcccccttcctgggacaggctcaatggaggctgcagggccatcagccgactcctacgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagtctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctgggatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaaggagacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacatcccctgaggctccacgggtagcagagggagcccttgtcccctggaccgtgtccttggctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgggggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcactctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgcaacctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcagcctcccaaagtgctgggattgcaggcatgagccaccacgccgggccgatttccttttctgtagtgatgttaacaatttagtttataaaattatattttattgtttattaaatatgtaacataggccaggtgcggtggctcacacctgtaatcccagcactttgggaggccgaggtgggtggatcacctgaggtcagcacttcagggccagcctgggcaacatggcaagactccgtgcctacaaaaaataaaaaacaaaaaaaattagctggacatggaggcacgccggcctgtggtcccagctacttgggagacagaggtgggaggatcacctgggggaggtgggcagaggttaaagtgagctgaggtcatgcccctgcattctagcctgggcaatagagcaagaccctatctaaaaaaaaaaaaggaacaatatattttattactttatctcaaattataattttattaattttaactacaaaagcaattaatatattctcctggttaaaaaaaaccttaaatattgcagataaacctggtgcccatctagccacctctctctatccaagtgggaacaaatttctttttctatccttctggtccattttttttaagtgacctgtgcatatggttttaaaactttaaatagtatctaaaacatttgaacaaaatgaagccaacatgtgctgaatgttttcatgtcaagctttgtgctaaggcctggatgtgggcaccattcacacgttcatctcacagatgagaaaacaggtcctgcgaggcacgcgcctggcccacagctgtgctcgtgctgggtcttgaatccactctgctccattgctcctgctgccctgtgcctcgctctgcagaggacttcccatagatgtgttactctctccacccctcctttacaggggctggtggttgtgggttccctggaaccataaatttggggtgtcccagtgctttggggagcaaggtccccgactcaagtggactgccagcaactaaattaatgggggatcctcaaagagagtgttagggaggcaagcagtaggtgggaagcttggacaagccccaaatgcctcagggacctttctgtattttttttttgagacaggctcttactctgtcgcctggactggcatgatctaggctcactgcaacctccacccccctggctcaagtgatcctcccacctcagcctcctgagtagctggggctataggcatgcgtcaccatgcccaactaatttttttgttttttggtagagacagggtttcaccatgttgcccaggctggtcttgaactcctggactcaagtgatccacctctcttggcctcccaaactgctgggattataaatatgagccaccatggccagctgatttttttgtttgtttgtttgagatggagtctcactctgtcactcaggctggagtgcagtggagtgatctcggctcactgcaacctccacctcctgggttcaagcaattctcctgccttagcctcctgagtagctgggattacaggcacccgtcaccacactggctaattttttttttttttttttgaggcggagtctctatctgttgcccaggctggagcacggtggcacaatctcggttcactgcaagctccgcctcccaggttcacgccattctcctgagtcagcctcccaagtagctgggactacaggtgcccgccaccgcgcctggctaattttttgtatttttagtagagacagggtttcactgtgccagccaggatggtctcgatctcctgacctcatgatccgcccacctcggcctcccaaagtgctaggaccacagacaggcgtgagccactgcgtctggcctaatttttgtatttttagtagagatggggtttcaccatgttggtcaggctggtctcgaactactgacctcgtgatccacccgccttggcctcccaaagtgctgggattgcaggcgtgagccaccgcgcccggccttttttttttttttttttaagatagggtttcactcttgtcccacaggctggtgtgcagtggcttgatctcagctcactgcaacctctgccccctgggttcaagcgattctcgtgtctcagactctgaaacaactgaaattacaggtgcgcgctaccacgcccggctaatttttgtatttttagtagggacagggttttgccctgttgtccaggttggtcctgaactcctgacttcaagtgatctgcctgcctcagcctcccaaagtgctgggattataggcatgagccaccacacccagcctgaatcatttttgtaatttaaaaatttaacgcaaaaagaataaaacttagcaataacaaaaatgcacaaaagatggaaagaaatccacccctgacctttgtggagagatgacctctgataacagtctcagggtgaacgggcacctctgataacagtctcagggtgaacgggcatcccgagacactgttagcagaggtggtccatgtccatgctgtccgcgttacaataattacactatgtttattcttaaggttttaaaaacatttatttttaacaaattttctttgaaaagctaccgtgtgcacgtgagaaaatctcaacaagaccacagggcacccgtgagaagaagctcctcccagtctggggcccctccccaggcacagccttccacacatctaccagaggcacccacgcatagagaagcacccacaagcagttttctttctttcttttatttgagacggtgtttccttctgttgcccaggcttgagtgcagtggcatgacataagctcactgcaacctccacctcccgagttcgtgtgattctccgcctcagcctcccaagcagctgggattacaggtgctcgccaccacgcctggctaatttttgtatttttagtagagacagggttttgccatgttggccaggctggtcttgaactcctgacctcagatgatccactgcctcagcctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcgactcaccacaacctctgcctcctgggttcaagcaattctcctgcctcagcctctcgagtagctgggagtacaggtgcgcgccaccatgcctggctaatttttgtatttttgggagagatggagtttcactatgttggccaggctggtctcgaactcctgacctcgtgacccacccgcctctgcctcccaaagtgcagggattatgggggtgagccaccgtgcccagctatgagtggttttgtttctatttatttattattattctatgagacagagtctcactctgtcgcccacgctggagtacagtggtgcaatcttggcttactgcaacctccgtctcctgggttcaagcaattcttctgcctcagcttccggagtagctggaacgtgtgagccaccacccctggctaatttttgtatttttagtagagacaggctggtctcgaactcctgacttccggtgatctgcccacctcagcctcccaaattgttggtattacaggcgtgagccaccgcacctggcctctatttatttatttattttgagatggggtcttgatatgaattcctagactcatgcttctcatgcttgctaccacccagtcctgcctcctgcacagcagtttccactaaagtcacccctttacgagaggcatcttttttttttttttgagatggtgtctcactctgtcgcccaggctggagtgcaatggcatgatctcagctcactgcaagctccacctcctgggttcaagtgattctcctgcttcagcctcccgagtagctgggactacaggcacccgccaccattcccggctaattttttgtatctttagtagagacggggtttcaccatgttagccaggatggtctcgatctcctgacttcgtgatccacccgcctcggcctcccaaagtgttgggattacaggcatgagccactgtacctggcctactagaggcatcttaaaacacatctcctgtgtctccattccaaagcgcatctttgtctacactcctggggtcctcccacgtcagcctcccaaagtgctgggattacagtcatgagccactgtgcccggccccaccaaattgttttctaacctgcttttttcttgaggaatcttctgcagcacatgactcacatgtagagccccttgtttcttgaggccttcatacccgtcagctcatctaaaagtcactcctgaggagtaagggcaaggggcattgggagaggtcaggcagccctgggaagcctcccagcgtgtgtcccaggaggcctgctgcctgcagacactgctcccagacgcagcggcctcggccatcagagcgtgtcccacgatgaggtggcaacttccctgaagggcttgctctcacccaggggtgtggttctccgtgtgcacacagatagatagttctacgtttgccatataccatttatatgcctcacacagattaacccactttcatttcaaaaagacctcctgtcatcgtgcccattgtacagatgaggacactgagacacggaatcctagtgacctgtgcaaggtcacacagctgggaagggtgagggaagcgtctgtgaacccagcaggcccagcccctgagtctaggctccgctcggcagctgtcatgggagcagagtccgagaagcactgcaggcacctgctctagggggagagaggtggaggtggcaggtagagagaggacgacccctgggagctgagacgatgccagcctcacacggacaggctgggtgacctcaggcaagtcgcttcccatttgggaccccaaggacccttctgcagacccagctgggggtccccgatgagactggctctcagagtccctgtgagtcccgtcagctgaggccagtaatgtcctggcaccatcactggacatggtttgctctcccatggaggggcaggtgtagcagccaaaagcgatcctgagctctgggcctctgaaccctgctctgccagctactgtgggtgtctctacccgctctgtgtctcagttccctttcctgaaaagaggggatagtaaaaactaaccctcaaggtgtttattaccaatgcccttcatggaggaatccgctgctccaggcccttgccagcagctgcacagctgggcctggggacctgggtgtgggtctgttgaaccttggcccaccctggggctgtggtcggcctggacgtgtaggtgtggaggtgcatatttattatggcaattttctgacaggtaacagagtgtggggctctcttctgaatggggctcgtggaggccgtgggtcaaaagccctaattttgtagtgagggctaaaaggcttcacaagggaaagggcctggctggggctatgggccggtgccgaccccccctctcccactttgtttgcagttctgggaagtcatcagtgatgagcatggcatcgaccccagcggcaactacgtgggcgactcggacttgcagctggagcggatcagcgtctactacaacgaggcctcttgtgagtgcctgccccagcctccctatcccagccctggactgaccaggtctcagcgtctgactgaccaggtctcagcacctggactcaccagctctcagcatctctgtcctcccatgggttaggttggctgagatgccagcaggcgtaactggatgtcaggcatccagacgcacagaacagacaataaatcacagtcacaaaagtgagagccaaacatattagtgccatgagggcctgtgcgtgtccaggggcacagacagggatggggcaggccagagactttggaggccataagagggcctagagaaggggtcacctggagggcttagtcaggggctctttagcaactggtgtgaagtgatttccatatcaaagtggtgatacacccacctgcccacatggacatgtgatttaaaattttatttaatttaatagagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatgtgagcaggaggatggcaggcgggcacagaattcagaaagaatgagggagaggctctggccctctgtgacccgaatcaccgagcccctctctcccctcagctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccatgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagactctgtccagagccctcgtcctgagcactcagcagcatcggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt
